(12) United States Patent
Troukhan et al.

(10) Patent No.: US 7,989,676 B2
(45) Date of Patent: Aug. 2, 2011

(54) NUCLEOTIDE SEQUENCES AND CORRESPONDING POLYPEPTIDES CONFERRING MODULATED PLANT CHARACTERISTICS

(75) Inventors: Maxim Troukhan, Agoura Hills, CA (US); Gregory Nadzan, Woodland Hills, CA (US); Peter Mascia, Thousand Oaks, CA (US); Joel Rarang, Granada Hills, CA (US); James Burns, Valley Village, CA (US); Kyle Vos Strache, Mountain View, CA (US)

(73) Assignee: Ceres, Inc., Thousand Oaks, CA (US)

( * ) Notice: Subject to any disclaimer, the term of this patent is extended or adjusted under 35 U.S.C. 154(b) by 637 days.

(21) Appl. No.: 11/897,944

(22) Filed: Aug. 31, 2007

(65) Prior Publication Data

US 2008/0072340 A1    Mar. 20, 2008

Related U.S. Application Data

(60) Provisional application No. 60/841,779, filed on Aug. 31, 2006.

(51) Int. Cl.
*C12N 15/29* (2006.01)
*C12N 15/82* (2006.01)
*C12N 5/04* (2006.01)
*A01H 5/00* (2006.01)
*A01H 5/10* (2006.01)

(52) U.S. Cl. .................. 800/278; 435/320.1; 435/419; 800/290; 800/298; 800/320.1; 800/287

(58) Field of Classification Search .................. None
See application file for complete search history.

(56) References Cited

OTHER PUBLICATIONS

Ralph et al (2004, NCBI Accession No. CV267710).*
Jaglo et al (2001, Plant Physiology 127:910-917).*
Bowie et al, Science 247:1306-1310, 1990.*
McConnell et al, Nature 411 (6838):709-713, 2001.*

* cited by examiner

*Primary Examiner* — Stuart F. Baum
(74) *Attorney, Agent, or Firm* — Birch, Stewart, Kolasch and Birch, LLP

(57) ABSTRACT

The present invention relates to isolated nucleic acid molecules and their corresponding encoded polypeptides able confer the trait of modulated plant size, vegetative growth, organ number, plant architecture, sterility or seedling lethality in plants. The present invention further relates to the use of these nucleic acid molecules and polypeptides in making transgenic plants, plant cells, plant materials or seeds of a plant having such modulated growth or phenotype characteristics that are altered with respect to wild type plants grown under similar conditions.

13 Claims, No Drawings

NUCLEOTIDE SEQUENCES AND CORRESPONDING POLYPEPTIDES CONFERRING MODULATED PLANT CHARACTERISTICS

CROSS-REFERENCE TO RELATED APPLICATIONS

This application claims priority under 35 USC §119(e) of provisional application 60/841,779, filed Aug. 31, 2006, the entire contents of which are hereby incorporated by reference.

INCORPORATION-BY-REFERENCE OF SEQUENCE LISTING OR TABLE

The material in the accompanying sequence listing is hereby incorporated by reference into this application. The accompanying file, named 2007-08-27 Sequence Listing 2750-1694PUS2.txt was created on Aug. 24, 2007 and is 13,263 KB. The file can be accessed using Microsoft Word on a computer that uses Windows OS.

FIELD OF THE INVENTION

The present invention relates to isolated nucleic acid molecules and their corresponding encoded polypeptides able to modulate plant characteristics. The present invention further relates to using the nucleic acid molecules and polypeptides to make transgenic plants, plant cells, plant materials or seeds of a plant having modulated phenotypic and growth characteristics as compared to wild-type plants grown under similar conditions.

BACKGROUND OF THE INVENTION

Plants specifically improved for agriculture, horticulture, biomass conversion, and other industries (e.g. paper industry, plants as production factories for proteins or other compounds) can be obtained using molecular technologies. As an example, great agronomic value can result from modulating the size of a plant as a whole or of any of its organs or the number of any of its organs.

Similarly, modulation of the size and stature of an entire plant, or a particular portion of a plant, allows production of plants better suited for a particular industry. For example, reductions in the height of specific crops and tree species can be beneficial by allowing easier harvesting. Alternatively, increasing height, thickness or organ number may be beneficial by providing more biomass useful for processing into food, feed, fuels and/or chemicals. Other examples of commercially desirable traits include increasing the length of the floral stems of cut flowers, increasing or altering leaf size and shape or enhancing the size of seeds and/or fruits. Changes in organ size, organ number and biomass also result in changes in the mass of constituent molecules such as secondary products and convert the plants into factories for these compounds.

Availability and maintenance of a reproducible stream of food and feed to feed people has been a high priority throughout the history of human civilization and lies at the origin of agriculture. Specialists and researchers in the fields of agronomy science, agriculture, crop science, horticulture, and forest science are even today constantly striving to find and produce plants with an increased growth potential to feed an increasing world population and to guarantee a supply of reproducible raw materials. The robust level of research in these fields of science indicates the level of importance leaders in every geographic environment and climate around the world place on providing sustainable sources of food, feed and energy for the population.

Manipulation of crop performance has been accomplished conventionally for centuries through plant breeding. The breeding process is, however, both time-consuming and labor-intensive. Furthermore, appropriate breeding programs must be specially designed for each relevant plant species.

On the other hand, great progress has been made in using molecular genetics approaches to manipulate plants to provide better crops. Through introduction and expression of recombinant nucleic acid molecules in plants, researchers are now poised to provide the community with plant species tailored to grow more efficiently and produce more product despite unique geographic and/or climatic environments. These new approaches have the additional advantage of not being limited to one plant species, but instead being applicable to multiple different plant species (1).

Despite this progress, today there continues to be a great need for generally applicable processes that improve forest or agricultural plant growth to suit particular needs depending on specific environmental conditions. To this end, the present invention is directed to advantageously manipulating plant characteristics in traits such as appearance, architecture, biomass, composition, confinement, development, nitrogen use, nutrient uptake, phosphate use, photosynthetic capacity, shade avoidance, stress tolerance, vigor, flowering time and yield to maximize the benefits of various crops depending on the benefit sought and the particular environment in which the crop must grow, characterized by expression of recombinant DNA molecules in plants. These molecules may be from the plant itself, and simply expressed at a higher or lower level, or the molecules may be from different plant species.

SUMMARY OF THE INVENTION

The present invention, therefore, relates to isolated nucleic acid molecules and polypeptides and their use in making transgenic plants, plant cells, plant materials or seeds of plants having modulated plant characteristics, with respect to wild-type plants grown under similar or identical conditions, in traits such as appearance, architecture, biomass, composition, confinement, development, nitrogen use, nutrient uptake, phosphate use, photosynthetic capacity, shade avoidance, stress tolerance, vigor, flowering time and yield. (sometimes hereinafter collectively referred to as modulated growth and phenotype characteristics).

Unless otherwise defined, all technical and scientific terms used herein have the same meaning as commonly understood by one of ordinary skill in the art to which this invention belongs.

DETAILED DESCRIPTION OF THE INVENTION

The present invention relates to isolated nucleic acid molecules and their corresponding encoded polypeptides able to confer the trait of modulated plant size, vegetative growth, organ number, plant architecture, sterility or seedling lethality in plants. The present invention further relates to the use of these nucleic acid molecules and polypeptides in making transgenic plants, plant cells, plant materials or seeds of a plant having such modulated growth or phenotype characteristics that are altered with respect to wild type plants grown under similar conditions.

1. DEFINITIONS

The following terms are utilized throughout this application:

Biomass refers to useful biological material including a product of interest, which material is to be collected and is intended for further processing to isolate or concentrate the product of interest. Biomass may comprise the fruit, or parts of it, or seeds, leaves, or stems or roots where these are the parts of the plant that are of particular interest for the industrial purpose. Biomass, as it refers to plant material, includes any structure or structures of a plant that contain or represent the product of interest.

Amino acid refers to one of the twenty biologically occurring amino acids and to synthetic amino acids, including D/L optical isomers.

Cell type-preferential promoter or tissue-preferential promoter refers to a promoter that drives expression preferentially in a target cell type or tissue, respectively, but may also lead to some transcription in other cell types or tissues as well.

Control plant refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

Domains are groups of substantially contiguous amino acids in a polypeptide that can be used to characterize protein families and/or parts of proteins. Such domains have a fingerprint or signature that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or to 55 amino acids, or 45 to 60 amino acids, or 200 to 300 amino acids, or 300 to 400 amino acids.

Down-regulation refers to regulation that decreases production of expression products (mRNA, polypeptide, or both) relative to basal or native states.

Exogenous with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

Expression refers to the process of converting genetic information of a polynucleotide into RNA through transcription, which is catalyzed by an enzyme, RNA polymerase, and into protein, through translation of mRNA on ribosomes.

Functional Homologs are those proteins that have at least one functional characteristic in common. Such characteristics include sequence similarity, biochemical activity, transcriptional pattern similarity and phenotypic activity. Typically, the functionally comparable proteins share some sequence similarity or at least one biochemical. Within this definition, analogs are considered to be functionally comparable. In addition, functionally comparable proteins generally share at least one biochemical and/or phenotypic activity.

Heterologous sequences are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence, are considered heterologous to said coding sequence. Elements operatively linked in nature and contiguous to each other are not heterologous to each other. On the other hand, these same elements remain operatively linked but become heterologous if other filler sequence is placed between them. Thus, the promoter and coding sequences of a corn gene expressing an amino acid transporter are not heterologous to each other, but the promoter and coding sequence of a corn gene operatively linked in a novel manner are heterologous.

Heterologous polypeptide refers to a polypeptide that is not a naturally occurring polypeptide in a plant cell, e.g., a transgenic *Lycopersicon* plant transformed with and expressing the coding sequence for a kinase polypeptide from a *Glycine* plant.

Percentage of sequence identity refers to the degree of identity between any given query sequence and a subject sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gin, Glu, Arg, and Lys; residue-specific gap penalties: on. The output is a sequence alignment that reflects the relationship between sequences. ClustalW can be run, for example, at the Baylor College of Medicine Search Launcher site and at the European Bioinformatics Institute site on the World Wide Web.

In case of the functional homolog searches, to ensure a subject sequence having the same function as the query sequence, the alignment has to be along at least 80% of the length of the query sequence so that the majority of the query sequence is covered by the subject sequence. To determine a percent identity between a query sequence and a subject sequence, ClustalW divides the number of identities in the best alignment by the number of residues compared (gap positions are excluded), and multiplies the result by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Isolated nucleic acid includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

Misexpression refers to an increase or a decrease in the transcription of a coding region into a complementary RNA sequence as compared to the wild-type. This term also encompasses expression and/or translation of a gene or coding region or inhibition of such transcription and/or translation for a different time period as compared to the wild-type and/or from a non-natural location within the plant genome, including a gene coding region from a different plant species or from a non-plant organism.

Modulation of the level of a compound or constituent refers to the change in the level of the indicated compound or constituent that is observed as a result of expression of, or transcription from, an exogenous nucleic acid in a plant cell. The change in level is measured relative to the corresponding level in control plants.

Nucleic acid and polynucleotide are used interchangeably herein, and refer to both RNA and DNA, including cDNA, genomic DNA, synthetic DNA, and DNA or RNA containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

Operably linked refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

Polypeptide as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

Progeny includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

Regulatory region refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell,* 1:977-984 (1989).

Up-regulation refers to regulation that increases the level of an expression product (mRNA, polypeptide, or both) relative to basal or native states.

Vector refers to a replicon, such as a plasmid, phage, or cosmid, into which another DNA segment may be inserted so as to bring about the replication of the inserted segment. Generally, a vector is capable of replication when associated with the proper control elements. The term vector includes cloning and expression vectors, as well as viral vectors and integrating vectors. An expression vector is a vector that includes a regulatory region.

$T_0$ refers to the whole plant, explant or callus tissue, inoculated with the transformation medium.

$T_1$ refers to either the progeny of the $T_0$ plant, in the case of whole-plant transformation, or the regenerated seedling in the case of explant or callous tissue transformation.

$T_2$ refers to the progeny of the $T_1$ plant. $T_2$ progeny are the result of self-fertilization or cross-pollination of a $T_1$ plant.

$T_3$ refers to second generation progeny of the plant that is the direct result of a transformation experiment. $T_3$ progeny are the result of self-fertilization or cross-pollination of a $T_2$ plant.

2. THE INVENTION

The invention of the present application may be described by, but not necessarily limited to, the following exemplary embodiments.

The present invention discloses novel isolated nucleic acid molecules, nucleic acid molecules that interfere with these nucleic acid molecules, nucleic acid molecules that hybridize to these nucleic acid molecules, and isolated nucleic acid molecules that encode the same protein due to the degeneracy of the DNA code. Additional embodiments of the present application further include the polypeptides encoded by the isolated nucleic acid molecules of the present invention.

More particularly, the nucleic acid molecules of the present invention comprise: (a) a nucleotide sequence encoding an amino acid sequence that is at least 85% identical to any one of the polypeptides in the sequence listing (SEQ ID Nos. 1-4084), (b) a nucleotide sequence encoding an amino acid sequence that is at least 85% identical to any one of the polypeptides from *Populus balsamifera* in the sequence listing (SEQ ID Nos. 1-4084), (c) a nucleotide sequence that is complementary to any one of the nucleotide sequences according to (a) and (b), (d) a nucleotide sequence according to any one of the nucleotides in the sequence listing SEQ ID Nos. 1-4084, (e) a nucleotide sequence able to interfere with any one of the nucleotide sequences according to (a) and (b), (f) a nucleotide sequence able to form a hybridized nucleic acid duplex with the nucleic acid according to any one of paragraphs (a)-(d) at a temperature from about 40° C. to about 48° C. below a melting temperature of the hybridized nucleic acid duplex, (g) a nucleotide sequence encoding any one of the polypeptide sequences from *Populus balsamifera* in the sequence listing, (h) a nucleotide sequence encoding any one of the polypeptide sequences given in the sequence listing.

The present invention further embodies a vector comprising a first nucleic acid having a nucleotide sequence encoding a plant transcription and/or translation signal, and a second nucleic acid having a nucleotide sequence according to the isolated nucleic acid molecules of the present invention. More particularly, the first and second nucleic acids may be operably linked. Even more particularly, the second nucleic acid may be endogenous to a first organism, and any other nucleic acid in the vector may be endogenous to a second organism. Most particularly, the first and second organisms may be different species.

In a further embodiment of the present invention, a host cell may comprise an isolated nucleic acid molecule according to the present invention. More particularly, the isolated nucleic acid molecule of the present invention found in the host cell of the present invention may be endogenous to a first organism and may be flanked by nucleotide sequences endogenous to a second organism. Further, the first and second organisms may be different species. Even more particularly, the host cell of the present invention may comprise a vector according to the present invention, which itself comprises nucleic acid molecules according to those of the present invention.

In another embodiment of the present invention, the isolated polypeptides of the present invention may additionally comprise amino acid sequences that are at least 85% identical to any one of the polypeptides in the sequence listing.

Other embodiments of the present invention include methods of introducing an isolated nucleic acid of the present invention into a host cell. More particularly, an isolated nucleic acid molecule of the present invention may be contacted to a host cell under conditions allowing transport of the isolated nucleic acid into the host cell. Even more particularly, a vector as described in a previous embodiment of the present invention, may be introduced into a host cell by the same method.

Methods of detection are also available as embodiments of the present invention. Particularly, methods for detecting a nucleic acid molecule according to the present invention in a sample. More particularly, the isolated nucleic acid molecule according to the present invention may be contacted with a sample under conditions that permit a comparison of the nucleotide sequence of the isolated nucleic acid molecule with a nucleotide sequence of nucleic acid in the sample. The results of such an analysis may then be considered to determine whether the isolated nucleic acid molecule of the present invention is detectable and therefore present within the sample.

A further embodiment of the present invention comprises a plant, plant cell, plant material or seeds of plants comprising an isolated nucleic acid molecule and/or vector of the present invention. More particularly, the isolated nucleic acid molecule of the present invention may be exogenous to the plant, plant cell, plant material or seed of a plant.

A further embodiment of the present invention includes a plant regenerated from a plant cell or seed according to the present invention. More particularly, the plant, or plants derived from the plant, plant cell, plant material or seeds of a plant of the present invention preferably has increased size (in whole or in part), increased vegetative growth, increased organ number and/or increased biomass (sometimes hereinafter collectively referred to as increased biomass), lethality, sterility or ornamental characteristics as compared to a wild-type plant cultivated under identical conditions. Furthermore, the transgenic plant may comprise a first isolated nucleic acid molecule of the present invention, which encodes a protein involved in modulating growth and phenotype characteristics, and a second isolated nucleic acid molecule which encodes a promoter capable of driving expression in plants, wherein the growth and phenotype modulating component and the promoter are operably linked. More preferably, the first isolated nucleic acid may be mis-expressed in the transgenic plant of the present invention, and the transgenic plant exhibits modulated characteristics as compared to a progenitor plant devoid of the gene, when the transgenic plant and the progenitor plant are cultivated under identical environmental conditions. In another embodiment of the present invention the modulated growth and phenotype characteristics may be due to the inactivation of a particular sequence, using for example an interfering RNA.

A further embodiment consists of a plant, plant cell, plant material or seed of a plant according to the present invention which comprises an isolated nucleic acid molecule of the present invention, wherein the plant, or plants derived from the plant, plant cell, plant material or seed of a plant, has the modulated growth and phenotype characteristics as compared to a wild-type plant cultivated under identical conditions.

Another embodiment of the present invention includes methods of modulating growth and phenotype characteristics in plants. More particularly, these methods comprise transforming a plant with an isolated nucleic acid molecule according to the present invention.

In yet another embodiment, lethality genes of the invention can be used to control transmission and expression of transgenic traits, thereby facilitating the cultivation of transgenic plants without the undesired transmission of transgenic traits to other plants. Such lethality genes can be also be utilized for selective lethality, by combining the lethal gene with appropriate promoter elements for selective expression, to thereby cause lethality of only certain cells or only under certain conditions.

3. Important Characteristics of the Polynucleotides and Polypeptides of the Invention The nucleic acid molecules and polypeptides of the present invention are of interest because when the nucleic acid molecules are mis-expressed (i.e., when expressed at a non-natural location or in an increased or decreased amount relative to wild-type) they produce plants that exhibit modulated growth and phenotype characteristics as compared to wild-type plants, as evidenced by the results of various experiments disclosed below. This trait can be used to exploit or maximize plant products. For example, the nucleic acid molecules and polypeptides of the present invention are used to increase the expression of genes that cause the plant to have modulated growth and phenotype characteristics.

Because some of the disclosed sequences and methods increase vegetative growth, the disclosed methods can be used to enhance biomass production. For example, plants that grow vegetatively have an increase biomass production, compared to a plant of the same species that is not genetically modified for substantial vegetative growth. Examples of increases in biomass production include increases of at least 5%, at least 10%, at least 20%, or even at least 50%, when compared to an amount of biomass production by a plant of the same species not growing vegetatively.

The life cycle of flowering plants in general can be divided into three growth phases: vegetative, inflorescence, and floral (late inflorescence phase). In the vegetative phase, the shoot apical meristem (SAM) generates leaves that later will ensure the resources necessary to produce fertile offspring. Upon receiving the appropriate environmental and developmental signals the plant switches to floral, or reproductive, growth and the SAM enters the inflorescence phase (I) and gives rise to an inflorescence with flower primordia. During this phase the fate of the SAM and the secondary shoots that arise in the axils of the leaves is determined by a set of meristem identity genes, some of which prevent and some of which promote the development of floral meristems. Once established, the plant enters the late inflorescence phase (12) where the floral organs are produced. If the appropriate environmental and developmental signals the plant switches to floral, or reproductive, growth are disrupted, the plant will not be able to enter reproductive growth, therefore maintaining vegetative growth.

As more and more transgenic plants are developed and introduced into the environment, it can be important to control the undesired spread of the transgenic triat(s) from transgenic plants to other traditional and transgenic cultivars, plant species and breeding lines, thereby preventing cross-contamination. The use of a conditionally lethal gene, i.e. one which results in plant cell death under certain conditions, has been suggested as a means to selectively kill plant cells containing a recombinant DNA (see e.g., WO 94/03619 and US patent publication 20050044596A1). The use of genes to control transmission and expression of transgenic traits is also described in U.S. application Ser. No. 10/667,295, filed on Sep. 17, 2003, which is hereby incorporated by reference. Some of the nucleotides of the invention are lethal genes, and can therefore be used as conditionally lethal genes, namely genes to be expressed in response to specific conditions, or in specific plant cells. For example, a gene that encodes a lethal trait can be placed under that control of a tissue specific promoter, or under the control of a promoter that is induced in response to specific conditions, for example, a specific chemical trigger, or specific environmental conditions.

Male or female sterile genes can also be used to control the spread of certain germplasm, such as by selective destruction of tissue, such as of the tapetum by fusing such a gene to a tapetum-specific promoter such as, TA29. Further examples of such promoters are described below.

The sequences of the invention can be applied to substrates for use in array applications such as, but not limited to, assays of global gene expression, under varying conditions of development, and growth conditions. The arrays are also used in diagnostic or forensic methods.

The polynucleotides of the invention are also used to create various types of genetic and physical maps of the genome of corn, *Arabidopsis*, soybean, rice, wheat, or other plants. Some are absolutely associated with particular phenotypic traits, allowing construction of gross genetic maps. Creation of such maps is based on differences or variants, generally referred to as polymorphisms, between different parents used in crosses. Common methods of detecting polymorphisms that can be used are restriction fragment length polymorphisms (RFLPs, single nucleotide polymorphisms (SNPs) or simple sequence repeats (SSRs).

The use of RFLPs and of recombinant inbred lines for such genetic mapping is described for *Arabidopsis* by Alonso-Blanco et al. (*Methods in Molecular Biology*, vol. 82, *Arabidopsis Protocols*, pp. 137-146, J. M. Martinez-Zapater and J. Salinas, eds., c. 1998 by Humana Press, Totowa, N.J.) and for corn by Burr (Mapping Genes with Recombinant Inbreds, pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) *Genetics* 134: 917). This procedure, however, is not limited to plants and is used for other organisms (such as yeast) or for individual cells.

The polynucleotides of the present invention are also used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping is achieved using various methods. In one instance, polymorphisms are identified when sequence specific probes contained within a polynucleotide flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms are identified by using the PCR fragment produced from the SSR-flanking sequence specific primer reaction as a probe against Southern blots representing different individuals (U. H. Refseth et al., (1997) *Electrophoresis* 18: 1519).

The polynucleotides of the invention can further be used to identify certain genes or genetic traits using, for example, known AFLP technologies, such as in EP0534858 and U.S. Pat. No. 5,878,215.

The polynucleotides of the present invention are also used for single nucleotide polymorphism (SNP) mapping.

The polynucleotides of the invention can be used with the various types of maps discussed above to identify Quantitative Trait Loci (QTLs). Many important crop traits, such as the solids content of tomatoes, are quantitative traits and result from the combined interactions of several genes. These genes reside at different loci in the genome, often times on different chromosomes, and generally exhibit multiple alleles at each locus. The polynucleotides of the invention are used to identify QTLs and isolate specific alleles as described by de Vicente and Tanksley (*Genetics* (1993) 134:585). Once a desired allele combination is identified, crop improvement is accomplished either through biotechnological means or by directed conventional breeding programs (for review see Tanksley and McCouch (1997) *Science* 277:1063). In addition to isolating QTL alleles in present crop species, the polynucleotides of the invention are also used to isolate alleles from the corresponding QTL of wild relatives.

In addition, the polynucleotides of the present invention can be used for marker assisted breeding. Marker assisted breeding uses genetic fingerprinting techniques to assist plant breeders in matching a molecular profile to the physical properties of a variety. This allows plant breeders to significantly accelerate the speed of natural plant breeding programs. Marker assisted breeding also allows better retention of sequences that participate in QTLs.

Following the procedures described above and using a plurality of the polynucleotides of the present invention, any individual can be genotyped. These individual genotypes are used for the identification of particular cultivars, varieties, lines, ecotypes and genetically modified plants or can serve as tools for subsequent genetic studies involving multiple phenotypic traits.

4. The Genes of the Invention

The polynucleotides of the present invention and the proteins expressed via translation of these polynucleotides are set forth in the Sequence Listing, specifically the polynucleotides described in any one of SEQ ID Nos. 1-4084. The Sequence Listing also consists of functionally comparable proteins that can be utilized for the purposes of the invention, namely to make transgenic plants with modulated growth and phenotype characteristics, including ornamental and compositional characteristics.

5. Use of the Genes to Make Transgenic Plants

To use the sequences of the present invention or a combination of them or parts and/or mutants and/or fusions and/or variants of them, recombinant DNA constructs are prepared that comprise the polynucleotide sequences of the invention inserted into a vector and that are suitable for transformation of plant cells. The construct can be made using standard recombinant DNA techniques (see, 16) and can be introduced into the plant species of interest by, for example, *Agrobacterium*-mediated transformation, or by other means of transformation, for example, as disclosed below.

The vector backbone may be any of those typically used in the field such as plasmids, viruses, artificial chromosomes, BACs, YACs, PACs and vectors such as, for instance, bacteria-yeast shuttle vectors, lamda phage vectors, T-DNA fusion vectors and plasmid vectors (see, 17-24).

Typically, the construct comprises a vector containing a nucleic acid molecule of the present invention with any desired transcriptional and/or translational regulatory sequences such as, for example, promoters, UTRs, and 3' end termination sequences. Vectors may also include, for example, origins of replication, scaffold attachment regions (SARs), markers, homologous sequences, and introns. The vector may also comprise a marker gene that confers a selectable phenotype on plant cells. The marker may preferably encode a biocide resistance trait, particularly antibiotic resistance, such as resistance to, for example, kanamycin, bleomycin, or hygromycin, or herbicide resistance, such as resistance to, for example, glyphosate, chlorosulfuron or phosphinothricin.

It will be understood that more than one regulatory region may be present in a recombinant polynucleotide, e.g., introns, enhancers, upstream activation regions, transcription terminators, and inducible elements. Thus, more than one regulatory region can be operably linked to said sequence.

To operably link a promoter sequence to a sequence, the translation initiation site of the translational reading frame of said sequence is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al. (1989) *Plant Cell* 1:977-984.

A basal promoter is the minimal sequence necessary for assembly of a transcription complex required for transcription initiation. Basal promoters frequently include a TATA box element that may be located between about 15 and about 35 nucleotides upstream from the site of transcription initiation. Basal promoters also may include a CCAAT box element (typically the sequence CCAAT) and/or a GGGCG sequence, which can be located between about 40 and about 200 nucleotides, typically about 60 to about 120 nucleotides, upstream from the transcription start site.

The choice of promoters to be included depends upon several factors, including, but not limited to, efficiency, selectability, inducibility, desired expression level, and cell- or tissue-preferential expression. It is a routine matter for one of skill in the art to modulate the expression of a sequence by appropriately selecting and positioning promoters and other regulatory regions relative to said sequence.

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucleus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano, et al. (1989) *Plant Cell,* 1:855-866; Bustos, et al. (1989) *Plant Cell,* 1:839-854; Green, et al. (1988) *EMBO J.* 7, 4035-4044; Meier, et al. (1991) *Plant Cell,* 3, 309-316; and Zhang, et al. (1996) *Plant Physiology* 110: 1069-1079.

Examples of various classes of promoters are described below. Some of the promoters indicated below are described in more detail in U.S. Patent Application Ser. Nos. 60/505,689; 60/518,075; 60/544,771; 60/558,869; 60/583,691; 60/619,181; 60/637,140; Ser. Nos. 10/950,321; 10/957,569; 11/058,689; 11/172,703; 11/208,308; and PCT/US05/23639. It will be appreciated that a promoter may meet criteria for one classification based on its activity in one plant species, and yet meet criteria for a different classification based on its activity in another plant species.

Other Regulatory Regions: A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation.

Examples of 3' UTRs include, but are not limited to, polyadenylation signals and transcription termination sequences, e.g., a nopaline synthase termination sequence.

Various promoters can be used to drive expression of the genes of the present invention. Nucleotide sequences of such promoters are set forth in SEQ ID NOs: 4085-4186 Some of them can be broadly expressing promoters, others may be more tissue preferential.

A promoter can be said to be broadly expressing when it promotes transcription in many, but not necessarily all, plant tissues or plant cells. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO: 4184), YP0144 (SEQ ID NO: 4163), YP0190 (SEQ ID NO: 4167), p13879 (SEQ ID NO: 4183), YP0050 (SEQ ID NO: 4143), p32449 (SEQ ID NO: 4185), 21876 (SEQ ID NO: 4109), YP0158 (SEQ ID NO: 4165), YP0214 (SEQ ID NO: 4169), YP0380 (SEQ ID NO: 4178), PT0848 (SEQ ID NO: 4134), and PT0633 (SEQ ID NO: 4115). Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root-active promoters drive transcription in root tissue, e.g., root endodermis, root epidermis, or root vascular tissues. In some embodiments, root-active promoters are root-preferential promoters, i.e., drive transcription only or predominantly in root tissue. Root-preferential promoters include the YP0128 (SEQ ID NO: 4160), YP0275 (SEQ ID NO: 4171), PT0625 (SEQ ID NO: 4114), PT0660 (SEQ ID NO: 4117), PT0683 (SEQ ID NO: 4122), and PT0758 (SEQ ID NO: 4130). Other root-preferential promoters include the PT0613 (SEQ ID NO: 4113), PT0672 (SEQ ID NO: 4119), PT0688 (SEQ ID NO: 4123), and PT0837 (SEQ ID NO: 4132), which drive transcription primarily in root tissue and to a lesser extent in ovules and/or seeds. Other examples of root-preferential promoters include the root-specific subdomains of the CaMV 35S promoter (Lam et al. (1989) *Proc. Natl. Acad. Sci. USA* 86:7890-7894), root cell specific promoters reported by Conkling et al. (1990) *Plant Physiol.* 93:1203-1211), and the tobacco RD2 gene promoter.

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin gene promoter (Bustos et al. (1989) *Plant Cell* 1(9):839-853), the soybean trypsin inhibitor promoter (Riggs et al. (1989) *Plant Cell* 1(6):609-621), the ACP promoter (Baerson et al. (1993) *Plant Mol Biol,* 22(2):255-267), the stearoyl-ACP desaturase gene (Slocombe et al. (1994) *Plant Physiol* 104(4):167-176), the soybean α' subunit of β-conglycinin promoter (Chen et al. (1986) *Proc Natl Acad Sci USA* 83:8560-8564), the oleosin promoter (Hong et al. (1997) *Plant Mol Biol* 34(3):549-555), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al. (1993) *Mol. Cell Biol.* 13:5829-5842), the beta-amylase gene promoter, and the barley hordein gene promoter. Other maturing endosperm promoters include the YP0092 (SEQ ID NO: 4146), PT0676 (SEQ ID NO: 4120), and PT0708 (SEQ ID NO: 4125).

Promoters that drive transcription in ovary tissues such as the ovule wall and mesocarp can also be useful, e.g., a polygalacturonidase promoter, the banana TRX promoter, and the melon actin promoter. Other such promoters that drive gene expression preferentially in ovules are YP0007 (SEQ ID NO: 4138), YP0111 (SEQ ID NO: 4154), YP0092 (SEQ ID NO: 4146), YP0103 (SEQ ID NO: 4151), YP0028 (SEQ ID NO: 4141), YP0121 (SEQ ID NO: 4159), YP0008 (SEQ ID NO: 4139), YP0039 (SEQ ID NO: 4142), YP0115 (SEQ ID NO: 4155), YP0119 (SEQ ID NO: 4157), YP0120 (SEQ ID NO: 4158) and YP0374 (SEQ ID NO: 4176).

In some other embodiments of the present invention, embryo sac/early endosperm promoters can be used in order drive transcription of the sequence of interest in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.,* 32:571-57; Conceicao (1994) *Plant,* 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics,* 142:1009-1020); maize Cat3 (see, GenBank No. L05934; Abler (1993) *Plant Mol. Biol.,* 22:10131-1038). Other promoters include the following *Arabidopsis* promoters: YP0039 (SEQ ID NO: 4142), YP0101 (SEQ ID NO: 4149), YP0102 (SEQ ID NO: 4150), YP0110 (SEQ ID NO: 4153), YP0117 (SEQ ID NO: 4156), YP0119 (SEQ ID NO: 4157), YP0137 (SEQ ID NO: 4161), DME, YP0285 (SEQ ID NO: 4172), and YP0212 (SEQ ID NO: 4168). Other promoters that may be useful include the following rice promoters: p530c10 (SEQ ID NO: 4187), pOsFIE2-2 (SEQ ID NO: 4188), pOsMEA (SEQ ID NO: 4189), pOsYp102 (SEQ ID NO: 4190), and pOsYp285 (SEQ ID NO: 4191).

Promoters that preferentially drive transcription in zygotic cells following fertilization can provide embryo-preferential expression and may be useful for the present invention. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654, YP0097 (SEQ ID NO: 4148), YP0107 (SEQ ID NO: 4152), YP0088 (SEQ ID NO: 4145), YP0143 (SEQ ID NO: 4162), YP0156 (SEQ ID NO: 4164), PT0650 (SEQ ID NO: 4116), PT0695 (SEQ ID NO: 4124), PT0723 (SEQ ID NO: 4127), PT0838 (SEQ ID NO: 4133), PT0879 (SEQ ID NO: 4136) and PT0740 (SEQ ID NO: 4128).

Promoters active in photosynthetic tissue in order to drive transcription in green tissues such as leaves and stems are of particular interest for the present invention. Most suitable are promoters that drive expression only or predominantly such tissues. Examples of such promoters include the ribulose-1, 5-bisphosphate carboxylase (RbcS) promoters such as the RbcS promoter from eastern larch (*Larix laricina*), the pine cab6 promoter (Yamamoto et al. (1994) *Plant Cell Physiol.* 35:773-778), the Cab-1 gene promoter from wheat (Fejes et al. (1990) *Plant Mol. Biol.* 15:921-932), the CAB-1 promoter from spinach (Lubberstedt et al. (1994) *Plant Physiol.* 104: 997-1006), the cab1R promoter from rice (Luan et al. (1992) *Plant Cell* 4:971-981), the pyruvate orthophosphate dikinase (PPDK) promoter from corn (Matsuoka et al. (1993) *Proc Natl Acad. Sci. USA* 90:9586-9590), the tobacco Lhcb1*2 promoter (Cerdan et al. (1997) *Plant Mol. Biol.* 33:245-255), the *Arabidopsis thaliana* SUC2 sucrose-H+ symporter promoter (Truernit et al. (1995) *Planta* 196:564-570), and thylakoid membrane protein promoters from spinach (psaD, psaF, psaE, PC, FNR, atpC, atpD, cab, rbcS. Other promoters that drive transcription in stems, leafs and green tissue are PT0535 (SEQ ID NO: 4111), PT0668 (SEQ ID NO: 4110), PT0886 (SEQ ID NO: 4137), PR0924 (SEQ ID NO: 4192), YP0144 (SEQ ID NO: 4163), YP0380 (SEQ ID NO: 4178) and PT0585 (SEQ ID NO: 4112).

In some other embodiments of the present invention, inducible promoters may be desired. Inducible promoters drive transcription in response to external stimuli such as chemical agents or environmental stimuli. For example, inducible promoters can confer transcription in response to hormones such as giberellic acid or ethylene, or in response to light or drought. Examples of drought inedible promoters are YP0380 (SEQ ID NO: 4178), PT0848 (SEQ ID NO: 4134), YP0381 (SEQ ID NO: 4179), YP0337 (SEQ ID NO: 4174), YP0337 (SEQ ID NO: 4174), PT0633 (SEQ ID NO: 4172), YP0374 (SEQ ID NO: 4176), PT0710 (SEQ ID NO: 4126), YP0356 (SEQ ID NO: 4175), YP0385 (SEQ ID NO: 4181), YP0396 (SEQ ID NO: 4182), YP0384 (SEQ ID NO: 4180), PT0688 (SEQ ID NO: 4123), YP0286 (SEQ ID NO: 4173), YP0377 (SEQ ID NO: 4177), and PD1367 (SEQ ID NO: 4186). Examples of promoters induced by nitrogen are PT0863 (SEQ ID NO: 4135), PT0829 (SEQ ID NO: 4131), PT0665 (SEQ ID NO: 4118) and PT0886 (SEQ ID NO: 4137). An example of a shade inducible promoter is PR0924 (SEQ ID NO: 4192).

Other Promoters: Other classes of promoters include, but are not limited to, leaf-preferential, stem/shoot-preferential, callus-preferential, guard cell-preferential, such as PT0678 (SEQ ID NO: 4121), and senescence-preferential promoters. Promoters designated YP0086 (SEQ ID NO: 4144), YP0188 (SEQ ID NO: 4166), YP0263 (SEQ ID NO: 4170), PT0758 (SEQ ID NO: 4130), PT0743 (SEQ ID NO: 4129), PT0829 (SEQ ID NO: 4131), YP0119 (SEQ ID NO: 4157), and YP0096 (SEQ ID NO: 4147), as described in the above-referenced patent applications, may also be useful. Other useful promoters include AtGGPS1 (SEQ ID NO: 4089), AtBASL (SEQ ID NO: 4090), AtBBE5 (SEQ ID NO: 4095), AtWDC (SEQ ID NO: 4106) and YP0019 (SEQ ID NO: 4140).

Alternatively, misexpression can be accomplished using a two component system, whereby the first component consists of a transgenic plant comprising a transcriptional activator operatively linked to a promoter and the second component consists of a transgenic plant that comprise a nucleic acid molecule of the invention operatively linked to the target-binding sequence/region of the transcriptional activator. The two transgenic plants are crossed and the nucleic acid molecule of the invention is expressed in the progeny of the plant. In another alternative embodiment of the present invention, the misexpression can be accomplished by having the sequences of the two component system transformed in one transgenic plant line.

Another alternative consists in inhibiting expression of a growth or phenotype-modulating polypeptide in a plant species of interest. The term expression refers to the process of converting genetic information encoded in a polynucleotide into RNA through transcription of the polynucleotide (i.e., via the enzymatic action of an RNA polymerase), and into protein, through translation of mRNA. Up-regulation or activation refers to regulation that increases the production of expression products relative to basal or native states, while down-regulation or repression refers to regulation that decreases production relative to basal or native states.

A number of nucleic-acid based methods, including antisense RNA, ribozyme directed RNA cleavage, and interfering RNA (RNAi) can be used to inhibit protein expression in plants. Antisense technology is one well-known method. In this method, a nucleic acid segment from the endogenous gene is cloned and operably linked to a promoter so that the antisense strand of RNA is transcribed. The recombinant vector is then transformed into plants, as described above, and the antisense strand of RNA is produced. The nucleic acid segment need not be the entire sequence of the endogenous gene to be repressed, but typically will be substantially identical to at least a portion of the endogenous gene to be repressed. Generally, higher homology can be used to compensate for the use of a shorter sequence. Typically, a sequence of at least 30 nucleotides is used (e.g., at least 40, 50, 80, 100, 200, 500 nucleotides or more).

Thus, for example, an isolated nucleic acid provided herein can be an antisense nucleic acid to one of the aforementioned nucleic acids encoding a biomass-modulating polypeptide. A nucleic acid that decreases the level of a transcription or translation product of a gene encoding a growth or phenotype-modulating polypeptide is transcribed into an antisense nucleic acid similar or identical to the sense coding sequence of the growth or phenotype-modulating polypeptide. Alternatively, the transcription product of an isolated nucleic acid can be similar or identical to the sense coding sequence of a growth or phenotype-modulating polypeptide, but is an RNA that is unpolyadenylated, lacks a 5' cap structure, or contains an unsplicable intron.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman, et al. (1995) *Proc. Natl. Acad. Sci. USA,* 92(13):6175-6179; de Feyter and Gaudron, Methods in Molecular Biology, Vol. 74, Chapter 43, Expressing Ribozymes in Plants, Edited by Turner, P. C, Humana Press Inc., Totowa, N.J. RNA endoribonucleases such as the one that occurs naturally in *Tetrahymena thermophila*, and which have been described extensively by Cech and collaborators can be useful. See, for example, U.S. Pat. No. 4,987,071.

Methods based on RNA interference (RNAi) can be used. RNA interference is a cellular mechanism to regulate the expression of genes and the replication of viruses. This mechanism is thought to be mediated by double-stranded small interfering RNA molecules. A cell responds to such a double-stranded RNA by destroying endogenous mRNA having the same sequence as the double-stranded RNA. Methods for designing and preparing interfering RNAs are known to those of skill in the art; see, e.g., WO 99/32619 and WO 01/75164. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of the biomass-modulating polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller (1997) *Antisense Nucleic Acid Drug Dev.,* 7:187-195; Hyrup et al. (1996) *Bioorgan. Med. Chem.,* 4:5-23. In addition, the deoxyphosphate backbone can be replaced with, for example, a phosphorothioate or phosphorodithioate backbone, a phosphoroamidite, or an alkyl phosphotriester backbone.

Transformation

Nucleic acid molecules of the present invention may be introduced into the genome or the cell of the appropriate host plant by a variety of techniques. These techniques, able to transform a wide variety of higher plant species, are well known and described in the technical and scientific literature (see, e.g., 28-29).

A variety of techniques known in the art are available for the introduction of DNA into a plant host cell. These techniques include transformation of plant cells by injection (30), microinjection (31), electroporation of DNA (32), PEG (33), use of biolistics (34), fusion of cells or protoplasts (35), and via T-DNA using *Agrobacterium tumefaciens* (36-37) or *Agrobacterium rhizogenes* (38) or other bacterial hosts (39), for example.

In addition, a number of non-stable transformation methods that are well known to those skilled in the art may be desirable for the present invention. Such methods include, but are not limited to, transient expression (40) and viral transfection (41).

Seeds are obtained from the transformed plants and used for testing stability and inheritance. Generally, two or more generations are cultivated to ensure that the phenotypic feature is stably maintained and transmitted.

A person of ordinary skill in the art recognizes that after the expression cassette is stably incorporated in transgenic plants and confirmed to be operable, it can be introduced into other plants by sexual crossing. Any of a number of standard breeding techniques can be used, depending upon the species to be crossed.

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver,*

*Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea*.

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), Triticosecale (triticum-wheat X rye) and bamboo.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava).

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, brussel sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), Spinacea oleracea (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii,* and *Tanacetum parthenium*.

Suitable species also include *Parthenium argentatum* (guayule), *Hevea* spp. (rubber), *Mentha spicata* (mint), *Menthapiperita* (mint), *Bixa orellana,* and *Alstroemeria* spp.

Suitable species also include *Rosa* spp. (rose), *Dianthus caryophyllus* (carnation), *Petunia* spp. (petunia) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple, *Hordeum vulgare* (barley), *Poa pratensis* (bluegrass), *Lolium* spp. (ryegrass) and *Phleum pratense* (timothy).

Thus, the methods and compositions can be used over a broad range of plant species, including species from the dicot genera *Brassica, Carthamus, Glycine, Gossypium, Helianthus, Jatropha, Parthenium, Populus,* and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum,* and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

Homologues Encompassed by the Invention

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Nucleic acid molecules of the present invention can comprise sequences that differ from those encoding a protein or fragment thereof selected from the group consisting of the nucleotide sequences in the sequence listing due to the fact that the different nucleic acid sequence encodes a protein having one or more conservative amino acid changes.

Biologically functional equivalents of the polypeptides, or fragments thereof, of the present invention can have about 10 or fewer conservative amino acid changes, more preferably about 7 or fewer conservative amino acid changes, and most preferably about 5 or fewer conservative amino acid changes. In a preferred embodiment of the present invention, the polypeptide has between about 5 and about 500 conservative changes, more preferably between about 10 and about 300 conservative changes, even more preferably between about 25 and about 150 conservative changes, and most preferably between about 5 and about 25 conservative changes or between 1 and about 5 conservative changes.

Identification of Useful Nucleic Acid Molecules and their Corresponding Nucleotide Sequences Some of the nucleic acid molecules, and nucleotide sequences thereof, of the present invention were identified by use of a variety of screens that are predictive of nucleotide sequences that provide plants with altered size, vegetative growth, organ number, plant architecture and/or biomass. One or more of the following screens were, therefore, utilized to identify the nucleotide (and amino acid) sequences of the present invention.

The present invention is further exemplified by the following examples. The examples are not intended to in any way limit the scope of the present application and its uses.

6. Analysis Indicating the Usefulness of the Polynucleotides and Polypeptides of the Invention

6.1 General Protocols

*Agrobacterium*-Mediated Transformation of *Arabidopsis*

Wild-type *Arabidopsis thaliana Wassilewskija* (WS) plants are transformed with Ti plasmids containing clones in the sense orientation relative to the 35S promoter. A Ti plasmid vector useful for these constructs, CRS 338, contains the Ceres-constructed, plant selectable marker gene phosphinothricin acetyltransferase (PAT), which confers herbicide resistance to transformed plants.

Ten independently transformed events are typically selected and evaluated for their qualitative phenotype in the $T_1$ generation.

Preparation of Soil Mixture: 24 L SunshineMix #5 soil (Sun Gro Horticulture, Ltd., Bellevue, Wash.) is mixed with 16 L Therm-O-Rock vermiculite (Therm-O-Rock West, Inc., Chandler, Ariz.) in a cement mixer to make a 60:40 soil mixture. To the soil mixture is added 2 Tbsp Marathon 1% granules (Hummert, Earth City, Mo.), 3 Tbsp OSMOCOTE® 14-14-14 (Hummert, Earth City, Mo.) and 1 Tbsp Peters fertilizer 20-20-20 (J.R. Peters, Inc., Allentown, Pa.), which are first added to 3 gallons of water and then added to the soil and mixed thoroughly. Generally, 4-inch diameter pots are filled with soil mixture. Pots are then covered with 8-inch squares of nylon netting.

Planting: Using a 60 mL syringe, 35 mL of the seed mixture is aspirated. 25 drops are added to each pot. Clear propagation domes are placed on top of the pots that are then placed under 55% shade cloth and subirrigated by adding 1 inch of water.

Plant Maintenance: 3 to 4 days after planting, lids and shade cloth are removed. Plants are watered as needed. After 7-10 days, pots are thinned to 20 plants per pot using forceps. After 2 weeks, all plants are subirrigated with Peters fertilizer at a rate of 1 Tsp per gallon of water. When bolts are about 5-10 cm long, they are clipped between the first node and the base of stem to induce secondary bolts. Dipping infiltration is performed 6 to 7 days after clipping.

Preparation of *Agrobacterium*: To 150 mL fresh YEB is added 0.1 mL each of carbenicillin, spectinomycin and rifampicin (each at 100 mg/ml stock concentration). *Agrobacterium* starter blocks are obtained (96-well block with *Agrobacterium* cultures grown to an $OD_{600}$ of approximately 1.0) and inoculated one culture vessel per construct by transferring 1 mL from appropriate well in the starter block. Cultures are then incubated with shaking at 27° C. Cultures are spun down after attaining an $OD_{600}$ of approximately 1.0 (about 24 hours). 200 mL infiltration media is added to resuspend *Agrobacterium* pellets. Infiltration media is prepared by adding 2.2 g MS salts, 50 g sucrose, and 5 µl 2 mg/ml benzylaminopurine to 900 ml water.

Dipping Infiltration: The pots are inverted and submerged for 5 minutes so that the aerial portion of the plants are in the *Agrobacterium* suspension. Plants are allowed to grow normally and seed is collected.

High-Throughput Phenotypic Screening of Misexpression Mutants:

Seed is evenly dispersed into water-saturated soil in pots and placed into a dark 4° C. cooler for two nights to promote uniform germination. Pots are then removed from the cooler and covered with 55% shade cloth for 4-5 days. Cotyledons are fully expanded at this stage. FINALE® (Sanofi Aventis, Paris, France) is sprayed on plants (3 ml FINALE® diluted into 48 oz. water) and repeated every 3-4 days until only transformants remain.

Screening is routinely performed at four stages: Seedling, Rosette, Flowering, and Senescence.

Seedling—the time after the cotyledons have emerged, but before the $3^{rd}$ true leaf begins to form.

Rosette—the time from the emergence of the $3^{rd}$ true leaf through just before the primary bolt begins to elongate.

Flowering—the time from the emergence of the primary bolt to the onset of senescence (with the exception of noting the flowering time itself, most observations should be made at the stage where approximately 50% of the flowers have opened).

Senescence—the time following the onset of senescence (with the exception of delayed senescence, most observations should be made after the plant has completely dried). Seeds are then collected.

Screens: Screening for increased size, vegetative growth, biomass, lethality, sterility and other modulated characteristics is performed by taking measurements, specifically $T_2$ measurements were taken as follows:

Days to Bolt=number of days between sowing of seed and emergence of first inflorescence.

Rosette Leaf Number at Bolt=number of rosette leaves present at time of emergence of first inflorescence.

Rosette Area=area of rosette at time of initial inflorescence emergence, using formula $((L \times W)*3.14)/4$.

Height=length of longest inflorescence from base to apex. This measurement was taken at the termination of flowering/onset of senescence.

Primary Inflorescence Thickness=diameter of primary inflorescence 2.5 cm up from base. This measurement was taken at the termination of flowering/onset of senescence.

Inflorescence Number=total number of unique inflorescences. This measurement was taken at the termination of flowering/onset of senescence.

PCR was used to amplify the cDNA insert in one randomly chosen $T_2$ plant. This PCR product was then sequenced to confirm the sequence in the plants.

Results

Plants transformed with the genes of interest were screened as described above for modulated growth and phenotype characteristics. The observations include those with respect to the entire plant, as well as parts of the plant, such as the roots and leaves. The observations for transformants with each polynucleotide sequence are noted in the Sequence listing and Table 1 for the corresponding encoded polypeptide.

Functional homologs/orthologs from *Populus balsamifera* for each gene of interest that gave a modulated growth and phenotype characteristic when transformed in plants were identified through the Determination of Functional Homolog/Ortholog Sequences process described below. Functional homologs/orthologs of a gene of interest are understood to possess the same phenotype(s) as was observed for the respective gene of interest when mis-expressed in plants. The modulated growth and phenotype characteristic(s) determined for the functional homologs/orthologs are noted in the Sequence Listing and Table 1.

Determination of Functional Homolog/Ortholog Sequences

A subject sequence was considered a functional homolog or ortholog of a query sequence if the subject and query sequences encoded proteins having a similar function and/or activity. A process known as Reciprocal BLAST (Rivera et al., *Proc. Natl. Acad. Sci. USA*, 95:6239-6244 (1998)) was used to identify potential functional homolog and/or ortholog sequences from a databases consisting of Ceres-Inc. proprietary peptide sequences from *Populus balsamifera* subsp. *trichocarpa*.

Before starting a Reciprocal BLAST process, a specific query polypeptide was searched against all peptides from its source species using BLAST in order to identify polypeptides having BLAST sequence identity of 80% or greater to the query polypeptide and an alignment length of 85% or greater along the shorter sequence in the alignment. The query polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e−5; 2) a word size of 5; and 3) the −postsw option. The BLAST sequence identity was calculated based on the alignment of the first BLAST HSP (High-scoring Segment Pairs) of the identified potential functional homolog and/or ortholog sequence with a specific query polypeptide. The number of identically matched residues in the BLAST HSP alignment was divided by the HSP length, and then multiplied by 100 to get the BLAST sequence identity. The HSP length typically included gaps in the alignment, but in some cases gaps can be excluded.

The main Reciprocal BLAST process consists of two rounds of BLAST searches; forward search and reverse search. In the forward search step, a query polypeptide sequence, polypeptide A, from source species SA was BLASTed against all Ceres-Inc. proprietary peptide sequences from *Populus balsamifera* subsp. *Trichocarpa*. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original query polypeptide was considered a potential functional homolog or ortholog as well.

In the reverse search round, the top hits identified in the forward search from *Populus balsamifera* subsp. *Trichocarpa* were BLASTed against all protein sequences from the source species SA. A top hit from the forward search that returned a polypeptide from the aforementioned cluster as its best hit was also considered as a potential functional homolog or ortholog.

Functional homologs and/or orthologs were identified by manual inspection of potential functional homolog and/or ortholog sequences. The BLAST percent identities and E-values of functional homologs and/or orthologs to the query sequences SEQ ID NO: X are shown in the sequence listing, respectively.

The BLAST sequence identity and E-value given in the sequence listing (in a miscellaneous feature section) was taken from the forward search round of the Reciprocal BLAST process.

Information in the Sequence Listing

The modulated growth and phenotype characteristics for each of the sequences of the invention are noted by an entry in the Phenotype field (in a miscellaneous feature section) for each respective nucleic acid and/or polypeptide sequence in the Sequence Listing. The Phenotype field in the Sequence Listing also gives the general location for which the noted modulated growth and phenotype characteristics occur. The Phenotype noted in the Sequence Listing for each relevant sequence further includes a valuable application of that sequence based on the observations and analysis.

Also, for each functional homolog, the E-value and the BLAST sequence identity relative to the respective query sequence is noted in a miscellaneous features field in the Sequence Listing.

For some of the polynucleotides/polypeptides of the invention, the sequence listing further includes (in a miscellaneous feature section) an indication of important identified dominant(s) and the corresponding function of the domain or identified by comparison to the publicly available pfam database.

For some of the polynucleotides/polypeptides of the invention, the sequence listing further includes (in a miscellaneous feature section) an indication of important identified characteristic(s) of a polypeptide sequence and the corresponding function of the polypeptide sequence identified by comparison to the publicly available Swiss-Prot database.

Table 1 correlates the Phenotype entries (in miscellaneous feature sections) in the sequence listing to the descriptions for each entry in the Phenotype Description column. Table 1 also gives the general location for where the modulated growth and phenotype characteristics are observed in the Tissue column. The Phenotype Category column in Table 1 groups the modulated growth and phenotype characteristics for possible Phenotype entries into the following plant trait categories: Appearance, Architecture, Biomass, Composition, Confinement, Development, Nitrogen use, Nutrient uptake, Phosphate use, Photosynthetic capacity, Shade, Stress tolerance, Vigor, and Yield. In addition to the use described for each phenotype in the Application column in Table 1, applications for modulated growth and phenotype that are given any one of the following designation in the Phenotype Category column in Table 1: Appearance, Architecture, Biomass, Composition, Confinement, Development, Nitrogen use, Nutrient uptake, Phosphate use, Photosynthetic capacity, Shade, Stress tolerance, Vigor, and Yield; are further discussed in preceding paragraphs.

Polypeptide sequences that are determined to be associated with a particular modulated growth and phenotype characteristic are listed in Table 1 by a Ceres internal identifier, given in the Ceres ID column in Table 1, and by their respective SEQ ID NOs.

TABLE 1

| Tissue | Phenotype Category | Phenotype | Phenotype Description | Applications | Ceres ID | SEQ ID NO |
|---|---|---|---|---|---|---|
| INFLORESCENCE | Appearance | Acauline Branching | The first branching is not subtended by a cauline leaf. | Useful for making ornamental plants with modified flowers | CLONE 3000; ANNOT 1518918; ANNOT 1518918; ANNOT 1535677; ANNOT 1535677; ANNOT 1482181; ANNOT 1482181; | 111; 112; 113; 114; 115; 116; 117; |
| INFLORESCENCE | Appearance | Asecondary Branching | The plant does not form secondary inflorescences. | Useful for making ornamental plants with modified flowers | CLONE 3000; ANNOT 1518918; ANNOT 1518918; ANNOT 1535677; ANNOT 1535677; ANNOT 1482181; ANNOT 1482181; CLONE 33232; ANNOT 1504045; ANNOT 1504045; ANNOT 1450983; ANNOT 1450983; CLONE 34412; ANNOT 1449739; ANNOT 1449739; ANNOT 1449738; ANNOT 1449738; ANNOT 1458830; ANNOT 1458830; CLONE 34783; ANNOT 1466952; ANNOT 1466952; ANNOT 1523551; ANNOT 1523551; ANNOT 1470164; ANNOT 1470164; CLONE 38973; ANNOT 1451899; ANNOT 1451899; ANNOT 1496367; ANNOT 1496367; CLONE 107731; ANNOT 1480518; ANNOT 1480518; ANNOT 1442194; ANNOT 1442194; ANNOT 1454127; ANNOT 1454127; ANNOT 1461414; ANNOT 1461414; ANNOT 1447424; ANNOT 1447424; ANNOT 1452873; ANNOT 1452873; ANNOT 1474708; ANNOT 1474708; CLONE 241379; ANNOT 1526950; ANNOT 1526950; ANNOT 1508362; ANNOT 1508362; ANNOT 1477361; CLONE 283597; ANNOT 1482074; ANNOT 1482074; ANNOT 1453923; ANNOT 1453923; | 111; 112; 113; 114; 115; 116; 117; 1263; 1264; 1265; 1266; 1267; 1376; 1377; 1378; 1379; 1380; 1381; 1382; 1423; 1424; 1425; 1426; 1427; 1428; 1429; 1818; 1819; 1820; 1821; 1822; 2263; 2264; 2265; 2266; 2267; 2268; 2269; 2270; 2271; 2272; 2273; 2274; 2275; 2276; 2277; 2718; 2719; 2720; 2721; 2722; 2723; 2724; 2833; 2834; 2835; 2836; 2837; |
| ROSETTE LEAVES | Appearance | Corkscrew | The leaves are completely curled/rolled up or down at the leaf margins, with the additional attribute of twisting like a corkscrew, instead of uniformly curling from both sides of the leaf. | Useful for making plants with altered leaf shape e.g. curled leaves | CLONE 32548; ANNOT 1450324; ANNOT 1450324; ANNOT 1460836; CLONE 96020; ANNOT 1450365; ANNOT 1460794; ANNOT 1460794; ANNOT 1471976; ANNOT 1471976; ANNOT 225200; CLONE 225200; ANNOT 1465507; ANNOT 1465507; | 1231; 1232; 1233; 1234; 1235; 2095; 2096; 2097; 2098; 2099; 2655; 2656; 2657; 2658; 2659; |
| CAULINE LEAVES | Appearance | Corkscrew | The leaves are completely curled/rolled up or down at the leaf margins, with the additional attribute of twisting like a corkscrew, | Useful for making ornamental plants with altered leaf shape | CLONE 9132; ANNOT 1458620; ANNOT 1458620; | 391; 392; 393; |

TABLE 1-continued

| Tissue | Phenotype Category | Phenotype | Phenotype Description | Applications | Ceres ID | SEQ ID NO |
|---|---|---|---|---|---|---|
| INFLORESCENCE | Appearance | Corkscrew Appearance | The inflorescence is twisted like a corkscrew, but somewhat more irregular. instead of uniformly curling from both sides of the leaf. | Useful for making ornamental plants with modified flowers | CLONE 123279; ANNOT 1508945; ANNOT 1531332; ANNOT 1482544; ANNOT 1478226; ANNOT 1478226; CLONE 225601; ANNOT 1457617; ANNOT 1465289; ANNOT 1453865; ANNOT 1465289; ANNOT 1478647; ANNOT 1453865; ANNOT 1438014; CLONE 627596; ANNOT 1500987; ANNOT 1500987; ANNOT 1490915; CDNA 2350103; ANNOT 1447690; ANNOT 1447690; ANNOT 149l278; ANNOT 1500987; ANNOT 1500987; ANNOT 1490915; | 2492; 2493; 2494; 2495; 2496; 2497; 2498; 2499; 2500; 2665; 2666; 2667; 2668; 2669; 2670; 2671; 2672; 2673; 2674; 2675; 3299; 3300; 3301; 3302; 3303; 3687; 3688; 3689; 3690; 3691; 3692; 3693; 3694; 3695; |
| ROSETTE LEAVES | Appearance | Cup-shaped | The leaves are curled up at the leaf margins such that they form a cup or bowl-like shape. | Useful for making ornamental plants with altered leaf shape | CLONE 8877; ANNOT 1507340; ANNOT 1507340; ANNOT 1529361; ANNOT 1529361; CLONE 13186; ANNOT 1464566; ANNOT 1458408; ANNOT 1458408; CLONE 26655; ANNOT 1477170; ANNOT 1477170; ANNOT 1508498; ANNOT 1530647; ANNOT 1530647; CLONE 37493; ANNOT 1494370; ANNOT 1494370; ANNOT 1441478; ANNOT 1441478; CLONE 41439; CLONE 42955; ANNOT 1505155; ANNOT 1505155; CLONE 262460; ANNOT 1530053; ANNOT 1530053; ANNOT 1493414; ANNOT 1493414; CLONE 382267; ANNOT 1456223; ANNOT 1456223; ANNOT 1467304; ANNOT 1467304; CDNA 36542397; ANNOT 1497958; ANNOT 1497958; ANNOT 1471743; ANNOT 1471743; ANNOT 1465272; ANNOT 1465272; ANNOT 1510814; ANNOT 1510814; | 383; 384; 385; 386; 387; 531; 532; 533; 534; 535; 1023; 1024; 1025; 1026; 1027; 1028; 1029; 1637; 1638; 1639; 1640; 1641; 1998; 2048; 2049; 2050; 2774; 2775; 2776; 2777; 2778; 2986; 2987; 2988; 2989; 2990; 3969; 3970; 3971; 3972; 3973; 4023; 4024; 4025; 4026; 4027; |
| CAULINE LEAVES | Appearance | Cup-shaped | The cauline leaves are curled up at the leaf margins such that they form a cup or bowl-like shape | Useful for making ornamental plants with altered leaf shape | CLONE 267564; ANNOT 1473933; ANNOT 1473933; ANNOT 1468704; ANNOT 1468704; | 2789; 2790; 2791; 2792; 2793; |
| ROSETTE LEAVES | Appearance | Curled 1 | The leaves are abnormally curled slightly up or down at the leaf margins. | Useful for making ornamental plants with altered leaf shape | CLONE 3000; ANNOT 1518918; ANNOT 1535677; ANNOT 1535677; ANNOT 1482181; CLONE 13757; ANNOT 1471425; ANNOT 1471425; CLONE 17409; ANNOT 1457617; ANNOT 1457617; ANNOT 1465289; ANNOT 1465289; ANNOT 1478647; ANNOT 1478647; ANNOT 1453865; ANNOT 1453865; CLONE 19486; ANNOT 1452204; ANNOT 1452204; ANNOT 1443204; ANNOT 1443204; CLONE 37493; ANNOT 1494370; ANNOT 1494370; ANNOT 1441478; ANNOT 1441478; CLONE 37663; ANNOT 1447659; ANNOT 1447659; ANNOT 1438478; ANNOT 1438478; CLONE 107731; ANNOT 1480518; ANNOT 1480518; ANNOT 1442194; ANNOT 1442194; ANNOT 1449026; CLONE 225601; ANNOT 1454127; ANNOT 1454127; ANNOT 1461414; ANNOT 1461414; ANNOT 1447424; ANNOT 1447424; ANNOT 1452873; ANNOT 1452873; ANNOT 1474708; ANNOT 1474708; CLONE 148943; CLONE 158333; ANNOT 1472949; ANNOT 1472949; CLONE 158333; ANNOT 1466505; ANNOT 1466505; ANNOT 1449026; CLONE 225601; ANNOT 1457617; ANNOT 1457617; ANNOT 1465289; ANNOT 1465289; ANNOT 1478647; ANNOT 1453865; ANNOT 1453865; ANNOT 1438014; ANNOT 1474923; ANNOT 1474923; CLONE 590462; ANNOT 1490788; ANNOT 1490788; ANNOT 1502230; ANNOT 1502230; CLONE 681088; ANNOT 1471330; ANNOT 1471330; ANNOT 1444437; ANNOT 1444437; | 111; 112; 113; 114; 115; 116; 117; 564; 565; 566; 678; 679; 680; 681; 682; 683; 684; 685; 686; 767; 768; 769; 770; 771; 1637; 1638; 1639; 1640; 1641; 1657; 1658; 1659; 1660; 1661; 2263; 2264; 2265; 2266; 2267; 2268; 2269; 2270; 2271; 2272; 2273; 2274; 2275; 2276; 2277; 2543; 2544; 2545; 2611; 2612; 2613; 2614; 2615; 2665; 2666; 2667; 2668; 2669; 2670; 2671; 2672; 2673; 2674; 2675; 3221; 3222; 3223; 3255; 3256; 3257; 3258; 3259; |

| Tissue | Phenotype Category | Phenotype | Phenotype Description | Applications | Ceres ID | SEQ ID NO |
|---|---|---|---|---|---|---|
| CAULINE LEAVES | Appearance | Curled 1 | The cauline leaves are curled slightly up or down at the leaf margins, but are not cup-shaped. | Useful for making ornamental plants with altered leaf shape | ANNOT 1444439; ANNOT 1444439; ANNOT 1486891; ANNOT 1486891; ANNOT 1479637; ANNOT 1479637; ANNOT 1446530; ANNOT 1446530; | 3345; 3346; 3347; 3348; 3349; 3350; 3351; 3352; 3353; 3354; 3355; 3356; 3357; |
| ROSETTE LEAVES | Appearance | Curled 2 | The leaves are abnormally curled up or down at the leaf margins, but do not form a cup or bowl-like shape. | Useful for making ornamental plants with altered leaf shape | CLONE 34552; ANNOT 1516449; ANNOT 1516449; ANNOT 1512976; ANNOT 1512976; CLONE 22560I; ANNOT 1457617; ANNOT 1457617; ANNOT 1465289; ANNOT 1465289; ANNOT 1478647; ANNOT 1478647; ANNOT 1453865; ANNOT 1453865; ANNOT 1438014; ANNOT 1438014; CLONE 241379; ANNOT 1526950; ANNOT 1526950; ANNOT 1508362; ANNOT 1508362; ANNOT 1477361; ANNOT 1477361; | 1406; 1407; 1408; 1409; 1410; 2665; 2666; 2667; 2668; 2669; 2670; 2671; 2672; 2673; 2674; 2675; 2718; 2719; 2720; 2721; 2722; 2723; 2724; |
| | | | | | CLONE 332; ANNOT 1474923; ANNOT 1474923; CLONE 5167; ANNOT 1465422; ANNOT 1465422; ANNOT 1457750; ANNOT 1457750; ANNOT 1513544; ANNOT 1513544; CLONE 6082; ANNOT 1443416; ANNOT 1505047; ANNOT 1505047; ANNOT 1488463; ANNOT 1496339; ANNOT 1496339; CLONE 6220; ANNOT 1488463; ANNOT 1541879; ANNOT 1541879; CLONE 8068; ANNOT 1510462; ANNOT 1510462; ANNOT 1471422; ANNOT 1471422; ANNOT 1497509; ANNOT 1497509; CLONE 11929; ANNOT 1518415; ANNOT 1518415; ANNOT 1475405; ANNOT 1475405; ANNOT 1457917; ANNOT 1457917; ANNOT 1515353; ANNOT 1515353; ANNOT 1484925; ANNOT 1484925; ANNOT 1484924; ANNOT 1484924; ANNOT 1462053; ANNOT 1462053; ANNOT 1450576; ANNOT 1450576; CLONE 12272; ANNOT 1506387; ANNOT 1506387; ANNOT 1474522; ANNOT 1474522; CLONE 17409; ANNOT 1457617; ANNOT 1457617; ANNOT 1478647; ANNOT 1478647; ANNOT 1453865; ANNOT 1453865; ANNOT 1465289; ANNOT 1465289; ANNOT 1541170; ANNOT 1541170; CLONE 25172; ANNOT 1457346; ANNOT 1457346; ANNOT 1450324; ANNOT 1450324; ANNOT 1460836; ANNOT 1460836; CLONE 32548; CLONE 32791; ANNOT 1540248; ANNOT 1540248; CLONE 37663; ANNOT 1447659; ANNOT 1447659; ANNOT 1438478; ANNOT 1438478; CLONE 38101; ANNOT 1454656; ANNOT 1454656; ANNOT 1528263; ANNOT 1528263; ANNOT 1458103; ANNOT 1458103; ANNOT 1464899; ANNOT 1464899; ANNOT 1482966; ANNOT 1482966; ANNOT 1441039; ANNOT 1441039; ANNOT 1520449; ANNOT 1520449; CLONE 38419; ANNOT 1542971; ANNOT 1542971; ANNOT 1521332; ANNOT 1521332; ANNOT 1467961; ANNOT 1467961; CLONE 38690; ANNOT 1525183; ANNOT 1525183; CLONE 97415; ANNOT 1481701; ANNOT 1481701; CLONE 103581; ANNOT 1486398; ANNOT 1486398; ANNOT 1496840; ANNOT 1496840; CLONE 104929; ANNOT 1449020; ANNOT 1449020; CLONE 107988; ANNOT 1459927; ANNOT 1459927; CLONE 115975; ANNOT 1507138; ANNOT 1507138; CLONE 117369; ANNOT 1499284; ANNOT 1499284; ANNOT 1499284; ANNOT 1481671; ANNOT 1481671; CLONE 147358; ANNOT 1493111; ANNOT 1493111; ANNOT 1461452; ANNOT 1461452; CLONE 241379; ANNOT 1526950; ANNOT 1526950; ANNOT 1508362; ANNOT 1508362; ANNOT 1477361; ANNOT 1477361; CLONE 645550; ANNOT 1479649; ANNOT 1479649; CLONE 681222; ANNOT 1456923; ANNOT 1456923; CLONE 1001432; ANNOT 1475043; ANNOT 1475043; ANNOT 1454586; ANNOT 1454586; ANNOT 1507756; ANNOT 1507756; ANNOT 1469708; CDNA 2355I244; ANNOT 1454030; ANNOT 1454030; ANNOT 1475651; ANNOT 1475651; CDNA 36542853; ANNOT 1524883; ANNOT 1524883; ANNOT 1497918; ANNOT 1497918; | 12; 13; 14; 223; 224; 225; 226; 227; 228; 229; 268; 269; 270; 271; 272; 273; 274; 275; 276; 277; 278; 279; 345; 346; 347; 348; 349; 350; 351; 480; 481; 482; 483; 484; 485; 486; 487; 488; 489; 490; 491; 492; 493; 494; 495; 496; 515; 516; 517; 518; 519; 678; 679; 680; 681; 682; 683; 684; 685; 686; 692; 693; 694; 952; 953; 954; 955; 956; 1231; 1232; 1233; 1234; 1235; 1255; 1256; 1257; 1657; 1658; 1659; 1660; 1661; 1682; 1683; 1684; 1685; 1686; 1687; 1688; 1689; 1690; 1691; 1692; 1693; 1694; 1695; 1696; 1747; 1748; 1749; 1750; 1751; 1752; 1753; 1774; 1775; 1776; 2100; 2101; 2102; 2232; 2233; 2234; 2235; 2236; 2237; 2238; 2239; 2278; 2279; 2280; 2373; 2374; 2375; 2407; 2408; 2409; 2410; 2411; 2528; 2529; 2530; 2531; 2532; 2718; 2719; 2720; 2721; 2722; 2723; 2724; 3311; 3312; 3313; 3358; 3359; 3360; 3419; 3420; 3421; 3422; 3423; 3424; 3425; 3426; 3427; 3821; 3822; 3823; 3824; 3825; 3974; 3975; 3976; 3977; 3978; |
| CAULINE LEAVES | Appearance | Curled 2 | The cauline leaves are | Useful for making | CLONE 32548; ANNOT 1450324; ANNOT 1450324; ANNOT 1460836; ANNOT 1460836; CLONE 22560I; ANNOT 1457617; ANNOT 1457617; ANNOT 1465289; ANNOT 1465289; | 1231; 1232; 1233; 1234; 1235; 2665; 2666; 2667; |

TABLE 1-continued

| Tissue | Phenotype Category | Phenotype | Phenotype Description | Applications | Ceres ID | SEQ ID NO |
|---|---|---|---|---|---|---|
| | | | abnormally curled up or down at the leaf margins, but are not cup-shaped. | ornamental plants with altered leaf shape | ANNOT 1465289; ANNOT 1478647; ANNOT 1478647; ANNOT 1453865; ANNOT 1453865; ANNOT 1438014; ANNOT 1438014; CLONE 645550; ANNOT 1479649; ANNOT 1479649; | 2668; 2669; 2670; 2671; 2672; 2673; 2674; 2675; 3311; 3312; 3313; |
| ROSETTE LEAVES | Appearance | Curled 3 | The leaves are abnormally curled up or down at the leaf margins, but do not form a cup or bowl-like shape. | Useful for making ornamental plants with altered leaf shape | CLONE 332; ANNOT 1474923; CLONE 3000; ANNOT 1518918; ANNOT 1518918; ANNOT 1535677; ANNOT 1535677; ANNOT 1482181; ANNOT 1482181; CLONE 3006; ANNOT 1472173; CLONE 3363; ANNOT 1445515; ANNOT 1445515; ANNOT 1461861; ANNOT 1449363; ANNOT 1449363; ANNOT 1465198; ANNOT 1518517; ANNOT 1518517; CLONE 6220; ANNOT 1488463; ANNOT 1488463; ANNOT 1541879; ANNOT 1541879; CLONE 8877; ANNOT 1507340; ANNOT 1507340; ANNOT 1529361; ANNOT 1529361; CLONE 9221; ANNOT 1535229; ANNOT 1535229; CLONE 11214; ANNOT 1501485; ANNOT 1501485; ANNOT 1490496; ANNOT 1490496; ANNOT 1448498; ANNOT 1448498; ANNOT 1474848; ANNOT 1474848; CLONE 11494; ANNOT 1438708; CLONE 1975; ANNOT 1460142; ANNOT 1460142; ANNOT 1483807; ANNOT 1483807; CLONE 12272; ANNOT 1506387; ANNOT 1506387; ANNOT 1474522; ANNOT 1474522; CLONE 13625; ANNOT 1455211; ANNOT 1455211; CLONE 13800; ANNOT 1458335; ANNOT 1458335; ANNOT 1464663; ANNOT 1464663; ANNOT 14105; ANNOT 1455669; ANNOT 1455669; ANNOT 1477732; ANNOT 1477732; ANNOT 1508866; ANNOT 1508866; CLONE 14555; ANNOT 1511392; ANNOT 1511392; ANNOT 1469356; ANNOT 1469356; ANNOT 1517500; ANNOT 1517500; ANNOT 1458151; ANNOT 1458151; ANNOT 1522757; ANNOT 1522757; ANNOT 25538; ANNOT 1480776; CLONE 28602; ANNOT 1461728; ANNOT 1461728; ANNOT 1488330; ANNOT 1488330; ANNOT 1460480; ANNOT 1460480; ANNOT 1461614; ANNOT 1461614; ANNOT 1479711; ANNOT 1479711; ANNOT 1479712; ANNOT 1479712; ANNOT 1488329; ANNOT 1460481; ANNOT 1460481; ANNOT 1461613; ANNOT 1461613; ANNOT 1458198; ANNOT 1458198; ANNOT 1488327; ANNOT 1488327; CLONE 32348; ANNOT 1470719; ANNOT 1470719; ANNOT 1543728; ANNOT 1543728; ANNOT 1482066; ANNOT 1482066; CLONE 32791; ANNOT 1540248; ANNOT 1540248; CLONE 37493; ANNOT 1494370; ANNOT 1494370; ANNOT 1441478; CLONE 38419; ANNOT 1542971; ANNOT 1542971; ANNOT 1521332; ANNOT 1521332; ANNOT 1467961; ANNOT 1467961; CLONE 103581; ANNOT 1486398; ANNOT 1486398; ANNOT 1496840; ANNOT 1496840; CLONE 109912; ANNOT 1451138; ANNOT 1451138; ANNOT 1456780; CLONE 156807; ANNOT 1464566; ANNOT 1464566; ANNOT 1458408; ANNOT 1458408; CLONE 222601; ANNOT 1457617; ANNOT 1457617; ANNOT 1465289; ANNOT 1465289; ANNOT 1478647; ANNOT 1478647; ANNOT 1453865; ANNOT 1453865; ANNOT 1438014; ANNOT 1438014; ANNOT 1139572; ANNOT 1139572; ANNOT 1139571; ANNOT 1139571; ANNOT 1519423; CLONE 304574; ANNOT 1481465; ANNOT 1481465; ANNOT 1482095; ANNOT 1482095; ANNOT 1482093; ANNOT 1482093; ANNOT 1440823; CLONE 537272; ANNOT 1518918; ANNOT 1518918; ANNOT 1535677; CLONE 557009; ANNOT 1474923; ANNOT 1474923; CLONE 645550; ANNOT 1479649; ANNOT 1479649; CDNA 3653561 8; ANNOT 1459998; ANNOT 1513263; ANNOT 1513263; CDNA 36567943; ANNOT 1467355; ANNOT 1467355; | 12; 13; 14; 111; 112; 113; 114; 115; 116; 117; 118; 119; 120; 129; 130; 131; 132; 133; 134; 135; 136; 137; 138; 139; 275; 276; 277; 278; 279; 383; 384; 385; 386; 387; 394; 395; 396; 448; 449; 450; 451; 452; 453; 454; 455; 456; 457; 458; 459; 502; 503; 504; 505; 506; 515; 516; 517; 518; 519; 544; 545; 546; 572; 573; 574; 575; 576; 587; 588; 589; 590; 591; 592; 593; 608; 609; 610; 611; 612; 613; 614; 615; 616; 617; 618; 967; 968; 969; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1219; 1220; 1221; 1222; 1223; 1224; 1225; 1255; 1256; 1257; 1637; 1638; 1639; 1640; 1641; 1747; 1748; 1749; 1750; 1751; 1752; 1753; 2232; 2233; 2234; 2235; 2236; 2303; 2304; 2305; 2306; 2307; 2583; 2584; 2585; 2586; 2587; 2665; 2666; 2667; 2668; 2669; 2670; 2671; 2672; 2673; 2674; 2675; 2690; 2691; 2692; 2693; 2694; 2695; 2696; 2884; 2885; 2886; 2887; 2888; 2889; 2890; 2891; 2892; 3163; 3164; 3165; 3166; 3167; 3221; 3222; 3223; 3311; 3312; 3313; 3951; 3952; 3953; 3954; 3955; 4028; 4029; 4030; |

TABLE 1-continued

| Tissue | Phenotype Category | Phenotype | Phenotype Description | Applications | Ceres ID | SEQ ID NO |
|---|---|---|---|---|---|---|
| CAULINE LEAVES | Appearance | Curled 3 | The cauline leaves are abnormally curled up or down at the leaf margins, but are not form a cup or bowl-like shape. | Useful for making ornamental plants with altered leaf shape | CLONE 14555; ANNOT 1511392; ANNOT 1469356; ANNOT 1469356; ANNOT 1517500; ANNOT 1458151; ANNOT 1458151; ANNOT 1522757; CLONE 32791; ANNOT 1540248; ANNOT 1540248; CLONE 34612; ANNOT 1479009; ANNOT 1469640; ANNOT 1469640; CLONE 105554; ANNOT 1451783; CLONE 156807; ANNOT 1464566; ANNOT 1458408; ANNOT 1458408; CLONE 645550; ANNOT 1479649; ANNOT 1479649; | 608; 609; 610; 611; 612; 613; 614; 615; 616; 617; 618; 1255; 1256; 1257; 1411; 1412; 1413; 1414; 1415; 2247; 2248; 2249; 2583; 2584; 2585; 2586; 2587; 3311; 3312; 3313; |
| ROSETTE LEAVES | Appearance | Curled 4 | The leaves are abnormally curled/rolled up or down at the leaf margins. | Useful for making ornamental plants with altered leaf shape | CLONE 3363; ANNOT 1445515; ANNOT 1445515; ANNOT 146186l; ANNOT 1461861; ANNOT 1449363; ANNOT 1449363; ANNOT 1465198; ANNOT 1465198; ANNOT 1518517; ANNOT 1518517; ANNOT 1464566; ANNOT 1464566; ANNOT 1458408; CLONE 13186; ANNOT 13745; ANNOT 1442604; ANNOT 1442604; ANNOT 1442612; ANNOT 1442608; ANNOT 1442608; ANNOT 1452827; CLONE 32791; ANNOT 1540248; ANNOT 1540248; CLONE 34412; ANNOT 1449739; ANNOT 1449738; ANNOT 1449738; CLONE 1458830; CLONE 37019; ANNOT 1517849; ANNOT 1511684; ANNOT 1511684; ANNOT 1464532; ANNOT 1458439; ANNOT 1540674; ANNOT 1540674; ANNOT 1494370; ANNOT 1494370 ANNOT 1441478; CLONE 38419; ANNOT 1542971; ANNOT 1542971; ANNOT 1521332; ANNOT 1489751; ANNOT 1467961; CLONE 38635; ANNOT 1489751; ANNOT 1446209; ANNOT 1446209; CLONE 40508; ANNOT 1453626; ANNOT 1453626; CLONE 96020; ANNOT 1450365; ANNOT 1508945; ANNOT 1460794; ANNOT 1460794; CLONE 123279; ANNOT 1482544; ANNOT 1482544; ANNOT 1478226; CLONE 228787; ANNOT 1139572; ANNOT 1139571; ANNOT 1139571; ANNOT 1519423; CLONE 608818; ANNOT 1528780; ANNOT 1518351; ANNOT 1518351; ANNOT 1525569; ANNOT 1453192; ANNOT 1441586; ANNOT 1441586; ANNOT 1509714; ANNOT 1509714; CLONE 681222; ANNOT 1456923; ANNOT 1456923; | 129; 130; 131; 132; 133; 134; 135; 136; 137; 138; 139; 531; 532; 533; 534; 535; 555; 556; 557; 558; 559; 560; 561; 562; 563; 1255; 1256; 1257; 1376; 1377; 1378; 1379; 1380; 1381; 1382; 1599; 1600; 1601; 1602; 1603; 1604; 1605; 1606; 1607; 1608; 1609; 1637; 1638; 1639; 1640; 1641; 1747; 1748; 1749; 1750; 1751; 1752; 1753; 1769; 1770; 1771; 1772; 1773; 1912; 1913; 1914; 2095; 2096; 2097; 2098; 2099; 2492; 2493; 2494; 2495; 2496; 2497; 2498; 2499; 2500; 2690; 2691; 2692; 2693; 2694; 2695; 2696; 3273; 3274; 3275; 3276; 3277; 3278; 3279; 3280; 3281; 3282; 3283; 3284; 3285; 3358; 3359; 3360; |
| CAULINE LEAVES | Appearance | Curled 4 | The cauline leaves are abnormally curled/rolled up or down at the leafmargins. | Useful for making ornamental plants with altered leaf shape | CLONE 32791; ANNOT 1540248; ANNOT 1540248; CLONE 34612; ANNOT 1479009; ANNOT 1479009; ANNOT 1469640; ANNOT 1469640; | 1255; 1256; 1257; 1411; 1412; 1413; 1414; 1415; |
| ROSETTE LEAVES | Appearance | Curled 5 | The leaves are completely curled/rolled up or down at the leaf margins. | Useful for making ornamental plants with altered leaf shape | CLONE 3000; ANNOT 1518918; ANNOT 1518918; ANNOT 1535677; ANNOT 1535677; ANNOT 1482181; ANNOT 1482181; CLONE 5055; ANNOT 1438157; ANNOT 1438157; ANNOT 1482181; ANNOT 1500936; CLONE 13186; ANNOT 1464566; ANNOT 1464566; ANNOT 1458408; ANNOT 1458408; CLONE 13263; ANNOT 1470919; CLONE 1470919; CLONE 32737; ANNOT 1536373; ANNOT 1536373; ANNOT 1536373; ANNOT 1482905; ANNOT 1482905; CLONE 32791; ANNOT 1540248; ANNOT 1540248; CLONE 34612; ANNOT 1479009; ANNOT 1479009; ANNOT 1469640; ANNOT 1469640; CLONE 37493; ANNOT 1494370; ANNOT 1494370; ANNOT 1441478; ANNOT 1441478; CLONE 123279; ANNOT 1508945; ANNOT 1508945; ANNOT 1531332; ANNOT 1531332; ANNOT 1482544; ANNOT 1482544; | 111; 112; 113; 114; 115; 116; 117; 215; 216; 217; 218; 219; 531; 532; 533; 534; 535; 536; 537; 538; 1242; 1243; 1244; 1245; 1246; 1255; 1256; 1257; 1411; 1412; 1413; 1414; 1415; 1637; 1638; 1639; 1640; 1641; 2492; 2493; 2494; 2495; 2496; 2497; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1478226; ANNOT 1478226; CLONE 148943; ANNOT 1472949; ANNOT 1472949; CLONE 228787; ANNOT 1139572; ANNOT 1139571; ANNOT 1139571; ANNOT 1519423; ANNOT 1519423; CLONE 331626; ANNOT 1479649; ANNOT 1479649; CLONE 608818; ANNOT 1528780; ANNOT 1518351; ANNOT 1518351; ANNOT 1522569; ANNOT 1525569; ANNOT 1453192; ANNOT 1453192; ANNOT 1441586; ANNOT 1509714; ANNOT 1509714; CDNA 36566773; ANNOT 1464046; ANNOT 1458861; ANNOT 1458861; | 2498; 2499; 2500; 2543; 2544; 2545; 2690; 2691; 2692; 2693; 2694; 2695; 2696; 2916; 2917; 2918; 3273; 3274; 3275; 3276; 3277; 3278; 3279; 3280; 3281; 3282; 3283; 3284; 3285; 4018; 4019; 4020; 4021; 4022; |
| CAULINE LEAVES | Appearance | Curled 5 | The cauline leaves are completely curled/rolled up or down at the leaf margins. | Useful for making ornamental plants with altered leaf shape | CLONE 13186; ANNOT 1464566; ANNOT 1464566; ANNOT 1458408; ANNOT 1458408; CLONE 32791; ANNOT 1540248; ANNOT 1540248; CLONE 37019; ANNOT 1517849; ANNOT 1517849; ANNOT 1511684; ANNOT 1511684; ANNOT 1464532; ANNOT 1464532; ANNOT 1458439; ANNOT 1540674; ANNOT 1540674; | 531; 532; 533; 534; 535; 1255; 1256; 1257; 1599; 1600; 1601; 1602; 1603; 1604; 1605; 1606; 1607; 1608; 1609; |
| ROSETTE LEAVES | Appearance | Interveinal Chlorosis | The leaf tissue is chlorotic between its veins. | Useful for making ornamental plants with modified color | CLONE 27464; ANNOT 1453044; ANNOT 1453044; ANNOT 1451171; ANNOT 1451171; CLONE 563522; ANNOT 1460321; ANNOT 1508144; ANNOT 1508144; ANNOT 1541886; ANNOT 1475178; ANNOT 1475178; | 1060; 1061; 1062; 1063; 1064; 3227; 3228; 3229; 3230; 3231; 3232; 3233; 3234; 3235; |
| ROSETTE LEAVES | Appearance | Lanceolate Shaped | The leaves are narrow and come to a dull point at the apex. | Useful for making ornamental plants with altered leaf shape | CLONE 332; ANNOT 1474923; ANNOT 1474923; CLONE 907; ANNOT 1502138; ANNOT 1502138; ANNOT 1449135; ANNOT 1449135; CLONE 3363; ANNOT 1445515; ANNOT 1445515; ANNOT 1461861; ANNOT 1449363; ANNOT 1449363; ANNOT 1465198; ANNOT 1465198; ANNOT 1518817; ANNOT 1518517; CLONE 4067; ANNOT 1514362; ANNOT 1494090; ANNOT 1494090; CLONE 5198; ANNOT 1472153; ANNOT 1472153; CLONE 5968; ANNOT 1450891; ANNOT 1450891; ANNOT 1456400; ANNOT 1456400; ANNOT 1450889; ANNOT 1450889; ANNOT 1456395; ANNOT 1456395; ANNOT 1447193; ANNOT 1447193; CLONE 13186; ANNOT 1464566; ANNOT 1464566; ANNOT 1458408; ANNOT 1458408; CLONE 13263; ANNOT 1470919; ANNOT 1470919; ANNOT 1470919; CLONE 13625; ANNOT 1455211; ANNOT 1455211; CLONE 13757; ANNOT 1471425; ANNOT 1471425; CLONE 14555; ANNOT 1511392; ANNOT 1511392; ANNOT 1469356; ANNOT 1469356; ANNOT 1460480; ANNOT 1517500; ANNOT 1517500; ANNOT 1458151; ANNOT 1458151; ANNOT 1522757; CLONE 18246; ANNOT 1489791; ANNOT 1489791; ANNOT 1470953; ANNOT 1470953; CLONE 20760; ANNOT 1462351; ANNOT 1462351; ANNOT 1488821; ANNOT 1488821; ANNOT 1469462; ANNOT 1469462; CLONE 21563; ANNOT 1438905; ANNOT 1438905; ANNOT 1483143; ANNOT 1483143; CLONE 25607; ANNOT 1450220; ANNOT 1450220; CLONE 28602; ANNOT 1461728; ANNOT 1461728; ANNOT 1488330; ANNOT 1488330; ANNOT 1460480; ANNOT 1461614; ANNOT 1461614; ANNOT 1461614; ANNOT 1479711; ANNOT 1479711; ANNOT 1479712; ANNOT 1479712; ANNOT 1488329; ANNOT 1460481; ANNOT 1460481; ANNOT 1461613; ANNOT 1461613; ANNOT 1458198; ANNOT 1458198; ANNOT 1488327; ANNOT 1488327; CLONE 32615; ANNOT 1471372; ANNOT 1471372; CLONE 33232; ANNOT 1504045; ANNOT 1504045; ANNOT 1450983; ANNOT 1450983; CLONE 34552; ANNOT 1516449; ANNOT 1516449; ANNOT 1512976; CLONE 37543; ANNOT 1539972; ANNOT 1539972; ANNOT 1486562; ANNOT 1486562; ANNOT 1496735; ANNOT 1443794; ANNOT 1443794; CLONE 37589; ANNOT 1440727; ANNOT 1440727; CLONE | 12; 13; 14; 30; 31; 32; 33; 34; 129; 130; 131; 132; 133; 134; 135; 136; 137; 138; 139; 196; 197; 198; 199; 200; 230; 231; 232; 250; 251; 252; 253; 254; 255; 256; 257; 258; 259; 260; 531; 532; 533; 534; 535; 536; 537; 538; 544; 545; 546; 564; 565; 566; 608; 609; 610; 611; 612; 613; 614; 615; 616; 617; 618; 715; 716; 717; 718; 719; 808; 809; 810; 811; 812; 813; 814; 842; 843; 844; 845; 846; 970; 971; 972; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1239; 1240; 1241; 1263; 1264; 1265; 1266; 1267; 1406; 1407; 1408; 1409; 1410; 1642; 1643; 1644; 1645; 1646; 1647; 1648; 1649; 1650; 1651; 1652; 1653; 1707; 1708; |

TABLE 1-continued

| Tissue | Phenotype Category | Phenotype | Phenotype Description | Applications | Ceres ID | SEQ ID NO |
|---|---|---|---|---|---|---|
| | | | | | 38214; ANNOT 1466779; ANNOT 1466779; ANNOT 1465769; ANNOT 1538318; ANNOT 1538318; CLONE 38690; ANNOT 1525183; ANNOT 1525183; CLONE 38757; ANNOT 1528846; ANNOT 1538329; ANNOT 1538329; CLONE 38843; ANNOT 1447896; ANNOT 1438197; ANNOT 1438197; CLONE 40436; ANNOT 1441645; ANNOT 1441645; CLONE 40729; ANNOT 1481678; ANNOT 1481678; CLONE 42533; ANNOT 1499810; ANNOT 1499810; ANNOT 1538733; ANNOT 1538733; ANNOT 1485323; ANNOT 1485323; CLONE 95453; ANNOT 1460836; ANNOT 1460836; ANNOT 1450324; ANNOT 1450324; CLONE 95677; ANNOT 1459723; ANNOT 1459723; ANNOT 1516455; ANNOT 1516455; CLONE 97415; ANNOT 1481701; ANNOT 1481701; CLONE 100319; ANNOT 1503141; ANNOT 1503141; ANNOT 1521524; ANNOT 1521524; CLONE 117369; ANNOT 1499284; ANNOT 1499284; ANNOT 1481671; ANNOT 1481671; CLONE 124720; ANNOT 1441430; ANNOT 1441430; CLONE 147358; ANNOT 1493111; ANNOT 1493111; ANNOT 1461452; ANNOT 1461452; CLONE 154718; ANNOT 1457453; ANNOT 1457453; CLONE 158734; ANNOT 1477956; CLONE 241379; ANNOT 1499284; ANNOT 1526950; ANNOT 1508362; ANNOT 1508362; ANNOT 1477361; ANNOT 1477361; CLONE 262460; ANNOT 1530053; ANNOT 1530053; ANNOT 1493414; ANNOT 1493414; CLONE 660003; ANNOT 1508184; ANNOT 1508184; ANNOT 1528645; ANNOT 1528645; CLONE 681088; ANNOT 1471330; ANNOT 1471330; ANNOT 1444437; ANNOT 1444437; ANNOT 1444439; ANNOT 1486891; ANNOT 1486891; ANNOT 1479637; ANNOT 1479637; ANNOT 1446530; ANNOT 1446530; CLONE 681222; ANNOT 1456923; ANNOT 1456923; CLONE 1006934; ANNOT 1532963; ANNOT 1532963; ANNOT 1007549; ANNOT 1458198; ANNOT 1458198; ANNOT 1439989; ANNOT 1439989; ANNOT 1464789; ANNOT 1464789; ANNOT 1461728; ANNOT 1461728; ANNOT 1479711; ANNOT 1479711; ANNOT 1440649; ANNOT 1440649; ANNOT 1464547; ANNOT 1464547; ANNOT 1454104; ANNOT 1454104; CDNA 23530467; CDNA 23551244; ANNOT 1454030; ANNOT 1454030; ANNOT 1475651; ANNOT 1475651; ANNOT 3650947; ANNOT 1497025; ANNOT 1497025; CDNA 3651446; ANNOT 1475322; ANNOT 1475322; CDNA 3653571; ANNOT 1451133; ANNOT 1451133; ANNOT 1456774; ANNOT 1456774; | 1709; 1710; 1711; 1712; 1713; 1774; 1775; 1776; 1791; 1792; 1793; 1794; 1795; 1801; 1802; 1803; 1804; 1805; 1904; 1905; 1906; 1930; 1931; 1932; 2030; 2031; 2032; 2033; 2034; 2035; 2036; 2085; 2086; 2087; 2088; 2089; 2090; 2091; 2092; 2093; 2094; 2100; 2101; 2102; 2191; 2192; 2193; 2194; 2195; 2407; 2408; 2409; 2410; 2411; 2501; 2502; 2503; 2528; 2529; 2530; 2531; 2532; 2577; 2578; 2579; 2619; 2620; 2621; 2718; 2719; 2720; 2721; 2722; 2723; 2724; 2774; 2775; 2776; 2777; 2778; 3314; 3315; 3316; 3317; 3318; 3345; 3346; 3347; 3348; 3349; 3350; 3351; 3352; 3353; 3354; 3355; 3356; 3357; 3358; 3359; 3360; 3437; 3438; 3439; 3440; 3441; 3442; 3443; 3444; 3445; 3446; 3447; 3448; 3449; 3450; 3451; 3452; 3453; 3454; 3455; 3456; 3786; 3821; 3822; 3823; 3824; 3825; 3890; 3891; 3892; 3905; 3906; 3907; 3956; 3957; 3958; 3959; 3960; |
| FLOWER | Appearance | Large | The flowers are abnormally large. | Useful for making ornamental plants with modified flowers | CLONE 21563; ANNOT 1438905; ANNOT 1438905; ANNOT 1483143; ANNOT 1483143; ANNOT 1451783; ANNOT 1451783; CLONE 112955; | 842; 843; 844; 845; 846; 2247; 2248; 2249; 2330; |
| | | | | | ANNOT 1447634; ANNOT 1447634; | 2331; 2332; |
| ROSETTE LEAVES | Appearance | Leaf Fused to Inflorescence | The leaf is fused to an inflorescence | Useful for making ornamental plants with flowers and leaves fused | CLONE 11214; ANNOT 1501485; ANNOT 1501485; ANNOT 1490496; ANNOT 1490496; ANNOT 1448498; ANNOT 1448498; ANNOT 1474848; ANNOT 1474848; | 448; 449; 450; 451; 452; 453; 454; 455; 456; |

TABLE 1-continued

| Tissue | Phenotype Category | Phenotype | Phenotype Description | Applications | Ceres ID | SEQ ID NO |
|---|---|---|---|---|---|---|
| ROSETTE LEAVES | Appearance | Leaf Fused to Leaf | The leaf is fused to itself or another leaf. | Useful for making ornamental plants with fused leaves | CLONE 3000; ANNOT 1518918; ANNOT 1535677; ANNOT 1535677; ANNOT 1482181; ANNOT 1482181; | 111; 112; 113; 114; 115; 116; 117; |
| ROSETTE LEAVES | Appearance | Lobed Shaped | The leaves have very deep and rounded serrations, giving an appearance of many lobes forming the margins of the leaves. | Useful for making ornamental plants with altered leaf shape | CLONE 20945; ANNOT 1519797; ANNOT 1519797; CLONE 537272; ANNOT 1518918; ANNOT 1535677; ANNOT 1535677; | 818; 819; 820; 3163; 3164; 3165; 3166; 3167; |
| INFLORESCENCE | Appearance | Multi-Inflorescence Fusion | The inflorescence is fused to another inflorescence, creating a celery-like appearance. | Useful for making ornamental plants with modified flowers | CLONE 105554; ANNOT 1451783; ANNOT 1451783; | 2247; 2248; 2249; |
| ROSETTE LEAVES | Appearance | Other | The plants have a morphological phenotype in leaves. | Useful for making ornamental plants with modified leaves | CLONE 332; ANNOT 1474923; CLONE 907; ANNOT 1502138; ANNOT 1502138; ANNOT 1449135; ANNOT 1449135; CLONE 1241; ANNOT 1453081; ANNOT 1453081; ANNOT 1442349; ANNOT 1442349; CLONE 1355; ANNOT 1515808; ANNOT 1515808; ANNOT 1469219; ANNOT 1469219; ANNOT 1462513; ANNOT 1462513; CLONE 1496; ANNOT 1490668; ANNOT 1490668; ANNOT 1474027; ANNOT 1474027; ANNOT 1497865; ANNOT 1497865; ANNOT 1471512; ANNOT 1471512; ANNOT 1443061; ANNOT 1443061; ANNOT 1504203; ANNOT 1504203; ANNOT 1505468; ANNOT 1505468; ANNOT 1452369; ANNOT 1452369; CLONE 2561; ANNOT 1450958; ANNOT 1450958; ANNOT 1456475; ANNOT 1456475; ANNOT 1446945; ANNOT 1446945; CLONE 3000; ANNOT 1518918; ANNOT 1518918; ANNOT 1535677; ANNOT 1535677; ANNOT 1482181; ANNOT 1482181; CLONE 3006; ANNOT 1472173; ANNOT 1472173; CLONE 3036; ANNOT 1456840; ANNOT 1456840; CLONE 3997; ANNOT 1455209; ANNOT 1455209; ANNOT 1446198; ANNOT 1446198; ANNOT 1450889; ANNOT 1450889; ANNOT 1456395; ANNOT 1456395; ANNOT 1456400; ANNOT 1456400; ANNOT 1509111; ANNOT 1509111; ANNOT 1447193; ANNOT 1447193; CLONE 6287; ANNOT 1509111; ANNOT 1509111; ANNOT 1541620; ANNOT 1541620; CLONE 5198; ANNOT 1472153; ANNOT 1472153; CLONE 5968; ANNOT 1450891; ANNOT 1450891; ANNOT 1456400; CLONE 8254; ANNOT 1543042; ANNOT 1543042; ANNOT 1489655; ANNOT 1489655; CLONE 8265; ANNOT 1438919; ANNOT 1438919; ANNOT 1499398; ANNOT 1499398; ANNOT 1446419; ANNOT 1446419; CLONE 8877; ANNOT 1507340; ANNOT 1507340; ANNOT 1529361; ANNOT 1529361; CLONE 9221; ANNOT 1535229; ANNOT 1535229; CLONE 9897; ANNOT 1445849; ANNOT 1445849; ANNOT 1500561; ANNOT 1500561; ANNOT 1464458; ANNOT 1464458; CLONE 10879; ANNOT 1467184; ANNOT 1467184; CLONE 11214; ANNOT 1501485; ANNOT 1501485; ANNOT 1490496; ANNOT 1490496; ANNOT 1448498; ANNOT 1448498; ANNOT 1474848; ANNOT 1474848; CLONE 11929; ANNOT 1518415; ANNOT 1518415; | 12; 13; 14; 30; 31; 32; 33; 34; 38; 39; 40; 41; 42; 43; 44; 45; 46; 47; 48; 49; 50; 51; 52; 53; 54; 55; 56; 57; 58; 59; 60; 61; 62; 63; 64; 65; 66; 104; 105; 106; 107; 108; 109; 110; 111; 112; 113; 114; 115; 116; 117; 118; 119; 120; 121; 122; 123; 178; 179; 180; 181; 182; 183; 184; 185; 186; 230; 231; 232; 250; 251; 252; 253; 254; 255; 256; 257; 258; 259; 260; 285; 286; 287; 288; 289; 357; 358; 359; 360; 361; 362; 363; 364; 365; 366; 367; 368; 383; 384; 385; 386; 387; 394; 395; 396; 405; 406; 407; 408; 409; 410; 411; 437; 438; 439; 448; 449; 450; 451; 452; 453; 454; 455; 456; 480; 481; 482; 483; 484; 485; 486; 487; 488; 489; 490; 491; 492; 493; 494; 495; 496; 507; 508; 509; 515; 516; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1475405; ANNOT 1475405; ANNOT 1457917; ANNOT 1515353; ANNOT 1515353; ANNOT 1484925; ANNOT 1484924; ANNOT 1484924; ANNOT 1462053; ANNOT 1450576; ANNOT 1450576; CLONE 12071; ANNOT 1466704; CLONE 12272; ANNOT 1506387; ANNOT 1506387; ANNOT 1474522; CLONE 13186; ANNOT 1464566; ANNOT 1464566; ANNOT 1458408; ANNOT 1458408; CLONE 13263; ANNOT 1470919; CLONE 13625; ANNOT 1455211; ANNOT 1455211; CLONE 13757; ANNOT 1471425; ANNOT 1471425; CLONE 13800; ANNOT 1458335; ANNOT 1458335; ANNOT 1464663; ANNOT 1464663; CLONE 16461; ANNOT 1479013; ANNOT 1479013; CLONE 16865; ANNOT 1454311; ANNOT 1454311; ANNOT 1483290; ANNOT 1483290; ANNOT 1533930; ANNOT 1533930; ANNOT 1450556; ANNOT 1533218; ANNOT 1533218; ANNOT 1512378; ANNOT 1512378; CLONE 17356; ANNOT 1478584; ANNOT 1478584; ANNOT 1487130; CLONE 17761; ANNOT 1481206; ANNOT 1481206; ANNOT 1534689; ANNOT 1534689; CLONE 18246; ANNOT 1489791; ANNOT 1489791; ANNOT 1470953; ANNOT 1470953; CLONE 18612; ANNOT 1522299; ANNOT 1522299; ANNOT 1527718; ANNOT 1527718; CLONE 19481; ANNOT 1475146; ANNOT 1475146; ANNOT 1454933; ANNOT 1454933; CLONE 19486; ANNOT 1452204; ANNOT 1452204; ANNOT 1443204; ANNOT 1443204; CLONE 19510; ANNOT 1501412; ANNOT 1501412; ANNOT 1490383; ANNOT 1490383; ANNOT 1448419; CLONE 19586; ANNOT 1476446; ANNOT 1476446; ANNOT 1451126; ANNOT 1451126; CLONE 21068; ANNOT 1463333; ANNOT 1463333; ANNOT 1505772; ANNOT 1505772; ANNOT 1495675; ANNOT 1495676; ANNOT 1469576; ANNOT 1469576; ANNOT 1442758; ANNOT 1442758; CLONE 23518; ANNOT 1475658; ANNOT 1475658; ANNOT 1449267; ANNOT 1449267; ANNOT 1507191; ANNOT 1507191; CLONE 23523; ANNOT 1453919; ANNOT 1453919; CLONE 25380; ANNOT 1512618; ANNOT 1512618; ANNOT 1459357; ANNOT 1459357; ANNOT 1463526; ANNOT 1463526; ANNOT 1480776; ANNOT 1480776; CLONE 26560; ANNOT 1536088; ANNOT 1536088; ANNOT 1482610; ANNOT 1482610; CLONE 26907; ANNOT 1484074; ANNOT 1484074; ANNOT 1440016; ANNOT 1440016; ANNOT 1461728; ANNOT 1461728; ANNOT 1518242; ANNOT 1518242; CLONE 28602; ANNOT 1461728; ANNOT 1460480; ANNOT 1460480; ANNOT 1488330; ANNOT 1461614; ANNOT 1461614; ANNOT 1479711; ANNOT 1479711; ANNOT 1479712; ANNOT 1479712; ANNOT 1488329; ANNOT 1488329; ANNOT 1460481; ANNOT 1460481; ANNOT 1461613; ANNOT 1461613; ANNOT 1458198; ANNOT 1458198; ANNOT 1488327; ANNOT 1488327; CLONE 31044; ANNOT 1486207; ANNOT 1486207; ANNOT 1496976; ANNOT 1496976; CLONE 32361; ANNOT 1471776; ANNOT 1471776; ANNOT 1445033; ANNOT 1445033; CLONE 32548; ANNOT 1450324; ANNOT 1450324; ANNOT 1460836; ANNOT 1460836; CLONE 32615; ANNOT 1471372; ANNOT 1471372; CLONE 32737; ANNOT 1536373; ANNOT 1536373; ANNOT 1482905; ANNOT 1482905; CLONE 32791; ANNOT 1538733; ANNOT 1538733; ANNOT 1540248; ANNOT 1540248; CLONE 34167; ANNOT 1538733; ANNOT 1485323; ANNOT 1485323; ANNOT 1499810; ANNOT 1499810; ANNOT 1485323; CLONE 34783; ANNOT 1466952; ANNOT 1466952; ANNOT 1523551; ANNOT 1523551; ANNOT 1470164; ANNOT 1470164; CLONE 37288; ANNOT 1453650; ANNOT 1453650; CLONE 37298; ANNOT 1476538; ANNOT 1476538; ANNOT 1493576; ANNOT 1493576; CLONE 37493; ANNOT 1494370; ANNOT 1494370; ANNOT 1441478; ANNOT 1441478; ANNOT 1440727; ANNOT 1440727; CLONE 37663; ANNOT 1447659; ANNOT 1447659; ANNOT 1443878; | 517; 518; 519; 531; 532; 533; 534; 535; 536; 537; 538; 544; 545; 546; 564; 565; 566; 572; 573; 574; 575; 576; 647; 648; 649; 650; 651; 652; 653; 654; 655; 656; 657; 658; 659; 660; 661; 662; 673; 674; 675; 676; 677; 700; 701; 702; 703; 704; 715; 716; 717; 718; 719; 720; 721; 722; 723; 724; 762; 763; 764; 765; 766; 767; 768; 769; 770; 771; 772; 773; 774; 775; 776; 777; 778; 784; 785; 786; 787; 788; 821; 822; 823; 824; 825; 826; 827; 828; 829; 830; 831; 907; 908; 909; 910; 911; 912; 913; 914; 915; 916; 960; 961; 962; 963; 964; 965; 966; 967; 968; 969; 1015; 1016; 1017; 1018; 1019; 1043; 1044; 1045; 1046; 1047; 1048; 1049; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1190; 1191; 1192; 1193; 1194; 1226; 1227; 1228; 1229; 1230; 1231; 1232; 1233; 1234; 1235; 1239; 1240; 1241; 1242; 1243; 1244; 1245; 1246; 1255; 1256; 1257; 1343; 1344; 1345; 1346; 1347; 1348; 1349; 1423; 1424; 1425; 1426; 1427; 1428; 1429; 1622; 1623; 1624; 1625; 1626; 1627; 1628; 1629; 1637; 1638; 1639; 1640; 1641; 1651; 1652; 1653; 1657; 1658; 1659; 1660; 1661; 1697; 1698; 1699; 1700; 1701; 1702; 1703; 1747; 1748; 1749; 1750; 1751; 1752; 1753; 1769; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1438478; CLONE 38105; ANNOT 1473032; ANNOT 1467499; ANNOT 1467499; ANNOT 1526442; ANNOT 1526442; CLONE 38419; ANNOT 1542971; ANNOT 1542971; ANNOT 1521332; ANNOT 1521332; ANNOT 1467961; ANNOT 1467961; CLONE 38635; ANNOT 1489751; ANNOT 1489751; ANNOT 1446209; ANNOT 1446209; CLONE 38690; ANNOT 1525183; ANNOT 1525183; CLONE 38743; ANNOT 1448369; ANNOT 1448369; CLONE 38873; ANNOT 1451899; ANNOT 1451899; ANNOT 1496367; ANNOT 1496367; CLONE 39286; ANNOT 1447961; ANNOT 1447961; ANNOT 1490936; ANNOT 1490936; CLONE 39890; ANNOT 1511886; ANNOT 1511886; ANNOT 1517635; ANNOT 1517635; CLONE 40436; ANNOT 1441645; ANNOT 1441645; CLONE 40508; ANNOT 1453626; ANNOT 1453626; CLONE 40692; ANNOT 1455695; ANNOT 1455695; CLONE 40729; ANNOT 1481678; ANNOT 1481678; CLONE 40766; ANNOT 1450499; ANNOT 1450499; CLONE 40824; ANNOT 1509015; ANNOT 1509015; ANNOT 1535964; ANNOT 1535964; ANNOT 1535962; ANNOT 1455815; ANNOT 1455815; ANNOT 1455817; ANNOT 1455817; ANNOT 1482502; ANNOT 1482502; ANNOT 1509035; ANNOT 1509035; ANNOT 1482477; ANNOT 1482477; ANNOT 1509013; ANNOT 1509013; ANNOT 1535990; ANNOT 1535990; ANNOT 1455837; ANNOT 1455837; CLONE 4214l; ANNOT 1473839; ANNOT 1473839; CLONE 42925; ANNOT 1462354; ANNOT 1462354; CLONE 92670; ANNOT 1531919; ANNOT 1531919; ANNOT 95135; ANNOT 1527449; ANNOT 1527449; ANNOT 1537653; ANNOT 1537653; ANNOT 1473733; ANNOT 1473733; ANNOT 1468537; ANNOT 1468537; CLONE 97415; ANNOT 1481701; ANNOT 1481701; CLONE 97434; ANNOT 1488311; ANNOT 1488311; ANNOT 1518776; ANNOT 1518776; CLONE 98855; ANNOT 1460836; ANNOT 1460836; ANNOT 1450324; ANNOT 1450324; CLONE 105554; ANNOT 1451783; ANNOT 1451783; CLONE 107988; ANNOT 1459927; ANNOT 1459927; CLONE 109912; ANNOT 1451138; ANNOT 1451138; ANNOT 1456780; ANNOT 1456780; CLONE 111209; ANNOT 1494507; ANNOT 1494507; CLONE 116237; ANNOT 1455816; ANNOT 1455816; ANNOT 1482502; ANNOT 1482502; ANNOT 1482508; ANNOT 1482508; ANNOT 1535990; ANNOT 1535990; ANNOT 1509013; ANNOT 1509013; CLONE 117369; ANNOT 1499284; ANNOT 1499284; ANNOT 1481671; ANNOT 1481671; CLONE 123279; ANNOT 1508945; ANNOT 1508945; ANNOT 1531332; ANNOT 1531332; ANNOT 1551332; ANNOT 1482544; ANNOT 1482544; ANNOT 1487826; ANNOT 1487826; ANNOT 1478226; CLONE 124720; ANNOT 1441430; ANNOT 1441430; CLONE 147358; ANNOT 1493111; ANNOT 1493111; ANNOT 1461452; ANNOT 1461452; CLONE 148943; ANNOT 1472949; ANNOT 1472949; CLONE 150912; ANNOT 1533910; ANNOT 1533910; ANNOT 1480439; ANNOT 1480439; CLONE 151087; ANNOT 1504145; ANNOT 1504145; ANNOT 1451079; ANNOT 1451079; CLONE 154718; ANNOT 1457453; ANNOT 1457453; CLONE 156655; ANNOT 1441740; ANNOT 1441740; CLONE 157547; ANNOT 1473898; ANNOT 1473898; CLONE 158333; ANNOT 1466505; ANNOT 1466505; ANNOT 1449026; ANNOT 1449026; CLONE 158702; ANNOT 1501773; ANNOT 1501773; CLONE 227651; ANNOT 1474222; ANNOT 1474222; ANNOT 1468994; ANNOT 1468994; ANNOT 1497043; ANNOT 1497043; CLONE 241379; ANNOT 1526950; ANNOT 1526950; ANNOT 1508362; ANNOT 1508362; ANNOT 1477361; ANNOT 1477361; CLONE 254065; ANNOT 1485544; ANNOT 1485544; ANNOT 1447051; ANNOT 1447051; ANNOT 1517016; ANNOT 1517016; CLONE 262460; ANNOT 1530053; ANNOT 1530053; ANNOT 1493414; ANNOT 1493414; CLONE 292789; ANNOT 1442040; ANNOT 1442040; ANNOT 1482966; ANNOT 1482966; ANNOT 1454656; ANNOT 1454656; ANNOT 1458103; ANNOT 1458103; ANNOT 1464899; ANNOT 1464899; ANNOT 1474837; | 1770; 1771; 1772; 1773; 1774; 1775; 1776; 1788; 1789; 1790; 1818; 1819; 1820; 1821; 1822; 1838; 1839; 1840; 1841; 1842; 1882; 1883; 1884; 1885; 1886; 1904; 1905; 1906; 1912; 1913; 1914; 1918; 1919; 1920; 1930; 1931; 1932; 1933; 1934; 1935; 1939; 1940; 1941; 1942; 1943; 1944; 1945; 1946; 1947; 1948; 1949; 1950; 1951; 1952; 1953; 1954; 1955; 1956; 1957; 1958; 1959; 1960; 1961; 2015; 2016; 2017; 2045; 2046; 2047; 2061; 2062; 2063; 2076; 2077; 2078; 2079; 2080; 2081; 2082; 2083; 2084; 2100; 2101; 2102; 2103; 2104; 2105; 2106; 2107; 2118; 2119; 2120; 2121; 2122; 2247; 2248; 2249; 2278; 2279; 2280; 2303; 2304; 2305; 2306; 2307; 2314; 2315; 2316; 2383; 2384; 2385; 2386; 2387; 2388; 2389; 2390; 2391; 2392; 2393; 2407; 2408; 2409; 2410; 2411; 2492; 2493; 2494; 2495; 2496; 2497; 2498; 2499; 2500; 2501; 2502; 2503; 2528; 2529; 2530; 2531; 2532; 2543; 2544; 2545; 2555; 2556; 2557; 2558; 2559; 2560; 2561; 2562; 2563; 2564; 2577; 2578; 2579; 2580; 2581; 2582; 2593; 2594; 2595; 2611; 2612; 2613; 2614; 2615; 2616; 2617; 2618; 2683; 2684; 2685; 2686; 2687; 2688; 2689; 2718; 2719; 2720; 2721; 2722; 2723; 2724; 2731; 2732; 2733; 2734; 2735; 2736; 2737; 2774; 2775; 2776; 2777; 2778; 2852; 2853; 2854; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1474837; ANNOT 1520449; ANNOT 1538169; ANNOT 1538169; CLONE 463203; ANNOT 1511505; CLONE 563522; ANNOT 1460321; ANNOT 1460321; ANNOT 1508144; ANNOT 1541886; ANNOT 1541886; ANNOT 1475178; ANNOT 1508144; ANNOT 1508184; ANNOT 1508184; ANNOT 1528645; CLONE 660003; ANNOT 1001432; ANNOT 1475043; ANNOT 1454586; CLONE 1507756; ANNOT 1507756; ANNOT 1469708; CLONE 1002819; ANNOT 1474290; ANNOT 1522314; ANNOT 1522314; ANNOT 1497147; ANNOT 1497147; ANNOT 1471045; CLONE 1006934; ANNOT 1532963; CLONE 1007549; ANNOT 1458198; ANNOT 1458198; ANNOT 1439989; ANNOT 1464789; ANNOT 1464789; ANNOT 1461728; ANNOT 1479711; ANNOT 1440649; ANNOT 1440649; ANNOT 1464547; ANNOT 1464547; ANNOT 1454104; CDNA 23498145; ANNOT 1482362; ANNOT 1489077; ANNOT 1489077; ANNOT 1510416; ANNOT 1510416; ANNOT 1541253; CDNA 23545147; ANNOT 1443044; ANNOT 1443044; CDNA 36507011; ANNOT 1442604; ANNOT 1442612; ANNOT 1442612; ANNOT 1442608; ANNOT 1452827; ANNOT 1452827; CDNA 36507407; ANNOT 1457193; ANNOT 1487854; ANNOT 1487854; CDNA 36508177; CDNA 36512904; ANNOT 1471370; ANNOT 1471370; ANNOT 1444471; ANNOT 1491278; ANNOT 1491278; ANNOT 1447690; ANNOT 1447690; CDNA 36545500; ANNOT 1449045; ANNOT 1449045; ANNOT 1470714; ANNOT 1470714; CDNA 36571789; ANNOT 1444156; ANNOT 1444156; ANNOT 1497097; CDNA 36579424; ANNOT 1455663; ANNOT 1455663; ANNOT 1438024; ANNOT 1451434; ANNOT 1448068; ANNOT 1448068; CDNA 36695523; ANNOT 1461440; ANNOT 1461427; ANNOT 1461427; ANNOT 1461440; ANNOT 1461430; ANNOT 1440253; | 2855; 2856; 2857; 2858; 2859; 2860; 2861; 2862; 2863; 2864; 2865; 2866; 2867; 2868; 3003; 3004; 3005; 3227; 3228; 3229; 3230; 3231; 3232; 3233; 3234; 3235; 3314; 3315; 3316; 3317; 3318; 3319; 3420; 3421; 3422; 3423; 3424; 3425; 3426; 3427; 3428; 3429; 3430; 3431; 3432; 3433; 3434; 3435; 3436; 3437; 3438; 3439; 3440; 3441; 3442; 3443; 3444; 3445; 3446; 3447; 3448; 3449; 3450; 3451; 3452; 3453; 3454; 3455; 3456; 3641; 3642; 3643; 3644; 3645; 3704; 3705; 3706; 3707; 3708; 3813; 3814; 3815; 3875; 3876; 3877; 3878; 3879; 3880; 3881; 3882; 3883; 3884; 3885; 3886; 3887; 3888; 3889; 3896; 3897; 3898; 3899; 3900; 3901; 3902; 3903; 3904; 3979; 3980; 3981; 3982; 3983; 4043; 4044; 4045; 4046; 4047; 4063; 4064; 4065; 4066; 4067; 4068; 4069; 4070; 4071; 4072; 4073; 4074; 4075; 4076; 4077; 4078; 4079; 4080; 4081; |
| CAULINE LEAVES | Appearance | Other | The plant has a morphological phenotype in cauline leaves. | Useful for making ornamental plants with modified leaves | CLONE 13186; ANNOT 1464566; ANNOT 1458408; ANNOT 1458408; CLONE 13757; ANNOT 1471425; ANNOT 1471425; CLONE 26560; ANNOT 1536088; ANNOT 1536088; ANNOT 1482610; ANNOT 1482610; CLONE 37288; ANNOT 1531721; ANNOT 1453650; CLONE 37398; ANNOT 1531721; ANNOT 1531721; ANNOT 1478221; ANNOT 1478221; ANNOT 1482547; ANNOT 1482547; CLONE 156655; ANNOT 1441740; ANNOT 1441740; | 531; 532; 533; 534; 535; 564; 565; 566; 1015; 1016; 1017; 1018; 1019; 1622; 1623; 1624; 1630; 1631; 1632; 1633; 1634; 1635; 1636; 2580; 2581; 2582; |
| FLOWER | Appearance | Other | The plants have a morphological phenotype in flowers. | Useful for making ornamental plants with modified flowers | CLONE 2036; ANNOT 1526068; CLONE 3000; ANNOT 1518918; ANNOT 1518918; ANNOT 1535677; ANNOT 1482181; ANNOT 1482181; CLONE 6397; ANNOT 1486285; CLONE 9132; ANNOT 1458620; CLONE 13186; ANNOT 1464566; ANNOT 1458408; ANNOT 1458408; CLONE 13757; ANNOT 1471425; ANNOT 1471425; CLONE 14555; ANNOT 1511392; ANNOT 1469356; ANNOT 1469356; ANNOT 1517500; ANNOT 1458151; ANNOT 1458151; ANNOT 1522757; CLONE 14583; ANNOT 1530256; ANNOT 1530256; ANNOT 1476783; ANNOT 1503166; ANNOT | 84; 85; 86; 111; 112; 113; 114; 115; 116; 117; 290; 291; 292; 391; 392; 393; 531; 532; 533; 534; 535; 564; 565; 566; 608; 609; 610; 611; 612; 613; 614; 615; 616; 617; 618; 619; 620; 621; 622; 623; 624; 625; 784; 785; 786; |

TABLE 1-continued

| Tissue | Phenotype Category | Phenotype | Phenotype Description | Applications | Ceres ID | SEQ ID NO |
|---|---|---|---|---|---|---|
| | | | | | 1503166; CLONE 19586; ANNOT 1476446; ANNOT 1451126; ANNOT 1451126; CLONE 21563; ANNOT 1438905; ANNOT 1483143; ANNOT 1483143; CLONE 25538; ANNOT 1480776; ANNOT 1480776; CLONE 30759; ANNOT 1520359; ANNOT 1494753; ANNOT 1494753; ANNOT 1441875; ANNOT 1441875; ANNOT 1467006; ANNOT 1467006; ANNOT 1441867; ANNOT 1441867; ANNOT 1441871; ANNOT 1441871; ANNOT 1441864; ANNOT 1441864; ANNOT 1441868; ANNOT 1441868; ANNOT 1441859; ANNOT 1441859; ANNOT 1467009; CLONE 3791; ANNOT 3791; ANNOT 1540248; ANNOT 1540248; CLONE 37298; ANNOT 1476538; ANNOT 1476538; ANNOT 1493576; ANNOT 1493576; CLONE 37398; ANNOT 1531721; ANNOT 1531721; ANNOT 1478221; ANNOT 1478221; ANNOT 1482547; ANNOT 1482547; ANNOT 1494370; ANNOT 1494370; CLONE 37493; ANNOT 1494370; ANNOT 1441478; ANNOT 1441478; CLONE 38370; ANNOT 1471869; ANNOT 1471869; ANNOT 1448032; ANNOT 1448032; ANNOT 1448031; ANNOT 1448031; ANNOT 1438060; ANNOT 1438060; ANNOT 1438061; ANNOT 1438061; ANNOT 1438030; ANNOT 1438030; ANNOT 1437831; CLONE 38743; ANNOT 1448369; ANNOT 1448369; CLONE 39890; ANNOT 1511886; ANNOT 1511886; ANNOT 1517635; CLONE 40729; ANNOT 1481678; ANNOT 1481678; CLONE 41337; ANNOT 1516613; ANNOT 1516613; ANNOT 1513097; ANNOT 1513097; ANNOT 1463324; ANNOT 1463324; ANNOT 95453; ANNOT 1460836; ANNOT 1460836; ANNOT 1450324; ANNOT 1450324; ANNOT 1450324; CLONE 98855; ANNOT 1460836; ANNOT 1503141; ANNOT 1521524; CLONE 105554; ANNOT 1451783; ANNOT 1451783; CLONE 112955; ANNOT 1447634; ANNOT 1447634; | 787; 788; 842; 843; 844; 845; 846; 967; 968; 969; 1164; 1165; 1166; 1167; 1168; 1169; 1170; 1171; 1172; 1173; 1174; 1175; 1176; 1177; 1178; 1179; 1180; 1181; 1182; 1183; 1184; 1255; 1256; 1257; 1625; 1626; 1627; 1628; 1629; 1630; 1631; 1632; 1633; 1634; 1635; 1636; 1637; 1638; 1639; 1640; 1641; 1732; 1733; 1734; 1735; 1736; 1737; 1738; 1739; 1740; 1741; 1742; 1743; 1744; 1745; 1746; 1788; 1789; 1790; 1882; 1883; 1884; 1885; 1886; 1930; 1931; 1932; 1988; 1989; 1990; 1991; 1992; 1993; 1994; 2085; 2086; 2087; 2088; 2089; 2118; 2119; 2120; 2121; 2122; 2191; 2192; 2193; 2194; 2195; 2247; 2248; 2249; 2330; 2331; 2332; |
| INFLORESCENCE | Appearance | Other | The plants have a morphological phenotype in inflorescences. | Useful for making ornamental plants with modified flowers | CLONE 314; ANNOT 1543129; CLONE 1543129; ANNOT 1474923; ANNOT 1474923; CLONE 332; ANNOT 1474923; ANNOT 1474923; CLONE 3000; ANNOT 1518918; ANNOT 1518918; ANNOT 1535677; ANNOT 1535677; ANNOT 1482181; ANNOT 1482181; CLONE 3036; ANNOT 1456840; ANNOT 1456840; CLONE 4058; ANNOT 4058; ANNOT 1468992; ANNOT 1468992; ANNOT 1444098; ANNOT 1444098; ANNOT 1474224; ANNOT 1474224; ANNOT 1524351; ANNOT 1524351; CLONE 4067; ANNOT 4067; ANNOT 1514362; ANNOT 1514362; ANNOT 1494090; ANNOT 1494090; CLONE 6387; ANNOT 6387; ANNOT 1509111; ANNOT 1509111; ANNOT 1541620; CLONE 6397; ANNOT 6397; ANNOT 1486285; ANNOT 1486285; CLONE 8068; ANNOT 8068; ANNOT 1510462; ANNOT 1510462; ANNOT 1471422; ANNOT 1471422; ANNOT 1497509; ANNOT 1497509; CLONE 8265; ANNOT 8265; ANNOT 1438919; ANNOT 1438919; ANNOT 1499398; ANNOT 1499398; ANNOT 1446419; ANNOT 1446419; CLONE 8633; ANNOT 8633; ANNOT 1527560; ANNOT 1527560; ANNOT 1522449; ANNOT 1522449; CLONE 9132; ANNOT 9132; ANNOT 1458620; ANNOT 1458620; CLONE 11214; ANNOT 11214; ANNOT 1501485; ANNOT 1501485; ANNOT 1490496; ANNOT 1490496; CLONE 11214; ANNOT 1448498; ANNOT 1448498; ANNOT 1474848; ANNOT 1474848; ANNOT 1474848; CLONE 13186; ANNOT 1464566; ANNOT 1464566; ANNOT 1458408; ANNOT 1458408; CLONE 13391; ANNOT 13391; ANNOT 1445555; ANNOT 1445555; ANNOT 1462963; ANNOT 1462963; ANNOT 1502315; CLONE 13741; ANNOT 13741; ANNOT 1462963; ANNOT 1462963; ANNOT 1459563; CLONE 13757; ANNOT 13757; ANNOT 1471425; ANNOT 1471425; CLONE 19510; ANNOT 1501412; ANNOT 1501412; ANNOT 1490383; ANNOT 1490383; ANNOT 1438905; ANNOT 1438905; ANNOT 1444819; ANNOT 1444819; CLONE 21563; ANNOT 23322; ANNOT 1512337; ANNOT 1512337; ANNOT 1483143; ANNOT 1483143; ANNOT 1517094; ANNOT 1517094; CLONE 23518; ANNOT 1475658; ANNOT 1475658; ANNOT 1449267; ANNOT 1449267; | 9; 10; 11; 12; 13; 14; 111; 112; 113; 114; 115; 116; 117; 121; 122; 123; 187; 188; 189; 190; 191; 192; 193; 194; 195; 196; 197; 198; 199; 200; 285; 286; 287; 288; 289; 290; 291; 292; 345; 346; 347; 348; 349; 350; 351; 362; 363; 364; 365; 366; 367; 368; 375; 376; 377; 378; 379; 391; 392; 393; 448; 449; 450; 451; 452; 453; 454; 455; 456; 531; 532; 533; 534; 535; 539; 540; 541; 542; 543; 550; 551; 552; 553; 554; 564; 565; 566; 772; 773; 774; 775; 776; 777; 778; 842; 843; 844; 845; 846; 897; 898; 899; 900; 901; 907; 908; 909; 910; 911; 912; 913; 960; 961; 962; 963; 964; 965; 966; 967; 968; 969; |

TABLE 1-continued

| Tissue | Phenotype Category | Phenotype | Phenotype Description | Applications | Ceres ID | SEQ ID NO |
|---|---|---|---|---|---|---|
| | | | | | 1449267; ANNOT 1507191; CLONE 25380; ANNOT 1512618; ANNOT 1512618; ANNOT 1459357; ANNOT 1459357; ANNOT 1463526; ANNOT 1463526; CLONE 25538; ANNOT 1480776; CLONE 25758; ANNOT 1473748; CLONE 25886; ANNOT 1446650; ANNOT 1446650; ANNOT 1439514; ANNOT 1439514; ANNOT 1477202; ANNOT 1477202; ANNOT 1455325; ANNOT 1455325; CLONE 27460; ANNOT 1474847; ANNOT 1474847; ANNOT 1507835; CLONE 27835; CLONE 28643; ANNOT 1469464; ANNOT 1469464; ANNOT 1463508; ANNOT 1463508; ANNOT 1459366; ANNOT 1459366; ANNOT 1542246; ANNOT 1542246; CLONE 31507; ANNOT 1447204; ANNOT 1447204; CLONE 32082; ANNOT 1446894; ANNOT 1446894; ANNOT 1481146; ANNOT 1543513; ANNOT 1481150; CLONE 33559; ANNOT 1481146; ANNOT 1481138; ANNOT 1481138; ANNOT 1485824; ANNOT 1485824; ANNOT 1534622; ANNOT 1534622; CLONE 34412; ANNOT 1449739; ANNOT 1449739; ANNOT 1449738; ANNOT 1449738; ANNOT 1458830; CLONE 35493; ANNOT 1457751; ANNOT 1457751; ANNOT 1518757; ANNOT 1465420; ANNOT 1465420; CLONE 36891; ANNOT 1480518; ANNOT 1480518; ANNOT 1442194; ANNOT 1442194; ANNOT 1454127; ANNOT 1454127; ANNOT 1461716; ANNOT 1461716; ANNOT 1440277; ANNOT 1461414; ANNOT 1461415; ANNOT 1461414; ANNOT 1461414; ANNOT 1447424; ANNOT 1447424; ANNOT 1528127; ANNOT 1528127; ANNOT 1438717; ANNOT 1440276; ANNOT 1440276; ANNOT 1442556; ANNOT 1442556; ANNOT 1452873; ANNOT 1452873; ANNOT 1453483; ANNOT 1453483; ANNOT 1473384; ANNOT 1473384; ANNOT 1475808; ANNOT 1475808; ANNOT 1474708; ANNOT 1474708; ANNOT 1438698; ANNOT 1438698; CLONE 37019; ANNOT 1517849; ANNOT 1517849; ANNOT 1511684; ANNOT 1511684; ANNOT 1464532; ANNOT 1464532; ANNOT 1458439; ANNOT 1458439; ANNOT 1540674; ANNOT 1540674; CLONE 37288; ANNOT 1453650; ANNOT 1453650; ANNOT 1476538; ANNOT 1476538; ANNOT 1493576; CLONE 37298; CLONE 37398; ANNOT 1531721; ANNOT 1531721; ANNOT 1478221; ANNOT 1478221; ANNOT 1482547; ANNOT 1482547; CLONE 38214; ANNOT 1466779; ANNOT 1466779; ANNOT 1465769; ANNOT 1465769; ANNOT 1538318; ANNOT 1538318; CLONE 38743; ANNOT 1448369; ANNOT 1448369; CLONE 38973; ANNOT 1451899; ANNOT 1451899; ANNOT 1496367; ANNOT 1496367; CLONE 39890; ANNOT 1511886; ANNOT 1511886; ANNOT 1517635; ANNOT 1517635; CLONE 40153; ANNOT 1453549; ANNOT 1453549; ANNOT 1528184; ANNOT 1528184; ANNOT 1474758; ANNOT 1474758; CLONE 41337; ANNOT 1516613; ANNOT 1516613; ANNOT 1513097; ANNOT 1513097; ANNOT 1463324; ANNOT 1463324; CLONE 42925; ANNOT 1462354; ANNOT 1462354; CLONE 96020; ANNOT 1450365; ANNOT 1450365; ANNOT 1460794; ANNOT 1460794; CLONE 97434; ANNOT 1488311; ANNOT 1488311; ANNOT 1518776; ANNOT 1518776; CLONE 100319; ANNOT 1503141; ANNOT 1503141; ANNOT 1521524; ANNOT 1521524; CLONE 101686; ANNOT 1479756; ANNOT 1479756; ANNOT 1540137; ANNOT 1540137; ANNOT 1486722; ANNOT 1486722; CLONE 106301; CLONE 112955; ANNOT 1447634; ANNOT 1447634; CLONE 117369; ANNOT 1499284; ANNOT 1499284; ANNOT 1481671; ANNOT 1481671; CLONE 126592; ANNOT 1474017; ANNOT 1474017; ANNOT 1468796; ANNOT 1468796; CLONE 147593; ANNOT 1475653; ANNOT 1475653; ANNOT 1458131; ANNOT 1458131; ANNOT 1461780; ANNOT 1461780; CLONE 156655; ANNOT 1441740; CLONE 157547; ANNOT 1473898; ANNOT 1473898; CLONE 157730; ANNOT 1532681; ANNOT 1469739; ANNOT | 973; 974; 975; 986; 987; 988; 989; 990; 991; 992; 993; 994; 1055; 1056; 1057; 1058; 1059; 1122; 1123; 1124; 1125; 1126; 1127; 1128; 1129; 1130; 1195; 1196; 1197; 1201; 1202; 1203; 1204; 1205; 1310; 1311; 1312; 1313; 1314; 1315; 1316; 1317; 1318; 1319; 1320; 1376; 1377; 1378; 1379; 1380; 1381; 1382; 1460; 1461; 1462; 1463; 1464; 1465; 1466; 1548; 1549; 1550; 1551; 1552; 1553; 1554; 1555; 1556; 1557; 1558; 1559; 1560; 1561; 1562; 1563; 1564; 1565; 1566; 1567; 1568; 1569; 1570; 1571; 1572; 1573; 1574; 1575; 1576; 1577; 1578; 1579; 1580; 1581; 1582; 1583; 1584; 1599; 1600; 1601; 1602; 1603; 1604; 1605; 1606; 1607; 1608; 1609; 1622; 1623; 1624; 1625; 1626; 1627; 1628; 1629; 1630; 1631; 1632; 1633; 1634; 1635; 1636; 1707; 1708; 1709; 1710; 1711; 1712; 1713; 1788; 1789; 1790; 1818; 1819; 1820; 1821; 1822; 1882; 1883; 1884; 1885; 1886; 1897; 1898; 1899; 1900; 1901; 1902; 1903; 1988; 1989; 1990; 1991; 1992; 1993; 1994; 2045; 2046; 2047; 2095; 2096; 2097; 2098; 2099; 2103; 2104; 2105; 2106; 2107; 2191; 2192; 2193; 2194; 2195; 2212; 2213; 2214; 2215; 2216; 2217; 2218; 2262; 2330; 2331; 2332; 2407; 2408; 2409; 2410; 2411; 2512; 2513; 2514; 2515; 2516; 2533; 2534; 2535; 2536; 2537; 2538; 2539; |

TABLE 1-continued

| Tissue | Phenotype Category | Phenotype | Phenotype Description | Applications | Ceres ID | SEQ ID NO |
|---|---|---|---|---|---|---|
| | | | | | 1469739; CLONE 158734; ANNOT 1477956; CLONE 225601; ANNOT 1457617; ANNOT 1465289; ANNOT 1438014; ANNOT 1478647; ANNOT 1478647; ANNOT 1453865; ANNOT 1438014; ANNOT 1438014; CLONE 226818; ANNOT 1503617; ANNOT 1450560; ANNOT 1450560; ANNOT 1460622; CLONE 241379; ANNOT 1526950; ANNOT 1508362; ANNOT 1508362; ANNOT 1477361; ANNOT 1477361; ANNOT 1473933; ANNOT 1473933; ANNOT 1468704; CLONE 267564; ANNOT 1442040; ANNOT 1442040; ANNOT 1482966; ANNOT 1454656; ANNOT 1454656; ANNOT 1458103; ANNOT 1458103; ANNOT 1464899; ANNOT 1464899; ANNOT 1474837; ANNOT 1474837; ANNOT 1520449; ANNOT 1538169; ANNOT 1538169; CLONE 536726; ANNOT 1499826; ANNOT 1499826; ANNOT 1445243; ANNOT 1525386; ANNOT 1448522; ANNOT 1448522; ANNOT 1465506; ANNOT 1497017; ANNOT 1497017; ANNOT 1447240; ANNOT 1447240; ANNOT 1539566; ANNOT 1539566; ANNOT 1458198; ANNOT 1444070; ANNOT 1439989; ANNOT 1464789; ANNOT 1500987; ANNOT 1500987; ANNOT 1490915; CLONE 1002819; ANNOT 1474290; ANNOT 1474290; ANNOT 1522314; ANNOT 1497147; ANNOT 1497147; ANNOT 1471045; CLONE 1007549; ANNOT 1458198; ANNOT 1458198; ANNOT 1461728; ANNOT 1479711; ANNOT 1479711; ANNOT 1464789; ANNOT 1440649; ANNOT 1464547; ANNOT 1464547; ANNOT 1454104; ANNOT 1454104; CDNA 23498145; ANNOT 1482362; ANNOT 1482362; ANNOT 1489077; ANNOT 1489077; CDNA 2505103; CDNA 36512904; ANNOT 1471370; ANNOT 1471370; ANNOT 1444471; ANNOT 1491278; ANNOT 1491278; ANNOT 1447690; CDNA 36521407; ANNOT 1514988; ANNOT 1514988; CDNA 36532976; ANNOT 1445379; ANNOT 1445379; ANNOT 1449468; CDNA 36545500; ANNOT 1449045; ANNOT 1449045; ANNOT 1470714; ANNOT 1447690; ANNOT 1447690; ANNOT 1491278; ANNOT 1491278; ANNOT 1500987; ANNOT 1490915; ANNOT 1490915; | 2580; 2581; 2582; 2593; 2594; 2595; 2601; 2602; 2603; 2604; 2605; 2619; 2620; 2621; 2665; 2666; 2667; 2668; 2669; 2670; 2671; 2672; 2673; 2674; 2675; 2676; 2677; 2678; 2679; 2680; 2681; 2682; 2718; 2719; 2720; 2721; 2722; 2723; 2724; 2789; 2790; 2791; 2792; 2793; 2852; 2853; 2854; 2855; 2856; 2857; 2858; 2859; 2860; 2861; 2862; 2863; 2864; 2865; 2866; 2867; 2868; 3135; 3136; 3137; 3138; 3139; 3140; 3141; 3142; 3143; 3144; 3145; 3146; 3147; 3148; 3149; 3150; 3151; 3152; 3153; 3299; 3300; 3301; 3302; 3303; 3428; 3429; 3430; 3431; 3432; 3433; 3434; 3435; 3436; 3440; 3441; 3442; 3443; 3444; 3445; 3446; 3447; 3448; 3449; 3450; 3451; 3452; 3453; 3454; 3455; 3456; 3641; 3642; 3643; 3644; 3645; 3687; 3896; 3897; 3898; 3899; 3900; 3901; 3902; 3903; 3904; 3908; 3909; 3910; 3928; 3929; 3930; 3931; 3932; 3979; 3980; 3981; 3982; 3983; 3688; 3689; 3690; 3691; 3692; 3693; 3694; 3695; |
| WHOLE PLANT | Appearance | Other | The plants have a morphological phenotype. | Useful for making ornamental plants | CLONE 314; ANNOT 1543129; CLONE 332; ANNOT 1474923; ANNOT 1474923; CLONE 1355; ANNOT 1515808; ANNOT 1515808; ANNOT 1469219; ANNOT 1469219; ANNOT 1462513; CLONE 3000; ANNOT 1518918; ANNOT 1518918; ANNOT 1535677; ANNOT 1482181; ANNOT 1482181; CLONE 5167; ANNOT 1465422; ANNOT 1465422; ANNOT 1457750; ANNOT 1457750; ANNOT 1513544; ANNOT 1513544; CLONE 5605; ANNOT 1437939; ANNOT 1437939; CLONE 6220; ANNOT 1488463; ANNOT 1488463; ANNOT 1541879; ANNOT 1541879; CLONE 9132; ANNOT 1458620; ANNOT 1458620; CLONE 9683; ANNOT 1471514; ANNOT 1471514; CLONE 10857; ANNOT 1464446; ANNOT 1464446; CLONE 13186; ANNOT 1464566; ANNOT 1464566; ANNOT 1458408; ANNOT 1458408; CLONE 13757; ANNOT 1471425; ANNOT 1471425; CLONE 14909; ANNOT 1499838; ANNOT 1497838; ANNOT 1522523; ANNOT 1522523; ANNOT 1471525; ANNOT 1471525; ANNOT | 9; 10; 11; 12; 13; 14; 43; 44; 45; 46; 47; 48; 49; 111; 112; 113; 114; 115; 116; 117; 223; 224; 225; 226; 227; 228; 229; 238; 239; 240; 275; 276; 277; 278; 279; 391; 392; 393; 402; 403; 404; 434; 435; 436; 531; 532; 533; 534; 535; 564; 565; 566; 626; 627; 628; 629; 630; 631; 632; 633; 634; 635; 636; 637; 638; 639; 640; 678; |

TABLE 1-continued

| Tissue | Phenotype Category | Phenotype | Phenotype Description | Applications | Ceres ID | SEQ ID NO |
|---|---|---|---|---|---|---|
| | | | | | 1511908; ANNOT 1511908; ANNOT 1451416; ANNOT 1464305; ANNOT 1451416; ANNOT 1451416; ANNOT 1461050; ANNOT 1461050; CLONE 17409; ANNOT 1457617; ANNOT 1457617; ANNOT 1465289; ANNOT 1478647; ANNOT 1478647; ANNOT 1478647; ANNOT 1453865; ANNOT 1453865; CLONE 19188; ANNOT 1445089; ANNOT 1445089; CLONE 19481; ANNOT 1475146; ANNOT 1475146; ANNOT 1454933; ANNOT 1454933; CLONE 19486; ANNOT 1452204; ANNOT 1452204; ANNOT 1452204; ANNOT 1443204; CLONE 23523; ANNOT 1453919; ANNOT 1453919; CLONE 24266; ANNOT 1463475; ANNOT 1463475; ANNOT 1540920; ANNOT 1540920; ANNOT 1487528; ANNOT 1487528; CLONE 25607; ANNOT 1450220; ANNOT 1450220; CLONE 26542; ANNOT 1475323; ANNOT 1475323; ANNOT 1538272; ANNOT 1538272; CLONE 26907; ANNOT 1484074; ANNOT 1484074; ANNOT 1440016; ANNOT 1440016; ANNOT 1451842; ANNOT 1518242; CLONE 27464; ANNOT 1453044; ANNOT 1453044; ANNOT 1451171; ANNOT 1451171; CLONE 32753; ANNOT 1480607; ANNOT 1480607; ANNOT 1472242; ANNOT 1472242; CLONE 35051; ANNOT 1443033; ANNOT 1443033; ANNOT 1452408; ANNOT 1452408; ANNOT 1505508; ANNOT 1505508; CLONE 36518; ANNOT 1471507; ANNOT 1471507; ANNOT 1444893; ANNOT 1444893; ANNOT 1458642; ANNOT 1458642; ANNOT 1522497; ANNOT 1522497; ANNOT 1469105; ANNOT 1469105; ANNOT 1484993; ANNOT 1484993; CLONE 36701; ANNOT 1487885; ANNOT 1487885; ANNOT 1457156; ANNOT 1457156; ANNOT 1449371; ANNOT 1449371; ANNOT 1445504; ANNOT 1445504; CLONE 37298; ANNOT 1476538; ANNOT 1476538; ANNOT 1493576; CLONE 38697; ANNOT 1470862; ANNOT 1470862; ANNOT 1443740; ANNOT 1443740; ANNOT 1461162; ANNOT 1461162; ANNOT 1526959; ANNOT 1526959; ANNOT 1468331; ANNOT 1468331; CLONE 39890; ANNOT 1511886; ANNOT 1511886; ANNOT 1517635; ANNOT 1517635; CLONE 41439; CLONE 95135; ANNOT 1527449; ANNOT 1527449; ANNOT 1537653; ANNOT 1537653; ANNOT 1473733; ANNOT 1473733; ANNOT 1468537; ANNOT 1468537; CLONE 96020; ANNOT 1450365; ANNOT 1450365; ANNOT 1460794; ANNOT 1460794; CLONE 97434; ANNOT 1488311; ANNOT 1488311; ANNOT 1518776; CLONE 113719; ANNOT 1513206; ANNOT 1513206; ANNOT 1516003; ANNOT 1462703; ANNOT 1462703; CLONE 123279; ANNOT 1508945; ANNOT 1508945; ANNOT 1531332; ANNOT 1531332; ANNOT 1482544; ANNOT 1478226; ANNOT 1478226; CLONE 141830; ANNOT 1488335; ANNOT 1488335; CLONE 147593; ANNOT 1475653; ANNOT 1475653; ANNOT 1458131; ANNOT 1458131; ANNOT 1461780; ANNOT 1461780; CLONE 152076; ANNOT 1493664; ANNOT 1493664; CLONE 225601; ANNOT 1457617; ANNOT 1457617; ANNOT 1465289; ANNOT 1465289; ANNOT 1478647; ANNOT 1478647; ANNOT 1453865; ANNOT 1453865; ANNOT 1438014; CLONE 262460; ANNOT 1530053; ANNOT 1530053; ANNOT 1493414; ANNOT 1493414; CLONE 536796; ANNOT 1484779; ANNOT 1484779; ANNOT 1538185; ANNOT 1538185; ANNOT 1455109; ANNOT 1455109; ANNOT 1477384; ANNOT 1477384; CLONE 557009; ANNOT 1474923; ANNOT 1474923; CLONE 660003; ANNOT 1508184; ANNOT 1508184; ANNOT 1528645; ANNOT 1528645; CDNA 3655438l; ANNOT 1523115; ANNOT 1523115; ANNOT 1479243; ANNOT 1479243; CDNA 3657579; ANNOT 1486224; ANNOT 1486224; ANNOT 1444021; ANNOT 1444021; | 679; 680; 681; 682; 683; 684; 685; 686; 747; 748; 749; 762; 763; 764; 765; 766; 767; 768; 769; 770; 771; 914; 915; 916; 937; 938; 939; 940; 941; 942; 943; 970; 971; 972; 1010; 1011; 1012; 1013; 1014; 1043; 1044; 1045; 1046; 1047; 1048; 1049; 1060; 1061; 1062; 1063; 1064; 1250; 1251; 1252; 1253; 1254; 1441; 1442; 1443; 1444; 1445; 1446; 1447; 1505; 1506; 1507; 1508; 1509; 1510; 1511; 1512; 1513; 1514; 1515; 1516; 1517; 1536; 1537; 1538; 1539; 1540; 1541; 1542; 1543; 1544; 1625; 1626; 1627; 1628; 1629; 1777; 1778; 1779; 1780; 1781; 1782; 1783; 1784; 1785; 1786; 1787; 1882; 1883; 1884; 1885; 1886; 1998; 2076; 2077; 2078; 2079; 2080; 2081; 2082; 2083; 2084; 2095; 2096; 2097; 2098; 2099; 2103; 2104; 2105; 2106; 2107; 2333; 2334; 2335; 2336; 2337; 2338; 2339; 2492; 2493; 2494; 2495; 2496; 2497; 2498; 2499; 2500; 2520; 2521; 2522; 2533; 2534; 2535; 2536; 2537; 2538; 2539; 2565; 2566; 2567; 2665; 2666; 2667; 2668; 2669; 2670; 2671; 2672; 2673; 2674; 2675; 2774; 2775; 2776; 2777; 2778; 3154; 3155; 3156; 3157; 3158; 3159; 3160; 3161; 3162; 3221; 3222; 3223; 3314; 3315; 3316; 3317; 3318; 4000; 4001; 4002; 4003; 4004; 4053; 4054; 4055; 4056; 4057; |
| ROSETTE LEAVES | Appearance | Oval Shaped | The leaves are much rounder | Useful for making | CLONE 907; ANNOT 1502138; ANNOT 1502138; ANNOT 1449135; ANNOT 1449135; CLONE 1241; ANNOT 1453081; ANNOT 1453081; ANNOT 1442349; | 30; 31; 32; 33; 34; 38; 39; 40; 41; 42; 67; 68; |

TABLE 1-continued

| Tissue | Phenotype Category | Phenotype | Phenotype Description | Applications | Ceres ID | SEQ ID NO |
|---|---|---|---|---|---|---|
| | | | than wild-type. | ornamental plants with altered leaf shape | ANNOT 1442349; CLONE 1610; ANNOT 1454586; ANNOT 1454586; ANNOT 1475043; ANNOT 1475043; ANNOT 1507756; ANNOT 1507756; ANNOT 1469708; ANNOT 1469708; CLONE 3036; ANNOT 1456840; ANNOT 1456840; CLONE 3363; ANNOT 1445515; ANNOT 1445515; ANNOT 1446198; ANNOT 1446198; ANNOT 1446198; ANNOT 1518517; ANNOT 1449363; ANNOT 1449363; ANNOT 1466198; ANNOT 1466198; ANNOT 1461861; ANNOT 1518517; CLONE 3542; ANNOT 1471301; ANNOT 1471301; CLONE 3858; ANNOT 1459068; ANNOT 1459068; CLONE 6082; ANNOT 1443416; ANNOT 1443416; ANNOT 1505047; ANNOT 1505047; ANNOT 1496339; ANNOT 1496339; CLONE 8254; ANNOT 1543042; ANNOT 1543042; ANNOT 1489655; ANNOT 1489655; CLONE 8265; ANNOT 1438919; ANNOT 1438919; ANNOT 1499398; ANNOT 1499398; ANNOT 1446419; ANNOT 1446419; CLONE 9221; ANNOT 1535229; ANNOT 1535229; CLONE 9683; ANNOT 1471514; ANNOT 1471514; ANNOT 1445849; ANNOT 1445849; ANNOT 1500561; ANNOT 1500561; ANNOT 1464458; ANNOT 1464458; CLONE 10879; ANNOT 1467184; ANNOT 1467184; CLONE 12272; ANNOT 1506387; ANNOT 1506387; ANNOT 1474522; ANNOT 1474522; CLONE 12993; ANNOT 1479464; ANNOT 1479464; CLONE 13741; ANNOT 1462963; ANNOT 1462963; ANNOT 1459563; ANNOT 1459563; CLONE 17434; ANNOT 1455741; ANNOT 1455741; ANNOT 1477832; ANNOT 1477832; CLONE 17632; ANNOT 1474847; ANNOT 1474847; ANNOT 1507835; ANNOT 1507835; CLONE 17912; ANNOT 1514378; ANNOT 1514378; ANNOT 1494118; ANNOT 1494118; CLONE 19116; ANNOT 1467522; ANNOT 1467522; ANNOT 1526421; ANNOT 1526421; CLONE 19486; ANNOT 1452204; ANNOT 1452204; ANNOT 1443204; ANNOT 1443204; ANNOT 1490383; ANNOT 1490383; ANNOT 19510; ANNOT 1501412; ANNOT 1501412; ANNOT 1490383; ANNOT 1490383; ANNOT 1448419; ANNOT 1448419; CLONE 19586; ANNOT 1476446; ANNOT 1476446; ANNOT 1451126; ANNOT 1451126; CLONE 23523; ANNOT 1453919; ANNOT 1453919; CLONE 28602; ANNOT 1461728; ANNOT 1461728; ANNOT 1488330; ANNOT 1488330; ANNOT 1460480; ANNOT 1460480; ANNOT 1461614; ANNOT 1461614; ANNOT 1479711; ANNOT 1479711; ANNOT 1479712; ANNOT 1479712; ANNOT 1460481; ANNOT 1460481; ANNOT 1461613; ANNOT 1461613; ANNOT 1488329; ANNOT 1488329; ANNOT 1458198; ANNOT 1458198; ANNOT 1488327; ANNOT 1488327; ANNOT 1488327; CLONE 31507; ANNOT 1447204; ANNOT 1447204; CLONE 32348; ANNOT 1470719; ANNOT 1470719; ANNOT 1543728; ANNOT 1543728; ANNOT 1451171; ANNOT 1451171; ANNOT 1482066; ANNOT 1482066; CLONE 32751; ANNOT 1540248; ANNOT 1540248; CLONE 34385; ANNOT 1445331; ANNOT 1445331; ANNOT 1498316; ANNOT 1498316; CLONE 34783; ANNOT 1466952; ANNOT 1466952; ANNOT 1523551; ANNOT 1523551; ANNOT 1455815; ANNOT 1455817; ANNOT 1470164; ANNOT 1470164; CLONE 34976; ANNOT 1507231; ANNOT 1507231; CLONE 35051; ANNOT 1443033; ANNOT 1443033; ANNOT 1452408; ANNOT 1452408; ANNOT 1452408; ANNOT 1505508; ANNOT 1505508; CLONE 36334; ANNOT 1464715; ANNOT 1464715; ANNOT 1511511; ANNOT 1511511; CLONE 36904; ANNOT 1526083; ANNOT 1526083; ANNOT 1498856; ANNOT 1498856; ANNOT 1445872; ANNOT 1445872; ANNOT 1472663; ANNOT 1472663; CLONE 37658; ANNOT 1497485; ANNOT 1497485; ANNOT 1525183; ANNOT 1525183; CLONE 38690; ANNOT 1481678; CLONE 40824; ANNOT 40729; ANNOT 1481678; ANNOT 1535964; ANNOT 1535964; ANNOT 1509015; ANNOT 1509015; ANNOT 1535962; ANNOT 1535962; ANNOT 1455815; ANNOT 1455815; ANNOT 1455817; ANNOT 1455817; ANNOT 1535817; ANNOT 1482502; ANNOT 1482502; ANNOT 1509035; ANNOT 1509035; 1455817; ANNOT 1482477; ANNOT 1482477; ANNOT 1509013; ANNOT 1509013; ANNOT 1455837; CLONE 41439; ANNOT 1535990; ANNOT 1535990; ANNOT 1455837; ANNOT 1455837; | 69; 70; 71; 72; 73; 74; 75; 121; 122; 123; 129; 130; 131; 132; 133; 134; 135; 136; 137; 138; 139; 145; 146; 147; 175; 176; 177; 268; 269; 270; 271; 272; 273; 274; 357; 358; 359; 360; 361; 362; 363; 364; 365; 366; 367; 368; 394; 395; 396; 402; 403; 404; 405; 406; 407; 408; 409; 410; 411; 437; 438; 439; 515; 516; 517; 518; 519; 520; 521; 522; 550; 551; 552; 553; 554; 687; 688; 689; 690; 691; 695; 696; 697; 698; 699; 705; 706; 707; 708; 709; 735; 736; 737; 738; 739; 767; 768; 769; 770; 771; 772; 773; 774; 775; 776; 777; 778; 784; 785; 786; 787; 788; 914; 915; 916; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1195; 1196; 1197; 1219; 1220; 1221; 1222; 1223; 1224; 1225; 1247; 1248; 1249; 1255; 1256; 1257; 1364; 1365; 1366; 1367; 1368; 1423; 1424; 1425; 1426; 1427; 1428; 1429; 1435; 1436; 1437; 1441; 1442; 1443; 1444; 1445; 1446; 1447; 1500; 1501; 1502; 1503; 1504; 1585; 1586; 1587; 1588; 1589; 1590; 1591; 1592; 1593; 1654; 1655; 1656; 1774; 1775; 1776; 1930; 1931; 1932; 1939; 1940; 1941; 1942; 1943; 1944; 1945; 1946; 1947; 1948; 1949; 1950; 1951; 1952; 1953; 1954; 1955; 1956; 1957; 1958; 1959; 1960; 1961; 1998; |

TABLE 1-continued

| Tissue | Phenotype Category | Phenotype | Phenotype Description | Applications | Ceres ID | SEQ ID NO |
|---|---|---|---|---|---|---|
| | | | | | CLONE 42141; ANNOT 1473839; CLONE 42925; ANNOT 1462354; ANNOT 1462354; CLONE 95135; ANNOT 1527449; ANNOT 1527449; ANNOT 1537653; ANNOT 1537653; ANNOT 1473733; ANNOT 1473733; ANNOT 1468537; ANNOT 1468537; CLONE 96020; ANNOT 1450365; ANNOT 1450365; ANNOT 1460794; ANNOT 1460794; CLONE 98855; ANNOT 160836; ANNOT 160836; ANNOT 1450324; ANNOT 1450324; CLONE 100047; ANNOT 1532164; ANNOT 1532164; ANNOT 1479341; ANNOT 1479341; ANNOT 1479350; ANNOT 1479350; ANNOT 1442450; CLONE 102248; ANNOT 1456981; ANNOT 1456981; CLONE 103581; ANNOT 1486398; ANNOT 1486398; ANNOT 1496840; CLONE 109912; ANNOT 1451138; ANNOT 1451138; ANNOT 1456780; ANNOT 1456780; CLONE 110454; CLONE 113719; ANNOT 1513206; ANNOT 1513206; ANNOT 1516003; ANNOT 1462703; ANNOT 1462703; CLONE 114602; ANNOT 1450785; ANNOT 1450785; ANNOT 1456283; ANNOT 1456283; ANNOT 1460638; ANNOT 1513900; ANNOT 1513900; ANNOT 1540271; ANNOT 1540271; CLONE 115946; ANNOT 1458342; ANNOT 1458342; CLONE 116257; ANNOT 1520806; ANNOT 1520806; ANNOT 1473089; ANNOT 1473089; ANNOT 1500150; CLONE 117895; ANNOT 1448592; ANNOT 1448592; ANNOT 1448594; ANNOT 1448594; CLONE 118337; ANNOT 1454773; ANNOT 1454773; ANNOT 1511811; ANNOT 1511811; ANNOT 1478364; ANNOT 1464394; ANNOT 1464394; CLONE 122353; ANNOT 1472265; ANNOT 1472265; CLONE 147358; ANNOT 1493111; ANNOT 1493111; ANNOT 1461452; CLONE 157547; ANNOT 1473898; ANNOT 1473898; CLONE 157709; ANNOT 1515067; ANNOT 1515067; ANNOT 1492780; ANNOT 1492780; CLONE 158333; ANNOT 1466505; ANNOT 1466505; ANNOT 1449026; ANNOT 1449026; CLONE 235706; ANNOT 1462351; ANNOT 1462351; ANNOT 1469462; ANNOT 1469462; ANNOT 1488821; ANNOT 1488821; CLONE 46203; ANNOT 1511505; ANNOT 1511505; CLONE 536796; ANNOT 1484779; ANNOT 1484779; ANNOT 1538185; ANNOT 1538185; ANNOT 1455109; ANNOT 1455109; ANNOT 1477384; ANNOT 1477384; CLONE 541719; ANNOT 1518918; ANNOT 1518918; ANNOT 1535677; ANNOT 1535677; CLONE 641355; ANNOT 1463334; ANNOT 1463334; ANNOT 1463335; ANNOT 1463335; ANNOT 1463334; ANNOT 1452665; ANNOT 1452665; CLONE 708342; ANNOT 1538185; ANNOT 1538185; CLONE 1001432; ANNOT 1475043; ANNOT 1475043; ANNOT 1454586; ANNOT 1454586; ANNOT 1507756; ANNOT 1507756; ANNOT 1469708; ANNOT 1469708; CLONE 1006934; ANNOT 1532963; ANNOT 1532963; CLONE 1029167; ANNOT 1453409; ANNOT 1453409; ANNOT 1474630; ANNOT 1474630; ANNOT 1450948; ANNOT 1450948; CDNA 2351870S; ANNOT 1463957; ANNOT 1463957; ANNOT 1458961; ANNOT 1458961; CDNA 23545147; ANNOT 1443044; ANNOT 1443044; CDNA 36507011; ANNOT 1442604; ANNOT 1442604; ANNOT 1442612; ANNOT 1442612; ANNOT 1442608; ANNOT 1442608; ANNOT 1452827; ANNOT 1452827; CDNA 36507407; ANNOT 1457193; ANNOT 1457193; ANNOT 1457794; ANNOT 1487854; ANNOT 1487854; CDNA 36508177; CDNA 36512904; ANNOT 1471370; ANNOT 1471370; ANNOT 1444471; ANNOT 1444471; ANNOT 1491278; ANNOT 1491278; ANNOT 1447690; ANNOT 1447690; CDNA 36534269; CDNA 36535618; ANNOT 1457794; ANNOT 1457794; ANNOT 1524172; CDNA 36536865; ANNOT 1459998; ANNOT 1459998; ANNOT 1513263; ANNOT 1513263; CDNA 36536865; ANNOT 1505326; ANNOT 1505326; ANNOT 1496106; ANNOT 1496106; CDNA 36539960; ANNOT 1448952; ANNOT 1448952; CDNA 36542397; ANNOT 1497958; ANNOT 149795S; ANNOT 1471743; ANNOT 1471743; ANNOT 1458313; ANNOT 1458313; CDNA 36560856; ANNOT 1517998; ANNOT 1517998; ANNOT 1458313; ANNOT 1458313; CDNA 36566773; | 2015; 2016; 2017; 2045; 2046; 2047; 2076; 2077; 2078; 2079; 2080; 2081; 2082; 2083; 2084; 2095; 2096; 2097; 2098; 2099; 2118; 2119; 2120; 2121; 2122; 2173; 2174; 2175; 2176; 2177; 2178; 2179; 2180; 2181; 2229; 2230; 2231; 2232; 2233; 2234; 2235; 2236; 2303; 2304; 2305; 2306; 2307; 2313; 2333; 2334; 2335; 2336; 2337; 2338; 2339; 2350; 2351; 2352; 2353; 2354; 2355; 2356; 2357; 2358; 2359; 2360; 2370; 2371; 2372; 2394; 2395; 2396; 2397; 2398; 2399; 2400; 2412; 2413; 2414; 2415; 2416; 2417; 2418; 2419; 2420; 2421; 2422; 2423; 2424; 2425; 2481; 2482; 2483; 2528; 2529; 2530; 2531; 2532; 2593; 2594; 2595; 2596; 2597; 2598; 2599; 2600; 2611; 2612; 2613; 2614; 2615; 2705; 2706; 2707; 2708; 2709; 2710; 2711; 3003; 3004; 3005; 3154; 3155; 3156; 3157; 3158; 3159; 3160; 3161; 3162; 3173; 3174; 3175; 3176; 3177; 3304; 3305; 3306; 3307; 3308; 3309; 3310; 3361; 3362; 3363; 3419; 3420; 3421; 3422; 3423; 3424; 3425; 3426; 3427; 3437; 3438; 3439; 3474; 3475; 3476; 3477; 3478; 3479; 3480; 3748; 3749; 3750; 3751; 3752; 3813; 3814; 3815; 3875; 3876; 3877; 3878; 3879; 3880; 3881; 3882; 3883; 3884; 3885; 3886; 3887; 3888; 3889; 3896; 3897; 3898; 3899; 3900; 3901; 3902; 3903; 3904; 3938; 3939; 3940; 3941; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1464046; ANNOT 1464046; ANNOT 1458861; ANNOT 1463445; ANNOT 1463445; ANNOT 1512677; CDNA 3656910S; ANNOT 1459412; ANNOT 1459412; CDNA 3672659; ANNOT 1512677; ANNOT 1455805; ANNOT 1455211; ANNOT 1529744; CDNA 3697835; ANNOT 1455805; ANNOT 1461440; ANNOT 1461440; ANNOT 1461427; ANNOT 1461427; ANNOT 1461430; ANNOT 1461430; ANNOT 1440253; ANNOT 1440253; | 3942; 3951; 3952; 3953; 3954; 3955; 3961; 3962; 3963; 3964; 3965; 3966; 3967; 3968; 3969; 3970; 3971; 3972; 3973; 4008; 4009; 4010; 4011; 4012; 4018; 4019; 4020; 4021; 4022; 4036; 4037; 4038; 4039; 4040; 4041; 4042; 4048; 4049; 4050; 4051; 4052; 4073; 4074; 4075; 4076; 4077; 4078; 4079; 4080; 4081; |
| ROSETTE LEAVES | Appearance | Ovate Shaped | The leaves are wider at base than at apex, otherwise similar to wild-type | Useful for making ornamental plants with altered leaf shape | CLONE 9897; ANNOT 1445849; ANNOT 1500561; ANNOT 1445849; ANNOT 1445849; ANNOT 1500561; ANNOT 1455211; ANNOT 1464458; CLONE 13625; ANNOT 1455211; ANNOT 1455211; ANNOT 18612; ANNOT 1522299; ANNOT 1527718; ANNOT 1527718; CLONE 24885; ANNOT 1485102; CLONE 32361; ANNOT 1471776; ANNOT 1445033; ANNOT 1445033; CLONE 34385; ANNOT 1445331; ANNOT 1498316; ANNOT 1498316; CLONE 42925; ANNOT 1462354; ANNOT 1462354; | 405; 406; 407; 408; 409; 410; 411; 544; 545; 546; 720; 721; 722; 723; 724; 949; 950; 951; 1226; 1227; 1228; 1229; 1230; 1364; 1365; 1366; 1367; 1368; 2045; 2046; 2047; |
| ROSETTE LEAVES | Appearance | Serrate Margins | The leaf margins are serrated. | Useful for making ornamental plants with altered leaf shape | CLONE 907; ANNOT 1502138; ANNOT 1449135; ANNOT 1449135; ANNOT 1502138; ANNOT 1449135; CLONE 1496; ANNOT 1490668; ANNOT 1474027; ANNOT 1474027; ANNOT 1497865; ANNOT 1471512; ANNOT 1471512; ANNOT 1443061; ANNOT 1504203; ANNOT 1505468; ANNOT 1505468; ANNOT 1452369; CLONE 3036; ANNOT 1456840; CLONE 5167; ANNOT 1465422; ANNOT 1465422; ANNOT 1457750; ANNOT 1513544; ANNOT 1513544; CLONE 5198; ANNOT 1472153; CLONE 6220; ANNOT 1488463; ANNOT 1488463; ANNOT 1472153; ANNOT 1541879; ANNOT 1499398; ANNOT 1446419; ANNOT 1438919; ANNOT 1438919; CLONE 8877; ANNOT 1507340; ANNOT 1507340; ANNOT 1446419; CLONE 8265; ANNOT 1529361; ANNOT 1529361; CLONE 9221; ANNOT 1535229; ANNOT 1535229; CLONE 9683; ANNOT 1471514; ANNOT 1471514; CLONE 9897; ANNOT 1445849; ANNOT 1445849; ANNOT 1500561; ANNOT 1464458; ANNOT 1464458; CLONE 10879; ANNOT 1467184; CLONE 12272; ANNOT 1506387; ANNOT 1506387; ANNOT 1474522; ANNOT 1474522; CLONE 13625; ANNOT 1455211; ANNOT 1455211; ANNOT 13757; ANNOT 1471425; ANNOT 1471425; CLONE 17761; ANNOT 1481206; ANNOT 1481206; ANNOT 1534689; ANNOT 1534689; CLONE 19481; ANNOT 1475146; ANNOT 1475146; ANNOT 1454933; ANNOT 1454933; CLONE 19486; ANNOT 1452204; ANNOT 1452204; ANNOT 1443204; ANNOT 1443204; CLONE 23518; ANNOT 1475658; ANNOT 1475658; ANNOT 1449267; ANNOT 1449267; ANNOT 1457346; ANNOT 1457346; ANNOT 1541170; ANNOT 1507191; CLONE 25172; ANNOT 1457346; ANNOT 1450220; ANNOT 1450220; CLONE 25796; ANNOT 1541170; CLONE 25607; ANNOT 1522583; ANNOT 1475323; ANNOT 1475323; CLONE 26542; ANNOT 1475323; ANNOT 1475323; CLONE 26825; ANNOT 1538272; ANNOT 1538272; CLONE 26907; ANNOT 1513438; ANNOT 1460167; ANNOT 1460167; CLONE 26907; ANNOT 1518242; ANNOT 1484074; ANNOT 1484074; ANNOT 1440016; ANNOT 1518242; ANNOT 1484207; ANNOT 1484207; ANNOT 1527449; ANNOT 1527449; ANNOT 1484207; ANNOT 1484207; ANNOT 1488207; CLONE 32348; ANNOT 1470719; ANNOT 1470719; ANNOT 1488207; | 30; 31; 32; 33; 34; 50; 51; 52; 53; 54; 55; 56; 57; 58; 59; 60; 61; 62; 63; 64; 65; 66; 121; 122; 123; 223; 224; 225; 226; 227; 228; 229; 230; 231; 232; 275; 276; 277; 278; 279; 362; 363; 364; 365; 366; 367; 368; 383; 384; 385; 386; 387; 394; 395; 396; 402; 403; 404; 405; 406; 407; 408; 409; 410; 411; 437; 438; 439; 515; 516; 517; 518; 519; 544; 545; 546; 564; 565; 566; 700; 701; 702; 703; 704; 762; 763; 764; 765; 766; 767; 768; 769; 770; 771; 907; 908; 909; 910; 911; 912; 913; 952; 953; 954; 955; 956; 970; 971; 972; 983; 984; 985; 1010; 1011; 1012; 1013; 1014; 1030; 1031; 1032; 1033; 1034; 1043; 1044; 1045; 1046; 1047; 1048; 1049; 1185; 1186; 1187; 1188; 1189; 1219; 1220; 1221; 1222; 1223; 1224; 1225; 1231; 1232; 1233; 1234; |

TABLE 1-continued

| Tissue | Phenotype Category | Phenotype | Phenotype Description | Applications | Ceres ID | SEQ ID NO |
|---|---|---|---|---|---|---|
| | | | | | 1470719; ANNOT 1543728; ANNOT 1482066; ANNOT 1482066; CLONE 32548; ANNOT 1450324; ANNOT 1460836; ANNOT 1460836; CLONE 32737; CLONE 33232; ANNOT 1536373; ANNOT 1482905; ANNOT 1482905; CLONE 33232; CLONE 34385; ANNOT 1504045; ANNOT 1450983; ANNOT 1450983; CLONE 34385; ANNOT 1445331; ANNOT 1445331; ANNOT 1498316; ANNOT 1498316; CLONE 34552; ANNOT 1516449; ANNOT 1516449; ANNOT 1512976; CLONE 34612; ANNOT 1479009; ANNOT 1479009; ANNOT 1469640; CLONE 3478; ANNOT 1466952; ANNOT 1466952; ANNOT 1523551; ANNOT 1523551; ANNOT 1470164; ANNOT 1470164; CLONE 35493; ANNOT 1457751; ANNOT 1457751; ANNOT 1518757; ANNOT 1518757; ANNOT 1465420; ANNOT 1465420; CLONE 36518; ANNOT 1471507; ANNOT 1471507; ANNOT 1444893; ANNOT 1444893; ANNOT 1458642; ANNOT 1458642; ANNOT 1522497; ANNOT 1522497; ANNOT 1469105; ANNOT 1469105; ANNOT 1484993; ANNOT 1484993; CLONE 36904; ANNOT 1526083; ANNOT 1526083; ANNOT 1498856; ANNOT 1498856; ANNOT 1445872; ANNOT 1445872; ANNOT 1479009; ANNOT 1472663; ANNOT 1472663; CLONE 37288; ANNOT 1453650; ANNOT 1453650; CLONE 37493; ANNOT 1494370; ANNOT 1494370; ANNOT 1441478; ANNOT 1441478; CLONE 37543; ANNOT 1539972; ANNOT 1539972; ANNOT 1486562; ANNOT 1486562; ANNOT 1496735; ANNOT 1496735; ANNOT 1443794; ANNOT 1443794; ANNOT 1443794; ANNOT 1440727; ANNOT 1440727; CLONE 38419; ANNOT 1542971; ANNOT 1542971; ANNOT 1521332; ANNOT 1521332; ANNOT 1467961; ANNOT 1467961; CLONE 38690; ANNOT 1525183; ANNOT 1525183; CLONE 38843; ANNOT 1447896; ANNOT 1447896; ANNOT 1438197; ANNOT 1438197; ANNOT 1439286; ANNOT 1447961; ANNOT 1447961; ANNOT 1490936; ANNOT 1490936; CLONE 39740; ANNOT 1483180; ANNOT 1483180; ANNOT 1483180; ANNOT 1480950; ANNOT 1480950; CLONE 40729; ANNOT 1481678; ANNOT 1481678; CLONE 40766; ANNOT 1450499; ANNOT 1450499; CLONE 42925; ANNOT 1462354; ANNOT 1462354; CLONE 42955; ANNOT 1505155; ANNOT 1505155; CLONE 92670; ANNOT 1531919; ANNOT 1531919; CLONE 95677; ANNOT 1459723; ANNOT 1459723; ANNOT 1516455; ANNOT 1516455; CLONE 96020; ANNOT 1450365; ANNOT 1450365; ANNOT 1460794; ANNOT 1460794; CLONE 97434; CLONE 97415; ANNOT 1481701; ANNOT 1481701; CLONE 97434; ANNOT 1488311; ANNOT 1488311; ANNOT 1518776; CLONE 98855; ANNOT 1460836; ANNOT 1460836; ANNOT 1450324; ANNOT 1450324; CLONE 104929; ANNOT 1449020; CLONE 117369; ANNOT 1499284; ANNOT 1499284; ANNOT 1481671; ANNOT 1481671; CLONE 119256; ANNOT 1469636; ANNOT 1469636; ANNOT 1479002; ANNOT 1479002; CLONE 141830; ANNOT 1488335; ANNOT 1488335; CLONE 147358; ANNOT 1493111; ANNOT 1493111; ANNOT 1461452; CLONE 147593; ANNOT 1475653; ANNOT 1475653; ANNOT 1458131; ANNOT 1458131; ANNOT 1461780; CLONE 148943; ANNOT 1472949; ANNOT 1472949; CLONE 151087; ANNOT 1504145; ANNOT 1504145; ANNOT 1451079; ANNOT 1451079; CLONE 157547; ANNOT 1473898; ANNOT 1473898; ANNOT 1466505; ANNOT 1466505; ANNOT 1449026; CLONE 158333; ANNOT 225200; ANNOT 1471976; ANNOT 1471976; ANNOT 1465507; ANNOT 1465507; CLONE 267626; ANNOT 1484074; ANNOT 1484074; ANNOT 1518242; ANNOT 1518242; ANNOT 1464923; ANNOT 1464923; ANNOT 1456223; CLONE 382267; ANNOT 1456223; ANNOT 1453458; ANNOT 1453458; ANNOT 1467304; CLONE 534397; ANNOT 1489056; ANNOT 1489056; ANNOT 1442794; ANNOT 1442794; ANNOT 1442797; ANNOT 1495713; ANNOT 1495713; ANNOT 1442797; ANNOT | 1235; 1242; 1243; 1244; 1245; 1246; 1263; 1264; 1265; 1266; 1267; 1364; 1365; 1366; 1367; 1368; 1406; 1407; 1408; 1409; 1410; 1411; 1412; 1413; 1414; 1415; 1423; 1424; 1425; 1426; 1427; 1428; 1429; 1460; 1461; 1462; 1463; 1464; 1465; 1466; 1505; 1506; 1507; 1508; 1509; 1510; 1511; 1512; 1513; 1514; 1515; 1516; 1517; 1585; 1586; 1587; 1588; 1589; 1590; 1591; 1592; 1593; 1622; 1623; 1624; 1637; 1638; 1639; 1640; 1641; 1642; 1643; 1644; 1645; 1646; 1647; 1648; 1649; 1650; 1651; 1652; 1653; 1747; 1748; 1749; 1750; 1751; 1752; 1753; 1774; 1775; 1776; 1801; 1802; 1803; 1804; 1805; 1838; 1839; 1840; 1841; 1842; 1877; 1878; 1879; 1880; 1881; 1930; 1931; 1932; 1933; 1934; 1935; 2045; 2046; 2047; 2048; 2049; 2050; 2061; 2062; 2063; 2090; 2091; 2092; 2093; 2094; 2095; 2096; 2097; 2098; 2099; 2100; 2101; 2102; 2103; 2104; 2105; 2106; 2107; 2118; 2119; 2120; 2121; 2122; 2237; 2238; 2239; 2407; 2408; 2409; 2410; 2411; 2451; 2452; 2453; 2454; 2455; 2520; 2521; 2522; 2528; 2529; 2530; 2531; 2532; 2533; 2534; 2535; 2536; 2537; 2538; 2539; 2543; 2544; 2545; 2560; 2561; 2562; 2563; 2564; 2593; 2594; 2595; 2611; 2612; 2613; 2614; 2615; 2655; 2656; 2657; 2658; 2659; 2794; 2795; 2796; 2797; 2798; 2799; |

TABLE 1-continued

| Tissue | Phenotype Category | Phenotype | Phenotype Description | Applications | Ceres ID | SEQ ID NO |
|---|---|---|---|---|---|---|
| | | | | | 1442797; ANNOT 1468612; ANNOT 1460503; ANNOT 1460503; ANNOT 1488307; ANNOT 1440343; ANNOT 1493212; ANNOT 1493212; CLONE 536726; ANNOT 1498226; ANNOT 1445243; ANNOT 1445243; ANNOT 1525386; ANNOT 1448522; ANNOT 1448522; ANNOT 1465506; ANNOT 1497017; ANNOT 1497017; ANNOT 1447240; ANNOT 1539566; ANNOT 1539566; ANNOT 1444070; CLONE 536796; ANNOT 1484779; ANNOT 1484779; ANNOT 1538185; ANNOT 1455109; ANNOT 1455109; ANNOT 1477384; CLONE 563522; ANNOT 1460321; ANNOT 1460321; ANNOT 1508144; ANNOT 1541886; ANNOT 1541886; ANNOT 1475178; CLONE 664365; ANNOT 1463333; ANNOT 1463333; ANNOT 1505772; ANNOT 1478872; ANNOT 1478872; ANNOT 1442758; ANNOT 1495675; ANNOT 1469576; ANNOT 1452666; ANNOT 1452668; ANNOT 1442757; CLONE 1002819; ANNOT 1461728; ANNOT 1522314; ANNOT 1474290; ANNOT 1474290; ANNOT 1471045; ANNOT 1497147; ANNOT 1497147; CLONE 1006934; ANNOT 1532963; CLONE 1007549; ANNOT 1458198; ANNOT 1458198; ANNOT 1439989; ANNOT 1464789; ANNOT 1461728; ANNOT 1461728; ANNOT 1479711; ANNOT 1440649; ANNOT 1464547; ANNOT 1454104; ANNOT 1454104; ANNOT 1460973; CDNA 23494371; ANNOT 1485236; ANNOT 1485236; ANNOT 1446740; CDNA 23495481; ANNOT 1485271; ANNOT 1485271; ANNOT 1447245; ANNOT 1447245; CDNA 23498145; ANNOT 1482362; ANNOT 1489077; ANNOT 1489077; CDNA 36534269; ANNOT 1457794; ANNOT 1524172; ANNOT 1524172; ANNOT 1465208; ANNOT 1465208; CDNA 36566404; ANNOT 1465208; ANNOT 1465207; ANNOT 1465207; CDNA 36575796; ANNOT 1486224; ANNOT 1486224; ANNOT 1444021; ANNOT 1444021; | 2800; 2986; 2987; 2988; 2989; 2990; 3109; 3110; 3111; 3112; 3113; 3114; 3115; 3116; 3117; 3118; 3119; 3120; 3121; 3122; 3123; 3124; 3125; 3126; 3127; 3128; 3129; 3135; 3136; 3137; 3138; 3139; 3140; 3141; 3142; 3143; 3144; 3145; 3146; 3147; 3148; 3149; 3150; 3151; 3152; 3153; 3154; 3155; 3156; 3157; 3158; 3159; 3160; 3161; 3162; 3227; 3228; 3229; 3230; 3231; 3232; 3233; 3234; 3235; 3319; 3320; 3321; 3322; 3323; 3324; 3325; 3326; 3327; 3328; 3329; 3330; 3331; 3332; 3333; 3334; 3335; 3336; 3337; 3428; 3429; 3430; 3431; 3432; 3433; 3434; 3435; 3436; 3437; 3438; 3439; 3440; 3441; 3442; 3443; 3444; 3445; 3446; 3447; 3448; 3449; 3450; 3451; 3452; 3453; 3454; 3455; 3456; 3613; 3614; 3615; 3616; 3617; 3618; 3619; 3620; 3622; 3623; 3624; 3625; 3626; 3641; 3642; 3643; 3644; 3645; 3938; 3939; 3940; 3941; 3942; 4013; 4014; 4015; 4016; 4017; 4053; 4054; 4055; 4056; 4057; |
| FLOWER | Appearance | Short Sepals | The sepals are abnormally short. | Useful for making ornamental plants with modified flowers | CLONE 32791; ANNOT 1540248; ANNOT 1540248; | 1255; 1256; 1257; |
| FLOWER | Appearance | Small | The flowers are abnormally small. | Useful for making ornamental plants with modified flowers | CLONE 3000; ANNOT 1518918; ANNOT 1535677; ANNOT 1535677; ANNOT 1482181; ANNOT 1482181; CLONE 13757; ANNOT 1471425; ANNOT 1471425; CLONE 32791; ANNOT 1540248; ANNOT 1540248; | 111; 112; 113; 114; 115; 116; 117; 564; 565; 566; 1255; 1256; 1257; |
| ROSETTE | Appearance | Trident Shaped | The leaves have | Useful for | CLONE 3000; ANNOT 1518918; ANNOT 1535677; ANNOT | 111; 112; 113; 114; 115; |

TABLE 1-continued

| Tissue | Phenotype Category | Phenotype | Phenotype Description | Applications | Ceres ID | SEQ ID NO |
|---|---|---|---|---|---|---|
| LEAVES | | | a sharp point at the apex, and a sharp point on each side. | making ornamental plants with altered leaf shape | 1535677; ANNOT 1482181; ANNOT 1471514; CLONE 9683; ANNOT 1471514; ANNOT 1471514; CLONE 42925; ANNOT 1462354; ANNOT 1462354; CLONE 147358; ANNOT 1493111; ANNOT 1493111; ANNOT 1461452; ANNOT 1461452; CDNA 2349548l; ANNOT 1485271; ANNOT 1485271; ANNOT 1447245; ANNOT 1447245; | 116; 117; 402; 403; 404; 2045; 2046; 2047; 2528; 2529; 2530; 2531; 2532; 3622; 3623; 3624; 3625; 3626; |
| INFLORESCENCE | Appearance | Undulate Appearance | The inflorescence is wavy in appearance compared to control. | Useful for making ornamental plants with modified flowers | CLONE 38690; ANNOT 1525183; ANNOT 1525183; | 1774; 1775; 1776; |
| ROSETTE LEAVES | Appearance | Undulate Shaped | The leaves are wavy in appearance compared to wild-type plants. | Useful for making ornamental plants with altered leaf shape | CLONE 3000; ANNOT 1518918; ANNOT 1535677; ANNOT 1535677; ANNOT 1482181; ANNOT 1518918; ANNOT 1482181; CLONE 36904; ANNOT 1526083; ANNOT 1526083; ANNOT 1498856; ANNOT 1445872; ANNOT 1445872; ANNOT 1472663; ANNOT 1472663; CLONE 38690; ANNOT 1525183; ANNOT 1525183; ANNOT 158333; CLONE 1466505; ANNOT 1449026; ANNOT 1449026; CLONE 541719; ANNOT 1518918; ANNOT 1535677; ANNOT 1535677; CDNA 2349371; ANNOT 1485236; ANNOT 1485236; ANNOT 1446740; ANNOT 1446740; ANNOT 1446740; CDNA 3657011; ANNOT 1442604; ANNOT 1442604; ANNOT 1442604; ANNOT 1442612; ANNOT 1442608; ANNOT 1442608; ANNOT 1452827; ANNOT 1452827; CDNA 3639960; ANNOT 1448952; ANNOT 1448952; CDNA 36566404; ANNOT 1465208; ANNOT 1465208; ANNOT 1465207; ANNOT 1465207; | 111; 112; 113; 114; 115; 116; 117; 1585; 1586; 1587; 1588; 1589; 1590; 1591; 1592; 1593; 1774; 1775; 1776; 2611; 2612; 2613; 2614; 2615; 3173; 3174; 3175; 3176; 3177; 3616; 3617; 3618; 3619; 3620; 3875; 3876; 3877; 3878; 3879; 3880; 3881; 3882; 3883; 3966; 3967; 3968; 4013; 4014; 4015; 4016; 4017; |
| WHOLE PLANT | Biomass | Bushy Rosette Shaped | The petioles have very varied liminal angles, giving the plant a very bushy appearance. The rosette leaves often do not appear in the normal fashion, i.e., their phyllotaxy may be abnormal or too many leaves may be emerging in comparison to the control. | Useful for making plants with increased biomass and foliage | CLONE 13757; ANNOT 1471425; CLONE 13800; ANNOT 1458335; ANNOT 1458335; ANNOT 1464663; CLONE 40766; ANNOT 1450499; ANNOT 1450499; | 564; 565; 566; 572; 573; 574; 575; 576; 1933; 1934; 1935; |
| ROSETTE LEAVES | Biomass | Disorganized Rosette | The rosette leaves do not appear in the normal fashion, i.e., their phyllotaxy may be abnormal or too many leaves | Useful for making plants with increased biomass | CLONE 332; ANNOT 1474923; CLONE 1496; ANNOT 1474923; CLONE 1496; ANNOT 1490668; ANNOT 1490668; ANNOT 1474027; ANNOT 1474027; ANNOT 1497865; ANNOT 1497865; ANNOT 1471512; ANNOT 1443061; ANNOT 1443061; ANNOT 1504203; ANNOT 1504203; ANNOT 1505468; ANNOT 1505468; ANNOT 1452369; CLONE 3000; ANNOT 1518918; ANNOT 1518918; ANNOT 1452369; ANNOT 1535677; ANNOT 1482181; ANNOT 1482181; CLONE 3858; ANNOT 1459068; CLONE 11214; ANNOT 1501485; ANNOT 1501485; ANNOT 1490496; ANNOT 1490496; ANNOT 1448498; ANNOT | 12; 13; 14; 50; 51; 52; 53; 54; 55; 56; 57; 58; 59; 60; 61; 62; 63; 64; 65; 66; 111; 112; 113; 114; 115; 116; 117; 175; 176; 177; 448; 449; 450; 451; 452; 453; 454; 455; 456; 515; 516; 517; 518; |

TABLE 1-continued

| Tissue | Phenotype Category | Phenotype | Phenotype Description | Applications | Ceres ID | SEQ ID NO |
|---|---|---|---|---|---|---|
| | | | may be emerging in comparison to the control. | | 1448498; ANNOT 1474848; ANNOT 1474848; CLONE 12272; ANNOT 1506387; ANNOT 1506387; ANNOT 1474522; ANNOT 1474522; CLONE 13186; ANNOT 1464566; ANNOT 1464566; ANNOT 1458408; CLONE 13757; ANNOT 1471425; ANNOT 1471425; CLONE 13800; ANNOT 1458335; ANNOT 1458335; ANNOT 1464663; ANNOT 1464663; CLONE 14555; ANNOT 1511392; ANNOT 1511392; ANNOT 1469356; ANNOT 1469356; ANNOT 1517500; ANNOT 1517500; ANNOT 1458151; ANNOT 1458151; ANNOT 1522757; ANNOT 1522757; CLONE 20760; ANNOT 1462351; ANNOT 1462351; ANNOT 1488821; ANNOT 1488821; ANNOT 1469462; ANNOT 1469462; CLONE 23771; ANNOT 1444030; ANNOT 1444030; ANNOT 1486813; ANNOT 1486813; ANNOT 1485303; ANNOT 1485303; ANNOT 1446796; ANNOT 1446796; CLONE 25538; ANNOT 1480776; ANNOT 1480776; ANNOT 1471372; ANNOT 1471372; CLONE 34552; ANNOT 1516449; ANNOT 1516449; ANNOT 1512976; ANNOT 1512976; CLONE 37019; ANNOT 1517849; ANNOT 1517849; ANNOT 1511684; ANNOT 1511684; ANNOT 1464532; ANNOT 1464532; ANNOT 1458439; ANNOT 1458439; ANNOT 1540674; ANNOT 1540674; ANNOT 37298; ANNOT 1476538; ANNOT 1476538; ANNOT 1493576; ANNOT 1493576; CLONE 37658; ANNOT 1497485; ANNOT 1497485; CLONE 37663; ANNOT 1447659; ANNOT 1447659; ANNOT 1438478; ANNOT 1438478; CLONE 38101; ANNOT 1454656; ANNOT 1454656; ANNOT 1528263; ANNOT 1528263; ANNOT 1458103; ANNOT 1458103; ANNOT 1464899; ANNOT 1464899; ANNOT 1482966; ANNOT 1482966; ANNOT 1441039; ANNOT 1441039; ANNOT 1520449; ANNOT 1520449; CLONE 38419; ANNOT 1542971; ANNOT 1542971; ANNOT 1521332; ANNOT 1521332; ANNOT 1467961; ANNOT 1467961; ANNOT 1447896; ANNOT 1447896; ANNOT 1438197; ANNOT 1438197; CLONE 39890; ANNOT 1511886; ANNOT 1511886; ANNOT 1517635; ANNOT 1517635; ANNOT 1441645; ANNOT 1441645; CLONE 40436; ANNOT 1441645; CLONE 40508; ANNOT 1453626; ANNOT 1453626; CLONE 40692; ANNOT 1455695; ANNOT 1455695; CLONE 42925; ANNOT 1462354; ANNOT 1462354; CLONE 95135; ANNOT 1527449; ANNOT 1527449; ANNOT 1537653; ANNOT 1537663; ANNOT 1473733; ANNOT 1473733; ANNOT 1468537; ANNOT 1468537; CLONE 115975; ANNOT 1507138; ANNOT 1507138; CLONE 117369; ANNOT 1499284; ANNOT 1499284; ANNOT 1481671; ANNOT 1481671; CLONE 124720; ANNOT 1441430; ANNOT 1441430; CLONE 157058; ANNOT 1528285; ANNOT 1528285; ANNOT 1454671; ANNOT 1454671; CLONE 157547; ANNOT 1473898; ANNOT 1473898; CLONE 158333; ANNOT 1466505; ANNOT 1466505; ANNOT 1449026; ANNOT 1449026; CLONE 227651; ANNOT 1474222; ANNOT 1474222; ANNOT 1468994; ANNOT 1468994; ANNOT 1497043; ANNOT 1497043; CLONE 241379; ANNOT 1526950; ANNOT 1526950; ANNOT 1508362; ANNOT 1508362; ANNOT 1477361; ANNOT 1477361; CLONE 262460; ANNOT 1530053; ANNOT 1530053; ANNOT 1493414; ANNOT 1493414; CLONE 283597; ANNOT 1482074; ANNOT 1482074; ANNOT 1453923; ANNOT 1453923; CLONE 292789; ANNOT 1442040; ANNOT 1442040; ANNOT 1482966; ANNOT 1482966; ANNOT 1464899; ANNOT 1454656; ANNOT 1454656; ANNOT 1458103; ANNOT 1458103; ANNOT 1464899; ANNOT 1520449; ANNOT 1520449; ANNOT 1474837; ANNOT 1474837; ANNOT 1520449; ANNOT 1463335; ANNOT 1538169; ANNOT 1538169; ANNOT 641355; ANNOT 1463335; ANNOT 1463335; ANNOT 1463334; ANNOT 1463334; ANNOT 1452665; ANNOT 1452665; CLONE 1007549; ANNOT 1458198; ANNOT 1458198; ANNOT 1439989; ANNOT 1439989; ANNOT 1464789; ANNOT 1464789; ANNOT 1461728; ANNOT 1461728; ANNOT 1479711; ANNOT 1440649; ANNOT 1440649; ANNOT 1464547; ANNOT 1464547; ANNOT 1454104; CLONE | 519; 531; 532; 533; 534; 535; 564; 565; 566; 572; 573; 574; 575; 576; 608; 609; 610; 611; 612; 613; 614; 615; 616; 617; 618; 808; 809; 810; 811; 812; 813; 814; 928; 929; 930; 931; 932; 933; 934; 935; 936; 967; 968; 969; 1239; 1240; 1241; 1406; 1407; 1408; 1409; 1410; 1599; 1600; 1601; 1602; 1603; 1604; 1605; 1606; 1607; 1608; 1609; 1625; 1626; 1627; 1628; 1629; 1654; 1655; 1656; 1657; 1658; 1659; 1660; 1661; 1682; 1683; 1684; 1685; 1686; 1687; 1688; 1689; 1690; 1691; 1692; 1693; 1694; 1695; 1696; 1747; 1748; 1749; 1750; 1751; 1752; 1753; 1801; 1802; 1803; 1804; 1881; 1882; 1883; 1884; 1885; 1886; 1904; 1905; 1906; 1912; 1913; 1914; 1918; 1919; 1920; 2045; 2046; 2047; 2076; 2077; 2078; 2079; 2080; 2081; 2082; 2083; 2084; 2373; 2374; 2375; 2407; 2408; 2409; 2410; 2411; 2501; 2502; 2503; 2588; 2589; 2590; 2591; 2592; 2593; 2594; 2595; 2611; 2612; 2613; 2614; 2615; 2683; 2684; 2685; 2686; 2687; 2688; 2689; 2718; 2719; 2720; 2721; 2722; 2723; 2724; 2774; 2775; 2776; 2777; 2778; 2833; 2834; 2835; 2836; 2837; 2852; 2853; 2854; 2855; 2856; 2857; 2858; 2859; 2860; 2861; 2862; 2863; 2864; 2865; 2866; 2867; 2868; 3304; 3305; 3306; 3307; 3308; 3309; 3310; 3440; 3441; 3442; 3443; 3444; 3445; 3446; |

TABLE 1-continued

| Tissue | Phenotype Category | Phenotype | Phenotype Description | Applications | Ceres ID | SEQ ID NO |
|---|---|---|---|---|---|---|
| | | | | | 1043081; ANNOT 1478584; ANNOT 1455564; ANNOT 1455564; ANNOT 1508764; ANNOT 1477651; ANNOT 1487130; ANNOT 1487193; CDNA 3657l789; ANNOT 1444156; ANNOT 1497097; ANNOT 1497097; | 3447; 3448; 3449; 3450; 3451; 3452; 3453; 3454; 3455; 3456; 3481; 3482; 3483; 3484; 3485; 3486; 3487; 3488; 3489; 3490; 3491; 4043; 4044; 4045; 4046; 4047; |
| CAULINE LEAVES | Biomass | Lanceolate Shaped | The leaves are narrow and come to a dull point at the apex. | Useful for making plants with increased biomass and foliage | CLONE 5968; ANNOT 1450891; ANNOT 1450891; ANNOT 1456400; ANNOT 1456400; ANNOT 1450889; ANNOT 1456395; ANNOT 1447193; CLONE 13186; ANNOT 1464566; ANNOT 1464566; ANNOT 1458408; CLONE 13757; ANNOT 1471425; ANNOT 1471425; | 250; 251; 252; 253; 254; 255; 256; 257; 258; 259; 260; 531; 532; 533; 534; 535; 564; 565; 566; |
| WHOLE PLANT | Biomass | Large | The plant is abnormally large. | Useful for making bigger plants | CLONE 332; ANNOT 1474923; CLONE 949; ANNOT 1449721; ANNOT 1449721; CLONE 2036; ANNOT 1526068; CLONE 5597; ANNOT 1507708; ANNOT 1507708; ANNOT 1475094; ANNOT 1475094; CLONE 8265; ANNOT 1438919; ANNOT 1438919; ANNOT 1499398; ANNOT 1446419; ANNOT 1446419; CLONE 9683; ANNOT 1471514; ANNOT 1471514; CLONE 12272; ANNOT 1506387; ANNOT 1506387; ANNOT 1474522; ANNOT 1474522; CLONE 16461; ANNOT 1479013; ANNOT 1479013; CLONE 17356; ANNOT 1478584; ANNOT 1478584; ANNOT 1487130; ANNOT 1487130; CLONE 23518; ANNOT 1475658; ANNOT 1475658; ANNOT 1449267; ANNOT 1449267; ANNOT 1507191; CLONE 37288; ANNOT 1453650; ANNOT 1453650; CLONE 98855; ANNOT 1460836; ANNOT 1460836; ANNOT 1450324; CLONE 105554; ANNOT 1451783; ANNOT 1451783; CLONE 118648; ANNOT 1510664; ANNOT 1457458; ANNOT 1457458; ANNOT 1443693; ANNOT 1496628; ANNOT 1496628; ANNOT 1451509; ANNOT 1451509; ANNOT 1540402; ANNOT 1540402; ANNOT 1487005; ANNOT 1487005; CLONE 119925; ANNOT 1473490; ANNOT 1473490; ANNOT 1526901; ANNOT 1526901; CLONE 148680; ANNOT 1487130; ANNOT 1522509; ANNOT 1522509; CLONE 151087; ANNOT 1504145; ANNOT 1504145; ANNOT 1451079; ANNOT 1451079; CLONE 156655; ANNOT 1441740; ANNOT 1441740; CLONE 157730; ANNOT 1532681; ANNOT 1532681; ANNOT 1469739; ANNOT 1469739; CLONE 158333; ANNOT 1466505; ANNOT 1466505; ANNOT 1449026; ANNOT 1449026; CLONE 227651; ANNOT 1474222; ANNOT 1474222; ANNOT 1468994; ANNOT 1468994; ANNOT 1497043; ANNOT 1497043; CLONE 536457; ANNOT 1490030; ANNOT 1490030; ANNOT 1493787; ANNOT 1493787; ANNOT 1508184; ANNOT 1508184; ANNOT 1528645; CDNA 23507479; ANNOT 1510416; ANNOT 1510416; ANNOT 1541253; ANNOT 1541253; CDNA 3657002; ANNOT 1483397; ANNOT 1483397; CDNA 36529808; ANNOT 1440346; ANNOT 1440346; ANNOT 1463445; ANNOT 1463445; ANNOT 1512677; ANNOT 1512677; ANNOT 1459412; ANNOT 1459412; | 12; 13; 14; 35; 36; 37; 84; 85; 86; 233; 234; 235; 236; 237; 362; 363; 364; 365; 366; 367; 368; 402; 403; 404; 515; 516; 517; 518; 519; 647; 648; 649; 673; 674; 675; 676; 677; 907; 908; 909; 910; 911; 912; 913; 1622; 1623; 1624; 2118; 2119; 2120; 2121; 2122; 2247; 2248; 2249; 2429; 2430; 2431; 2432; 2433; 2434; 2435; 2436; 2437; 2438; 2439; 2440; 2441; 2442; 2443; 2461; 2462; 2463; 2464; 2465; 2540; 2541; 2542; 2560; 2561; 2562; 2563; 2564; 2580; 2581; 2582; 2601; 2602; 2603; 2604; 2605; 2611; 2612; 2613; 2614; 2615; 2683; 2684; 2685; 2686; 2687; 2688; 2689; 3130; 3131; 3132; 3133; 3134; 3314; 3315; 3316; 3317; 3318; 3704; 3705; 3706; 3707; 3708; 3916; 3917; 3918; 3920; 3921; 3922; 4036; 4037; 4038; 4039; 4040; 4041; 4042; |
| CAULINE LEAVES | Biomass | Large | The cauline leaves are abnormally large. | Useful for making plants with increased biomass and foliage | CLONE 1496; ANNOT 1490668; ANNOT 1490668; ANNOT 1474027; ANNOT 1474027; ANNOT 1497865; ANNOT 1471512; ANNOT 1471512; ANNOT 1443061; ANNOT 1443061; ANNOT 1504203; ANNOT 1504203; ANNOT 1505468; ANNOT 1505468; ANNOT 1452369; CLONE 21563; CLONE 32361; ANNOT 1438905; ANNOT 1438905; ANNOT 1483143; ANNOT 1483143; CLONE 32361; ANNOT 1471776; ANNOT 1471776; ANNOT 1445033; ANNOT 1445033; ANNOT CLONE 105554; ANNOT 1451783; ANNOT 1451783; CLONE 1007549; ANNOT | 50; 51; 52; 53; 54; 55; 56; 57; 58; 59; 60; 61; 62; 63; 64; 65; 66; 842; 843; 844; 845; 846; 1226; 1227; 1228; 1229; 1230; 2247; 2248; 2249; 3440; 3441; 3442; 3443; |

TABLE 1-continued

| Tissue | Phenotype Category | Phenotype | Phenotype Description | Applications | Ceres ID | SEQ ID NO |
|---|---|---|---|---|---|---|
| | | | | | 1458198; ANNOT 1458198; ANNOT 1439989; ANNOT 1464789; ANNOT 1464789; ANNOT 1461728; ANNOT 1461728; ANNOT 1479711; ANNOT 1479711; ANNOT 1440649; ANNOT 1464547; ANNOT 1464547; ANNOT 1454104; ANNOT 1454104; | 3444; 3445; 3446; 3447; 3448; 3449; 3450; 3451; 3452; 3453; 3454; 3455; 3456; |
| HYPOCOTYL | Biomass | Long | The hypocotyl is longer than in wild-type. | Useful for making taller plants | CLONE 24644; ANNOT 1463301; ANNOT 1459811; CLONE 28602; ANNOT 1488330; ANNOT 1488330; ANNOT 1461728; ANNOT 1460480; ANNOT 1460480; ANNOT 1461614; ANNOT 1461614; ANNOT 1479711; ANNOT 1479711; ANNOT 1479712; ANNOT 1488329; ANNOT 1488329; ANNOT 1460481; ANNOT 1460481; ANNOT 1461613; ANNOT 1461613; ANNOT 1458198; ANNOT 1488327; ANNOT 1488327; | 944; 945; 946; 947; 948; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; |
| INFLORESCENCE | Biomass | Long Internode | The internode is abnormally long. | Useful for making taller plants and plants with longer flowers | CDNA 2350103; ANNOT 1447690; ANNOT 1447690; ANNOT 1491278; ANNOT 1491278; ANNOT 1500987; ANNOT 1490915; ANNOT 1490915; | 3687; 3688; 3689; 3690; 3691; 3692; 3693; 3694; 3695; |
| WHOLE PLANT | Biomass | Misc. Dwarf | The plants are small. | Useful for modulating plant size | CLONE 463; ANNOT 1542632; CLONE 3000; ANNOT 1518918; ANNOT 1518918; ANNOT 1535677; ANNOT 1482181; ANNOT 1482181; CLONE 6082; ANNOT 1443416; ANNOT 1505047; ANNOT 1505047; ANNOT 1496339; CLONE 8916; ANNOT 1462804; ANNOT 1462804; CLONE 9683; ANNOT 1471514; ANNOT 1471514; ANNOT 1451126; CLONE 19586; ANNOT 1476446; ANNOT 1451126; ANNOT 23771; ANNOT 1444030; ANNOT 1444030; ANNOT 1486813; ANNOT 1486813; ANNOT 1485303; ANNOT 1446796; ANNOT 1481806; ANNOT 1446796; CLONE 27477; ANNOT 1535293; ANNOT 1481806; CLONE 28003; ANNOT 1527756; ANNOT 1481806; ANNOT 1468882; CLONE 32753; ANNOT 1480607; ANNOT 1480607; ANNOT 1472242; ANNOT 37663; ANNOT 1437663; ANNOT 1447659; ANNOT 1438478; CLONE 38101; ANNOT 1454656; ANNOT 1454656; ANNOT 1528263; ANNOT 1458103; ANNOT 1458103; ANNOT 1464899; ANNOT 1482966; ANNOT 1482966; ANNOT 1441039; ANNOT 1490459; ANNOT 1520449; CLONE 39678; ANNOT 1490459; ANNOT 1437663; ANNOT 1437663; ANNOT 1437666; ANNOT 1437689; ANNOT 1437689; CLONE 40153; ANNOT 1453549; ANNOT 1453549; ANNOT 1528184; ANNOT 1528184; ANNOT 1474758; CLONE 40729; ANNOT 1481678; ANNOT 1474758; ANNOT 1481678; ANNOT 1476817; ANNOT 1503063; ANNOT 1503063; ANNOT 1450022; ANNOT 1450022; ANNOT 1447022; CLONE 206224; ANNOT 1485509; ANNOT 1485509; ANNOT 1447022; ANNOT 1443744; CDNA 3655053; ANNOT 1496682; ANNOT 1496682; ANNOT 1464088; ANNOT 1458774; ANNOT 1458774; CDNA 36360856; ANNOT 1517998; ANNOT 1458313; ANNOT 1458313; | 15; 16; 17; 111; 112; 113; 114; 115; 116; 117; 268; 269; 270; 271; 272; 273; 274; 388; 389; 390; 402; 403; 404; 784; 785; 786; 787; 788; 928; 929; 930; 931; 932; 933; 934; 935; 936; 1065; 1066; 1067; 1068; 1069; 1080; 1081; 1082; 1083; 1084; 1250; 1251; 1252; 1253; 1254; 1657; 1658; 1659; 1660; 1661; 1682; 1683; 1684; 1685; 1686; 1687; 1688; 1689; 1690; 1691; 1692; 1693; 1694; 1695; 1696; 1868; 1869; 1870; 1871; 1872; 1873; 1874; 1875; 1876; 1897; 1898; 1899; 1900; 1901; 1902; 1903; 1931; 1932; 2240; 2241; 2242; 2243; 2244; 2245; 2246; 2630; 2631; 2632; 2633; 2634; 2806; 2807; 2808; 2809; 2810; 3990; 3991; 3992; 3993; 3994; 4008; 4009; 4010; 4011; 4012; |
| CAULINE LEAVES | Biomass | Oval Shaped | The leaves are much rounder than wild-type. | Useful for making plants with increased biomass and foliage | CLONE 32361; ANNOT 1471776; ANNOT 1445033; ANNOT 1445033; CLONE 102248; ANNOT 1456981; CLONE 157709; ANNOT 1515067; ANNOT 1515067; ANNOT 1492780; ANNOT 1492780; CDNA 36359960; ANNOT 1448952; ANNOT 1448952; | 1226; 1227; 1228; 1229; 1230; 2229; 2230; 2231; 2596; 2597; 2598; 2599; 2600; 3966; 3967; 3968; |
| CAULINE | Biomass | Ovate Shaped | The leaves are | Useful for | CLONE 304574; ANNOT 1481465; ANNOT 1481465; ANNOT 1482095; ANNOT | 2884; 2885; 2886; 2887; |

TABLE 1-continued

| Tissue | Phenotype Category | Phenotype | Phenotype Description | Applications | Ceres ID | SEQ ID NO |
|---|---|---|---|---|---|---|
| LEAVES | | | wider at base than at the apex, otherwise similar to wild-type | making plants with increased biomass and foliage | 1482095; ANNOT 1482093; ANNOT 1440823; ANNOT 1440823; | 2888; 2889; 2890; 2891; 2892; |
| WHOLE PLANT | Biomass | Plant Size | The plants have increased size compared to wild type. | Useful for making plants with increased size and biomass | CLONE 37288; ANNOT 1453650; ANNOT 1453650; | 1622; 1623; 1624; |
| INFLORESCENCE | Biomass | Reduced Apical Dominance | The dominance of the primary inflorescence is diminished. The secondary inflorescences are as dominant or nearly as dominant as the primary inflorescence. | Useful for modifying plant structure, i.e. increased branching | CLONE 463; ANNOT 1542632; CLONE 3036; ANNOT 1456840; ANNOT 1456840; CLONE 9132; ANNOT 1458620; CLONE 13757; ANNOT 1471425; ANNOT 1471425; CLONE 19586; ANNOT 1476446; ANNOT 1476446; ANNOT 1451126; CLONE 31507; ANNOT 1447204; ANNOT 1447204; CLONE 37298; ANNOT 1476538; ANNOT 1476538; ANNOT 1493576; ANNOT 1493576; CLONE 39890; ANNOT 1511886; ANNOT 1511886; ANNOT 1517635; ANNOT 1517635; CLONE 40708; ANNOT 1457313; ANNOT 1457313; ANNOT 1487784; ANNOT 1505885; ANNOT 1505885; ANNOT 1495571; CLONE 40729; ANNOT 1481678; ANNOT 1481678; ANNOT 1495571; ANNOT 1462354; ANNOT 1462354; CLONE 96020; ANNOT 1450365; ANNOT 1450365; ANNOT 1460794; ANNOT 1460794; CLONE 101686; ANNOT 1479756; ANNOT 1540137; ANNOT 1540137; ANNOT 1486722; ANNOT 1486722; CLONE 115946; ANNOT 1458342; ANNOT 1458342; ANNOT 480332; ANNOT 1511016; ANNOT 1511016; ANNOT 1518556; ANNOT 1518556; ANNOT 1457793; ANNOT 1457793; ANNOT 1465233; ANNOT 1465233; CLONE 536726; ANNOT 1498226; ANNOT 1498226; ANNOT 1445243; ANNOT 1445243; ANNOT 1525386; ANNOT 1448522; ANNOT 1448522; ANNOT 1447017; ANNOT 1465506; ANNOT 1465506; ANNOT 1497017; ANNOT 1447240; ANNOT 1447240; ANNOT 1539566; ANNOT 1539566; ANNOT 1444070; ANNOT 1444070; CLONE 572121; ANNOT 1477450; ANNOT 1477450; CDNA 3652976; ANNOT 1445379; ANNOT 1449468; ANNOT 1449468; | 15; 16; 17; 121; 122; 123; 391; 392; 393; 564; 565; 566; 784; 785; 786; 787; 788; 1195; 1196; 1197; 1625; 1626; 1627; 1628; 1629; 1882; 1883; 1884; 1885; 1886; 1921; 1922; 1923; 1924; 1925; 1926; 1927; 1928; 1929; 1930; 1931; 1932; 2045; 2046; 2047; 2095; 2096; 2097; 2098; 2099; 2212; 2213; 2214; 2215; 2216; 2217; 2218; 2370; 2371; 2372; 3034; 3035; 3036; 3037; 3038; 3039; 3040; 3041; 3042; 3135; 3136; 3137; 3138; 3139; 3140; 3141; 3142; 3143; 3144; 3145; 3146; 3147; 3148; 3149; 3150; 3151; 3152; 3153; 3252; 3253; 3254; 3928; 3929; 3930; 3931; 3932; |
| CAULINE LEAVES | Biomass | Serrate Margins | The leaf margins are serrated. | Useful for making plants with increased biomass and foliage | CLONE 1496; ANNOT 1474027; ANNOT 1490668; ANNOT 1490668; ANNOT 1497865; ANNOT 1471512; ANNOT 1471512; ANNOT 1443061; ANNOT 1443061; ANNOT 1504203; ANNOT 1505468; ANNOT 1505468; ANNOT 1452369; ANNOT 1452369; CLONE 25172; ANNOT 1457346; ANNOT 1457346; ANNOT 1504045; ANNOT 1541170; CLONE 33232; ANNOT 1504045; ANNOT 1450045; ANNOT 1450983; ANNOT 1450983; CLONE 34552; ANNOT 1516449; ANNOT 1516449; ANNOT 1512976; CLONE 304574; ANNOT 1481465; ANNOT 1482095; ANNOT 1482095; ANNOT 1482093; ANNOT 1440823; ANNOT 1440823; ANNOT 1475043; ANNOT 1475043; ANNOT 1454586; ANNOT 1454586; ANNOT 1507756; ANNOT 1507756; ANNOT 1469708; ANNOT 1469708; | 50; 51; 52; 53; 54; 55; 56; 57; 58; 59; 60; 61; 62; 63; 64; 65; 66; 952; 953; 954; 955; 956; 1263; 1264; 1265; 1266; 1267; 1406; 1407; 1408; 1409; 1410; 2884; 2885; 2886; 2887; 2888; 2889; 2890; 2891; 2892; 3419; 3420; 3421; 3422; 3423; 3424; 3425; 3426; 3427; |
| INFLORESCENCE | Biomass | Short | The inflorescences of the plants are abnormally | Useful for modulating plant height | CLONE 332; ANNOT 1474923; CLONE 1496; ANNOT 1490668; ANNOT 1490668; ANNOT 1474027; ANNOT 1474027; ANNOT 1497865; ANNOT 1497865; ANNOT 1471512; ANNOT 1471512; ANNOT 1443061; ANNOT 1443061; ANNOT 1504203; ANNOT 1504203; ANNOT 1505468; ANNOT 1505468; | 12; 13; 14; 50; 51; 52; 53; 54; 55; 56; 57; 58; 59; 60; 61; 62; 63; 64; 65; 66; 67; 68; 69; 70; |

TABLE 1-continued

| Tissue | Phenotype Category | Phenotype | Phenotype Description | Ceres ID | SEQ ID NO |
|---|---|---|---|---|---|
| | | | short. | 1452369; ANNOT 1452369; CLONE 1610; ANNOT 1454586; ANNOT 1454586; ANNOT 1475043; ANNOT 1475043; ANNOT 1507756; ANNOT 1507756; ANNOT 1469708; ANNOT 1469708; CLONE 2561; ANNOT 1450958; ANNOT 1450958; ANNOT 1456475; ANNOT 1456475; ANNOT 1446945; ANNOT 1446945; CLONE 3062; ANNOT 1504677; ANNOT 1504677; ANNOT 1451593; ANNOT 1451593; CLONE 3997; ANNOT 1455209; ANNOT 1455209; ANNOT 1446198; ANNOT 1446198; ANNOT 1490273; ANNOT 1490273; ANNOT 1530603; ANNOT 1530603; CLONE 5198; ANNOT 1472153; ANNOT 1472153; CLONE 6387; ANNOT 1509111; ANNOT 1509111; ANNOT 1541620; ANNOT 1541620; CLONE 8254; ANNOT 1543042; ANNOT 1543042; ANNOT 1489655; ANNOT 1489655; CLONE 8265; ANNOT 1438919; ANNOT 1438919; ANNOT 1499398; ANNOT 1499398; ANNOT 1446419; ANNOT 1446419; CLONE 8633; ANNOT 1500561; ANNOT 1500561; ANNOT 1527560; ANNOT 1527560; ANNOT 1522449; ANNOT 1522449; CLONE 8877; ANNOT 1507340; ANNOT 1507340; ANNOT 1529361; ANNOT 1529361; CLONE 9132; ANNOT 1458620; ANNOT 1458620; CLONE 9221; ANNOT 1535229; ANNOT 1535229; CLONE 9897; ANNOT 1445849; ANNOT 1445849; ANNOT 1150561; ANNOT 1150561; ANNOT 1464446; ANNOT 1464446; ANNOT 1464458; ANNOT 1464458; CLONE 10857; ANNOT 1464446; ANNOT 1464446; CLONE 10879; ANNOT 1467184; ANNOT 1467184; CLONE 11214; ANNOT 1501485; ANNOT 1501485; ANNOT 1490496; ANNOT 1490496; ANNOT 1448498; ANNOT 1448498; ANNOT 1474848; ANNOT 1474848; CLONE 11854; ANNOT 1506763; ANNOT 1506763; ANNOT 1453614; ANNOT 1453614; CLONE 12071; ANNOT 1466704; ANNOT 1466704; CLONE 12272; ANNOT 1506387; ANNOT 1506387; ANNOT 1474522; ANNOT 1474522; CLONE 12993; ANNOT 1479464; ANNOT 1479464; ANNOT 1464566; ANNOT 1464566; ANNOT 1458408; ANNOT 1458408; CLONE 13186; ANNOT 1470919; ANNOT 1470919; CLONE 13625; ANNOT 1455211; ANNOT 1455211; CLONE 13757; ANNOT 1471425; ANNOT 1471425; CLONE 13767; ANNOT 1542158; ANNOT 1542158; ANNOT 1488730; ANNOT 1488730; CLONE 14583; ANNOT 1530256; ANNOT 1530256; ANNOT 1476783; ANNOT 1476783; ANNOT 1503166; ANNOT 1503166; CLONE 14909; ANNOT 1497838; ANNOT 1497838; ANNOT 1522523; ANNOT 1522523; ANNOT 1471525; ANNOT 1471525; ANNOT 1511908; ANNOT 1511908; ANNOT 1464305; ANNOT 1464305; ANNOT 1451416; ANNOT 1451416; ANNOT 1461050; ANNOT 1461050; CLONE 17434; ANNOT 1455741; ANNOT 1455741; ANNOT 1477832; ANNOT 1477832; CLONE 17761; ANNOT 1481206; ANNOT 1481206; ANNOT 1534689; ANNOT 1534689; CLONE 18612; ANNOT 1522299; ANNOT 1522299; ANNOT 1527718; ANNOT 1527718; CLONE 19116; ANNOT 1467522; ANNOT 1467522; ANNOT 1526421; ANNOT 1526421; CLONE 19586; ANNOT 1476446; ANNOT 1476446; ANNOT 1451126; ANNOT 1451126; CLONE 22007; ANNOT 1464350; ANNOT 1464350; ANNOT 1458591; ANNOT 1458591; ANNOT 1517094; ANNOT 1517094; ANNOT 1512337; ANNOT 1512337; CLONE 23771; CLONE 23322; ANNOT 1444030; ANNOT 1444030; ANNOT 1486813; ANNOT 1486813; CLONE 25172; ANNOT 1485303; ANNOT 1485303; ANNOT 1457346; ANNOT 1457346; ANNOT 1446796; ANNOT 1446796; ANNOT 1541170; CLONE 25538; ANNOT 1480776; ANNOT 1480776; CLONE 25758; ANNOT 1473748; ANNOT 1473748; CLONE 26907; ANNOT 1484074; ANNOT 1484074; ANNOT 1440016; ANNOT 1440016; ANNOT 1518242; ANNOT 1518242; CLONE 27810; ANNOT 1503622; ANNOT 1503622; ANNOT 1450565; ANNOT 1450565; CLONE 28326; ANNOT 1468461; ANNOT 1468461; CLONE 29363; ANNOT 1471301; ANNOT 1471301; ANNOT 1494753; ANNOT 1494753; ANNOT 1441875; ANNOT 1441875; CLONE 30759; ANNOT 1520359; ANNOT 1520359; ANNOT | 71; 72; 73; 74; 75; 104; 105; 106; 107; 108; 109; 110; 124; 125; 126; 127; 128; 178; 179; 180; 181; 182; 183; 184; 185; 186; 230; 231; 232; 285; 286; 287; 288; 289; 357; 358; 359; 360; 361; 362; 363; 364; 365; 366; 367; 368; 375; 376; 377; 378; 379; 383; 384; 385; 386; 387; 391; 392; 393; 394; 395; 396; 405; 406; 407; 408; 409; 410; 411; 434; 435; 436; 437; 438; 439; 448; 449; 450; 451; 452; 453; 454; 455; 456; 475; 476; 477; 478; 479; 507; 508; 509; 515; 516; 517; 518; 519; 520; 521; 522; 531; 532; 533; 534; 535; 536; 537; 538; 544; 545; 546; 564; 565; 566; 567; 568; 569; 570; 571; 619; 620; 621; 622; 623; 624; 625; 626; 627; 628; 629; 630; 631; 632; 633; 634; 635; 636; 637; 638; 639; 640; 687; 688; 689; 690; 691; 700; 701; 702; 703; 704; 720; 721; 722; 723; 724; 735; 736; 737; 738; 739; 784; 785; 786; 787; 788; 876; 877; 878; 879; 880; 897; 898; 899; 900; 901; 928; 929; 930; 931; 932; 933; 934; 935; 936; 952; 953; 954; 955; 956; 967; 968; 969; 973; 974; 975; 1043; 1044; 1045; 1046; 1047; 1048; 1049; 1075; 1076; 1077; 1078; 1079; 1088; 1089; 1090; 1143; 1144; 1145; 1164; 1165; 1166; 1167; 1168; 1169; 1170; 1171; 1172; 1173; 1174; 1175; 1176; 1177; 1178; 1179; 1180; 1181; 1182; 1183; 1184; 1195; 1196; 1197; 1219; 1220; |

TABLE 1-continued

| Tissue | Phenotype Category | Phenotype | Phenotype Description | Applications | Ceres ID | SEQ ID NO |
|---|---|---|---|---|---|---|
| | | | | | 1441875; ANNOT 1467006; ANNOT 1441867; ANNOT 1441871; ANNOT 1441864; ANNOT 1441868; ANNOT 1441859; ANNOT 1467009; ANNOT 1467009; CLONE 31507; ANNOT 1447204; ANNOT 32248; ANNOT 1470719; ANNOT 1543728; CLONE 1471776; ANNOT 1482066; CLONE 32361; ANNOT 1450324; ANNOT 1450324; ANNOT 1445033; CLONE 32548; ANNOT 1460836; ANNOT 1471372; CLONE 32791; ANNOT 1540248; ANNOT 1498316; CLONE 34385; ANNOT 1445531; ANNOT 1498316; ANNOT 1449358; CLONE 34480; ANNOT 1502362; ANNOT 1449358; ANNOT 1452408; CLONE 35051; ANNOT 1443033; ANNOT 1457751; ANNOT 1452408; ANNOT 1505508; CLONE 35493; ANNOT 1465420; CLONE 35733; ANNOT 1518757; ANNOT 1453650; ANNOT 1443988; CLONE 37288; ANNOT 1486258; ANNOT 1493576; CLONE 37298; ANNOT 1476538; ANNOT 1465769; ANNOT 1465769; CLONE 38214; ANNOT 1466779; ANNOT 1467961; ANNOT 1542971; ANNOT 1521332; CLONE 38318; ANNOT 1514466; CLONE 38785; ANNOT 1461193; ANNOT 1448369; ANNOT 1480950; CLONE 39740; ANNOT 1483180; ANNOT 1514466; ANNOT 1528184; ANNOT 1495571; ANNOT 1474758; ANNOT 1453549; ANNOT 1457313; ANNOT 1453626; CLONE 40708; ANNOT 1457313; ANNOT 1481678; ANNOT 1487784; ANNOT 1505885; ANNOT 1455815; ANNOT 1495571; ANNOT 1482477; ANNOT 1481678; ANNOT 1535964; CLONE 40824; ANNOT 1509015; ANNOT 1535964; ANNOT 1535815; ANNOT 1455817; ANNOT 1482502; ANNOT 1509035; ANNOT 1509035; ANNOT 1482477; ANNOT 1482502; ANNOT 1509013; ANNOT 1535990; ANNOT 1455837; ANNOT 1455837; CLONE 41337; ANNOT 1516613; ANNOT 1513097; ANNOT 1513097; ANNOT 1463324; CLONE 92670; ANNOT 1531919; ANNOT 1531919; CLONE 95677; ANNOT 1459723; ANNOT 1459723; ANNOT 1516455; CLONE 96020; ANNOT 1450365; ANNOT 1450365; ANNOT 1460794; CLONE 97434; ANNOT 1488311; ANNOT 1488311; ANNOT 1518776; CLONE 100047; ANNOT 1532164; ANNOT 1532164; ANNOT 1479341; ANNOT 1479350; ANNOT 1442450; CLONE 100245; ANNOT 1535451; ANNOT 1535451; ANNOT 1532285; ANNOT 1480241; ANNOT 1480241; ANNOT 1446025; CLONE 100319; ANNOT 1503141; ANNOT 1503141; ANNOT 1521524; ANNOT 1453127; 102248; ANNOT 1456981; CLONE 115924; ANNOT 1453127; ANNOT 1453127; ANNOT 1506261; ANNOT 1480332; ANNOT 1480332; ANNOT 1454197; CLONE 116117; ANNOT 1456955; ANNOT 1456955; ANNOT 1451365; ANNOT 1451365; ANNOT 1504433; ANNOT 1504433; CLONE 116237; ANNOT 1455816; ANNOT 1482502; ANNOT 1482502; ANNOT 1482508; ANNOT 1535990; ANNOT | 1221; 1222; 1223; 1224; 1225; 1226; 1227; 1228; 1229; 1230; 1231; 1232; 1233; 1234; 1235; 1239; 1240; 1241; 1255; 1256; 1257; 1364; 1365; 1366; 1367; 1368; 1398; 1399; 1400; 1401; 1402; 1441; 1442; 1443; 1444; 1445; 1446; 1447; 1460; 1461; 1462; 1463; 1464; 1465; 1466; 1476; 1477; 1478; 1479; 1480; 1622; 1623; 1624; 1625; 1626; 1627; 1628; 1629; 1707; 1708; 1709; 1710; 1711; 1712; 1713; 1747; 1748; 1749; 1750; 1751; 1752; 1753; 1788; 1789; 1790; 1796; 1797; 1798; 1799; 1800; 1877; 1878; 1879; 1880; 1881; 1897; 1898; 1899; 1900; 1901; 1902; 1903; 1912; 1913; 1914; 1921; 1922; 1923; 1924; 1925; 1926; 1927; 1928; 1929; 1930; 1931; 1932; 1939; 1940; 1941; 1946; 1947; 1944; 1945; 1946; 1947; 1948; 1949; 1950; 1951; 1952; 1953; 1954; 1955; 1956; 1957; 1958; 1959; 1960; 1961; 1988; 1989; 1990; 1991; 1992; 1993; 1994; 2061; 2062; 2063; 2090; 2091; 2092; 2093; 2094; 2095; 2096; 2097; 2098; 2099; 2103; 2104; 2105; 2106; 2107; 2173; 2174; 2175; 2176; 2177; 2178; 2179; 2180; 2181; 2182; 2183; 2184; 2185; 2186; 2187; 2188; 2189; 2190; 2191; 2192; 2193; 2194; 2195; 2229; 2230; 2231; 2361; 2362; 2363; 2364; 2365; 2366; 2367; 2368; 2369; 2376; 2377; 2378; 2379; 2380; 2381; 2382; 2383; 2384; 2385; |

TABLE 1-continued

| Tissue | Phenotype Category | Phenotype | Phenotype Description | Applications | Ceres ID | SEQ ID NO |
|---|---|---|---|---|---|---|
| | | | | | 1535990; ANNOT 1509013; CLONE 118337; ANNOT 1454773; | 2386; 2387; 2388; 2389; |
| | | | | | ANNOT 1454773; ANNOT 1511811; ANNOT 1478364; ANNOT | 2390; 2391; 2392; 2393; |
| | | | | | 1478364; ANNOT 1464394; CLONE 123279; ANNOT 1508945; | 2417; 2418; 2419; 2420; |
| | | | | | ANNOT 1508945; ANNOT 1531332; ANNOT 1482544; ANNOT | 2421; 2422; 2423; 2424; |
| | | | | | 1482544; ANNOT 1478226; ANNOT 1478226; CLONE 141830; ANNOT 1488335; | 2425; 2492; 2493; 2494; |
| | | | | | ANNOT 1488335; CLONE 147358; ANNOT 1493111; ANNOT | 2495; 2496; 2497; 2498; |
| | | | | | 1461452; ANNOT 1461452; CLONE 147593; ANNOT 1475653; | 2499; 2500; 2520; 2521; |
| | | | | | ANNOT 1458131; ANNOT 1458131; ANNOT 1461780; ANNOT 1461780; CLONE | 2522; 2528; 2529; 2530; |
| | | | | | 148680; ANNOT 1522509; CLONE 149380; ANNOT 1461440; | 2531; 2532; 2533; 2534; |
| | | | | | ANNOT 1461440; ANNOT 1461430; ANNOT 1461427; ANNOT | 2535; 2536; 2537; 2538; |
| | | | | | 1461427; ANNOT 1440253; CLONE 150912; ANNOT 1533910; | 2539; 2540; 2541; 2542; |
| | | | | | ANNOT 1533910; ANNOT 1480439; ANNOT 1480439; CLONE 157547; ANNOT | 2546; 2547; 2548; 2549; |
| | | | | | 1473898; ANNOT 1473898; CLONE 206224; ANNOT 1485509; ANNOT 1485509; | 2550; 2551; 2552; 2553; |
| | | | | | ANNOT 1447022; ANNOT 1447022; CLONE 226818; ANNOT 1503617; ANNOT | 2554; 2555; 2556; 2557; |
| | | | | | 1503617; ANNOT 1450560; ANNOT 1450560; ANNOT 1460622; ANNOT 1460622; ANNOT | 2558; 2559; 2593; 2594; |
| | | | | | CLONE 241379; ANNOT 1526950; ANNOT 1526950; ANNOT 1508362; ANNOT | 2595; 2630; 2631; 2632; |
| | | | | | 1508362; ANNOT 1477361; ANNOT 1477361; CLONE 254065; ANNOT 1485544; | 2633; 2634; 2676; 2677; |
| | | | | | ANNOT 1485544; ANNOT 1447051; ANNOT 1517016; ANNOT | 2678; 2679; 2680; 2681; |
| | | | | | 1517016; CLONE 262460; ANNOT 1530053; ANNOT 1493414; | 2682; 2718; 2719; 2720; |
| | | | | | ANNOT 1493414; CLONE 267657; ANNOT 1471473; ANNOT | 2721; 2722; 2723; 2724; |
| | | | | | 1471473; ANNOT 1444931; CLONE 304574; ANNOT 1481465; | 2731; 2732; 2733; 2734; |
| | | | | | ANNOT 1481465; ANNOT 1482095; ANNOT 1482093; ANNOT | 2735; 2736; 2737; 2774; |
| | | | | | 1482093; ANNOT 1440823; CLONE 480332; ANNOT 1511016; | 2775; 2776; 2777; 2778; |
| | | | | | ANNOT 1511016; ANNOT 1518556; ANNOT 1457793; ANNOT 1457793; ANNOT | 2801; 2802; 2803; 2804; |
| | | | | | 1465233; ANNOT 1465233; CLONE 536726; ANNOT 1498226; ANNOT 1498226; | 2805; 2884; 2885; 2886; |
| | | | | | ANNOT 1445243; ANNOT 1445243; ANNOT 1525386; ANNOT 1525386; ANNOT | 2887; 2888; 2889; 2890; |
| | | | | | 1448522; ANNOT 1448522; ANNOT 1465506; ANNOT 1497017; | 2891; 2892; 3034; 3035; |
| | | | | | ANNOT 1497017; ANNOT 1447240; ANNOT 1447240; ANNOT 1539566; ANNOT | 3036; 3037; 3038; 3039; |
| | | | | | 1539566; ANNOT 1444070; ANNOT 1444070; ANNOT 1466193; ANNOT | 3040; 3041; 3042; 3135; |
| | | | | | ANNOT 1466193; ANNOT 1494416; ANNOT 1494416; CLONE 566317; ANNOT | 3136; 3137; 3138; 3139; |
| | | | | | 1489585; ANNOT 1489585; ANNOT 1467905; ANNOT 1517371; | 3140; 3141; 3142; 3143; |
| | | | | | ANNOT 1517371; ANNOT 1512104; ANNOT 1512104; ANNOT 1458837; | 3144; 3145; 3146; 3147; |
| | | | | | 1458837; CLONE 1001432; ANNOT 1475043; ANNOT 1454586; | 3148; 3149; 3150; 3151; |
| | | | | | ANNOT 1454586; ANNOT 1507756; ANNOT 1507756; ANNOT 1469708; ANNOT | 3152; 3153; 3168; 3169; |
| | | | | | 1469708; CLONE 1002819; ANNOT 1474290; ANNOT 1522314; | 3170; 3171; 3172; 3241; |
| | | | | | ANNOT 1522314; ANNOT 1497147; ANNOT 1497147; ANNOT 1471045; ANNOT | 3242; 3243; 3244; 3245; |
| | | | | | 1471045; ANNOT 1006934; ANNOT 1532963; CLONE 1007549; | 3246; 3247; 3248; 3249; |
| | | | | | ANNOT 1458198; ANNOT 1458198; ANNOT 1439989; ANNOT 1439989; ANNOT | 3250; 3251; 3419; 3420; |
| | | | | | 1464789; ANNOT 1464789; ANNOT 1461728; ANNOT 1479711; | 3421; 3422; 3423; 3424; |
| | | | | | ANNOT 1479711; ANNOT 1440649; ANNOT 1440649; ANNOT 1464547; ANNOT | 3425; 3426; 3427; 3428; |
| | | | | | 1464547; ANNOT 1454104; CLONE 1011386; ANNOT 1531134; | 3429; 3430; 3431; 3432; |
| | | | | | ANNOT 1531134; ANNOT 1508758; ANNOT 1508758; CLONE 1011537; ANNOT | 3433; 3434; 3435; 3436; |
| | | | | | 1473879; ANNOT 1473879; ANNOT 1468666; ANNOT 1438163; | 3437; 3438; 3439; 3440; |
| | | | | | ANNOT 1438163; CDNA 23493481; ANNOT 1460973; CDNA | 3441; 3442; 3443; 3444; |
| | | | | | 23498145; ANNOT 1482362; ANNOT 1489077; ANNOT 1489077; | 3445; 3446; 3447; 3448; |
| | | | | | CDNA 23305182; ANNOT 1525474; ANNOT 1525474; CDNA 23545147; ANNOT | 3449; 3450; 3451; 3452; |
| | | | | | 1443044; ANNOT 1443044; CDNA 36512904; ANNOT 1471370; ANNOT | 3453; 3454; 3455; 3456; |
| | | | | | ANNOT 1444471; ANNOT 1444471; ANNOT 1491278; ANNOT 1491278; ANNOT | 3462; 3463; 3464; 3465; |
| | | | | | 1447690; ANNOT 1447690; CDNA 36521407; ANNOT 1514988; | 3466; 3467; 3468; 3469; |
| | | | | | CDNA 36535419; ANNOT 1524972; ANNOT 1524972; CDNA 36542853; ANNOT | 3470; 3471; 3472; 3473; |

TABLE 1-continued

| Tissue | Phenotype Category | Phenotype | Phenotype Description | Applications | Ceres ID | SEQ ID NO |
|---|---|---|---|---|---|---|
| | | | | | 1524883; ANNOT 1524883; ANNOT 149918; ANNOT 1497918; CDNA 36545500; ANNOT 1449045; ANNOT 1444156; ANNOT 1470714; ANNOT 1470714; CDNA 36571789; ANNOT 1444156; ANNOT 1497097; ANNOT 1497097; CDNA 3695523; ANNOT 1451434; ANNOT 1451434; CDNA 36697835; ANNOT 1461440; ANNOT 1461440; ANNOT 1461427; ANNOT 1461430; ANNOT 1461430; ANNOT 1440253; ANNOT 1440253; | 3613; 3614; 3615; 3641; 3642; 3643; 3644; 3645; 3696; 3697; 3698; 3813; 3814; 3815; 3896; 3897; 3898; 3899; 3900; 3901; 3902; 3903; 3904; 3908; 3909; 3910; 3948; 3949; 3950; 3974; 3975; 3976; 3977; 3978; 3979; 3980; 3981; 3982; 3983; 4043; 4044; 4045; 4046; 4047; 4070; 4071; 4072; 4073; 4074; 4075; 4076; 4077; 4078; 4079; 4080; 4081; |
| ROSETTE LEAVES | Biomass | Short Petioles | The leaf petioles are abnormally short. | Useful for modulating plant size | CLONE 332; ANNOT 1474923; ANNOT 1474923; CLONE 2403; ANNOT 1509972; ANNOT 1509972; ANNOT 1504203; ANNOT 1504203; ANNOT 1443061; ANNOT 1443061; ANNOT 1452369; ANNOT 1452369; CLONE 3000; ANNOT 1518918; ANNOT 1518918; ANNOT 1535677; ANNOT 1535677; ANNOT 1482181; ANNOT 1482181; CLONE 3036; ANNOT 1456840; ANNOT 1456840; CLONE 3858; ANNOT 1459068; ANNOT 1459068; CLONE 6387; ANNOT 1509111; ANNOT 1509111; ANNOT 1541620; ANNOT 1541620; CLONE 12272; ANNOT 1506387; ANNOT 1506387; ANNOT 1474522; ANNOT 1474522; CLONE 13741; ANNOT 1462963; ANNOT 1462963; ANNOT 1459563; ANNOT 1459563; CLONE 14583; ANNOT 1530256; ANNOT 1530256; ANNOT 1476783; ANNOT 1476783; ANNOT 1503166; ANNOT 1503166; CLONE 14909; ANNOT 1497838; ANNOT 1497838; ANNOT 1522523; ANNOT 1522523; ANNOT 1471525; ANNOT 1471525; ANNOT 1511908; ANNOT 1511908; ANNOT 1464305; ANNOT 1464305; ANNOT 1451416; ANNOT 1451416; ANNOT 1461050; ANNOT 1461050; CLONE 19586; ANNOT 1476446; ANNOT 1476446; ANNOT 1451126; ANNOT 1451126; CLONE 21563; ANNOT 1438905; ANNOT 1438905; ANNOT 1483143; ANNOT 1483143; CLONE 23523; ANNOT 1453919; ANNOT 1453919; CLONE 25172; ANNOT 1457346; ANNOT 1457346; ANNOT 1541170; ANNOT 1541170; CLONE 25538; ANNOT 1480776; ANNOT 1480776; CLONE 31507; ANNOT 1447204; ANNOT 1447204; CLONE 32751; ANNOT 1451171; ANNOT 1451171; CLONE 36334; ANNOT 1464715; ANNOT 1464715; ANNOT 1511511; ANNOT 1511511; CLONE 36518; ANNOT 1471507; ANNOT 1471507; ANNOT 1444893; ANNOT 1444893; ANNOT 1458642; ANNOT 1458642; ANNOT 1522497; ANNOT 1522497; ANNOT 1469105; ANNOT 1469105; ANNOT 1484993; ANNOT 1484993; CLONE 37288; ANNOT 1453650; ANNOT 1453650; ANNOT 1454656; ANNOT 1454656; ANNOT 1528263; ANNOT 1528263; ANNOT 1458103; ANNOT 1458103; ANNOT 1464899; ANNOT 1464899; ANNOT 1482966; ANNOT 1482966; ANNOT 1441039; ANNOT 1441039; ANNOT 1520449; ANNOT 1520449; CLONE 40508; ANNOT 1453626; ANNOT 1453626; CLONE 40824; ANNOT 1509015; ANNOT 1509015; ANNOT 1535964; ANNOT 1535964; ANNOT 1535962; ANNOT 1535962; ANNOT 1455815; ANNOT 1455815; ANNOT 1455817; ANNOT 1455817; ANNOT 1482502; ANNOT 1482502; ANNOT 1509035; ANNOT 1509035; ANNOT 1482477; ANNOT 1482477; ANNOT 1509013; ANNOT 1509013; ANNOT 1535990; ANNOT 1535990; ANNOT 1455837; ANNOT 1455837; CLONE 38101; CLONE 41439; ANNOT 100047; ANNOT 1532164; ANNOT 1532164; ANNOT 1442450; ANNOT 1442450; CLONE 102248; ANNOT 1445981; ANNOT 1479350; ANNOT 1479350; ANNOT 1479341; ANNOT 1479341; | 12; 13; 14; 95; 96; 97; 98; 99; 100; 101; 102; 103; 111; 112; 113; 114; 115; 116; 117; 121; 122; 123; 175; 176; 177; 285; 286; 287; 288; 289; 515; 516; 517; 518; 519; 550; 551; 552; 553; 554; 619; 620; 621; 622; 623; 624; 625; 626; 627; 628; 629; 630; 631; 632; 633; 634; 635; 636; 637; 638; 639; 640; 784; 785; 786; 787; 788; 842; 843; 844; 845; 846; 914; 915; 916; 952; 953; 954; 955; 956; 967; 968; 969; 1195; 1196; 1197; 1247; 1248; 1249; 1500; 1501; 1502; 1503; 1504; 1505; 1506; 1507; 1508; 1509; 1510; 1511; 1512; 1513; 1514; 1515; 1516; 1517; 1622; 1623; 1624; 1682; 1683; 1684; 1685; 1686; 1687; 1688; 1689; 1690; 1691; 1692; 1693; 1694; 1695; 1696; 1912; 1913; 1914; 1939; 1940; 1941; 1942; 1943; 1944; 1945; 1946; 1947; 1948; 1949; 1950; 1951; 1952; 1953; 1954; 1955; 1956; 1957; 1958; 1959; 1960; 1961; 1998; 2173; 2174; 2175; 2176; 2177; 2178; 2179; 2180; 2181; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1456981; CLONE 114602; ANNOT 1450785; ANNOT 1456283; ANNOT 1456283; ANNOT 1460638; ANNOT 1513900; ANNOT 1513900; ANNOT 1455816; ANNOT 1540271; ANNOT 116237; ANNOT 1455816; ANNOT 1482508; ANNOT 1482502; ANNOT 1482508; ANNOT 1482508; ANNOT 1535990; ANNOT 1509013; ANNOT 1509013; CLONE 122353; ANNOT 1472265; CLONE 123279; ANNOT 1508945; ANNOT 1508945; ANNOT 1531332; ANNOT 1531332; ANNOT 1482544; ANNOT 1482544; ANNOT 1478226; CLONE 206224; ANNOT 1485509; ANNOT 1485509; ANNOT 1447022; ANNOT 1447022; CLONE 235706; ANNOT 1462351; ANNOT 1462351; ANNOT 1469462; ANNOT 1469462; ANNOT 1488821; ANNOT 1488821; ANNOT 1485750; ANNOT 1485750; ANNOT 1485750; ANNOT 1440730; ANNOT 1440730; CLONE 482122; ANNOT 1438776; ANNOT 1438776; CLONE 536726; ANNOT 1498226; ANNOT 1498226; ANNOT 1445243; ANNOT 1445243; ANNOT 1525386; ANNOT 1448522; ANNOT 1448522; ANNOT 1465506; ANNOT 1465506; ANNOT 1497017; ANNOT 1497017; ANNOT 1497017; ANNOT 1447240; ANNOT 1539566; ANNOT 1539566; ANNOT 1444070; ANNOT 1444070; CLONE 536796; ANNOT 1484779; ANNOT 1484779; ANNOT 1538185; ANNOT 1538185; ANNOT 1455109; ANNOT 1455109; ANNOT 1477384; ANNOT 1477384; CLONE 537272; ANNOT 1518918; ANNOT 1518918; ANNOT 1535677; ANNOT 1535677; CLONE 541719; ANNOT 1518918; ANNOT 1518918; ANNOT 1535677; ANNOT 1535677; ANNOT 708342; ANNOT 1538185; ANNOT 1538185; CLONE 965175; ANNOT 1479013; ANNOT 1479013; CDNA 23498145; ANNOT 1482362; ANNOT 1482362; ANNOT 1489077; ANNOT 1489077; CDNA 23507479; ANNOT 1510416; ANNOT 1510416; ANNOT 1541253; ANNOT 1541253; CDNA 23518705; ANNOT 1463957; ANNOT 1463957; ANNOT 1458961; ANNOT 1458961; CDNA 36507407; ANNOT 1457193; ANNOT 1457193; ANNOT 1487854; ANNOT 1487854; CDNA 36508177; CDNA 36536865; ANNOT 1505326; ANNOT 1505326; ANNOT 1496106; ANNOT 1496106; CDNA 36560639; ANNOT 1437702; ANNOT 1437702; CDNA 36572659; ANNOT 1455805; ANNOT 1455805; ANNOT 1529744; ANNOT 1529744; | 2229; 2230; 2231; 2350; 2351; 2352; 2353; 2354; 2355; 2356; 2357; 2358; 2359; 2360; 2383; 2384; 2385; 2386; 2387; 2388; 2389; 2390; 2391; 2392; 2393; 2481; 2482; 2483; 2492; 2493; 2494; 2495; 2496; 2497; 2498; 2499; 2500; 2630; 2631; 2632; 2633; 2634; 2705; 2706; 2707; 2708; 2709; 2710; 2711; 2779; 2780; 2781; 2782; 2783; 3049; 3050; 3051; 3135; 3136; 3137; 3138; 3139; 3140; 3141; 3142; 3143; 3144; 3145; 3146; 3147; 3148; 3149; 3150; 3151; 3152; 3153; 3154; 3155; 3156; 3157; 3158; 3159; 3160; 3161; 3162; 3163; 3164; 3165; 3166; 3167; 3173; 3174; 3175; 3176; 3177; 3361; 3362; 3363; 3388; 3389; 3390; 3641; 3642; 3643; 3644; 3645; 3704; 3705; 3706; 3707; 3708; 3748; 3749; 3750; 3751; 3752; 3884; 3885; 3886; 3887; 3888; 3889; 3961; 3962; 3963; 3964; 3965; 4005; 4006; 4007; 4048; 4049; 4050; 4051; 4052; |
| WHOLE PLANT | Biomass | Small | The plant is abnormally small. | Useful for modulating plant size | CLONE 332; ANNOT 1474923; CLONE 907; ANNOT 1502138; ANNOT 1502138; ANNOT 1449135; ANNOT 1449135; CLONE 1241; ANNOT 1453081; ANNOT 1515808; ANNOT 1442349; CLONE 1355; ANNOT 1515808; ANNOT 1469219; ANNOT 1469219; ANNOT 1462513; ANNOT 1462513; CLONE 1610; ANNOT 1454586; ANNOT 1454586; ANNOT 1475043; ANNOT 1475043; ANNOT 1507756; ANNOT 1507756; ANNOT 1469708; CLONE 2561; ANNOT 1450958; ANNOT 1450958; ANNOT 1456475; ANNOT 1456475; ANNOT 1446945; ANNOT 1446945; CLONE 3000; ANNOT 1518918; ANNOT 1518918; ANNOT 1535677; ANNOT 1535677; ANNOT 1482181; ANNOT 1482181; CLONE 3006; ANNOT 1472173; ANNOT 1472173; CLONE 3036; ANNOT 1456840; ANNOT 1456840; CLONE 3363; ANNOT 1445515; ANNOT 1445515; ANNOT 1461861; ANNOT 1461861; ANNOT 1449363; ANNOT 1449363; ANNOT 1465198; ANNOT 1465198; ANNOT 1518517; ANNOT 1518517; CLONE 3542; ANNOT 1471301; ANNOT 1471301; CLONE 3819; ANNOT 1441039; ANNOT 1441039; ANNOT 1482966; ANNOT 1482966; ANNOT 1454656; ANNOT 1454656; ANNOT 1528263; ANNOT 1528263; ANNOT 1464899; ANNOT | 12; 13; 14; 30; 31; 32; 33; 34; 38; 39; 40; 41; 42; 43; 44; 45; 46; 47; 48; 49; 67; 68; 69; 70; 71; 72; 73; 74; 75; 104; 105; 106; 107; 108; 109; 110; 111; 112; 113; 114; 115; 116; 117; 118; 119; 120; 121; 122; 123; 129; 130; 131; 132; 133; 134; 135; 136; 137; 138; 139; 145; 146; 147; 153; 154; 155; 156; 157; 158; 159; 160; 161; 162; 163; 164; 165; 166; 167; 168; 169; 175; 176; 177; 178; 179; |

TABLE 1-continued

| Tissue | Phenotype Category | Phenotype | Phenotype Description | Applications | Ceres ID | SEQ ID NO |
|---|---|---|---|---|---|---|
| | | | | | 1464899; ANNOT 1458103; ANNOT 1458103; ANNOT 1442040; ANNOT 1442040; ANNOT 1520449; ANNOT 1520449; CLONE 3858; ANNOT 1459068; ANNOT 1459068; CLONE 3997; ANNOT 1455209; ANNOT 1455209; ANNOT 1446198; ANNOT 1446198; CLONE 3997; ANNOT 1490273; ANNOT 1490273; ANNOT 1530603; ANNOT 1530603; CLONE 4058; ANNOT 1468992; ANNOT 1468992; ANNOT 1444098; ANNOT 1444098; CLONE 4058; ANNOT 1474224; ANNOT 1474224; ANNOT 1524351; ANNOT 1524351; CLONE 5055; ANNOT 1438157; ANNOT 1438157; ANNOT 1500936; ANNOT 1500936; CLONE 5167; ANNOT 1465422; ANNOT 1465422; ANNOT 1457750; ANNOT 1457750; ANNOT 1513544; CLONE 5198; ANNOT 1472153; ANNOT 1472153; CLONE 5605; ANNOT 1437939; ANNOT 1437939; CLONE 5710; ANNOT 1464658; ANNOT 1464658; ANNOT 1458337; ANNOT 1458337; ANNOT 1454234; ANNOT 1454234; ANNOT 1475996; ANNOT 1475996; CLONE 6082; ANNOT 1443416; ANNOT 1443416; ANNOT 1505047; ANNOT 1505047; ANNOT 1496339; ANNOT 1496339; CLONE 6411; ANNOT 1505322; ANNOT 1505322; ANNOT 1496110; ANNOT 1496110; ANNOT 1496111; ANNOT 1496111; CLONE 6630; ANNOT 1529141; ANNOT 1529141; ANNOT 1475689; ANNOT 1475689; ANNOT 1476577; ANNOT 1476577; CLONE 7191; ANNOT 1493787; ANNOT 1493787; CLONE 8254; ANNOT 1543042; ANNOT 1543042; ANNOT 1489655; ANNOT 1489655; CLONE 8265; ANNOT 1438919; ANNOT 1438919; ANNOT 1499398; ANNOT 1499398; ANNOT 1446419; ANNOT 1446419; CLONE 9221; ANNOT 1535229; ANNOT 1535229; CLONE 9683; ANNOT 1471514; ANNOT 1471514; CLONE 9897; ANNOT 1445849; ANNOT 1445849; ANNOT 1500561; ANNOT 1500561; ANNOT 1464458; ANNOT 1464458; CLONE 10159; ANNOT 1439969; ANNOT 1439969; CLONE 10879; ANNOT 1467184; ANNOT 1467184; ANNOT 1467184; CLONE 11214; ANNOT 1501485; ANNOT 1501485; ANNOT 1490496; ANNOT 1490496; ANNOT 1448498; ANNOT 1448498; ANNOT 1474848; ANNOT 1474848; CLONE 11843; ANNOT 1443460; ANNOT 1443460; ANNOT 1504967; ANNOT 1504967; CLONE 11854; ANNOT 1506763; ANNOT 1506763; ANNOT 1452827; ANNOT 1452827; CLONE 13757; ANNOT 1471425; ANNOT 1471425; ANNOT 1453614; ANNOT 1453614; CLONE 11975; ANNOT 1460142; ANNOT 1460142; ANNOT 1460142; ANNOT 1483807; ANNOT 1483807; CLONE 12071; ANNOT 1466704; ANNOT 1466704; CLONE 12272; ANNOT 1506387; ANNOT 1506387; ANNOT 1474522; ANNOT 1474522; CLONE 12993; ANNOT 1479464; ANNOT 1479464; CLONE 13092; ANNOT 1471785; ANNOT 1471785; CLONE 13186; ANNOT 1464566; ANNOT 1464566; ANNOT 1458408; ANNOT 1458408; CLONE 13625; ANNOT 1455211; ANNOT 1455211; CLONE 13745; ANNOT 1442604; ANNOT 1442604; ANNOT 1442612; ANNOT 1442612; ANNOT 1442608; ANNOT 1442608; ANNOT 1452827; ANNOT 1452827; CLONE 13757; ANNOT 1471425; ANNOT 1471425; CLONE 13767; ANNOT 1542158; ANNOT 1542158; ANNOT 1488730; ANNOT 1488730; CLONE 13800; ANNOT 1458335; ANNOT 1458335; ANNOT 1464663; ANNOT 1464663; CLONE 14033; ANNOT 1480322; ANNOT 1480322; ANNOT 1493735; ANNOT 1493735; CLONE 14555; ANNOT 1511392; ANNOT 1511392; ANNOT 1511392; ANNOT 1469356; ANNOT 1469356; ANNOT 1517500; ANNOT 1517500; CLONE 14909; ANNOT 1497838; ANNOT 1497838; ANNOT 1522523; ANNOT 1522523; ANNOT 1471525; ANNOT 1471525; ANNOT 1511908; ANNOT 1511908; ANNOT 1464305; ANNOT 1464305; ANNOT 1451416; ANNOT 1451416; ANNOT 1461050; ANNOT 1461050; CLONE 16461; ANNOT 1479013; ANNOT 1479013; CLONE 17409; ANNOT 1457617; ANNOT 1457617; ANNOT 1465289; ANNOT 1465289; ANNOT 1478647; ANNOT 1478647; ANNOT 1453865; ANNOT 1453865; CLONE 17434; ANNOT 1455741; ANNOT 1455741; ANNOT 1477832; ANNOT 1477832; | 180; 181; 182; 183; 184; 185; 186; 187; 188; 189; 190; 191; 192; 193; 194; 195; 215; 216; 217; 218; 219; 223; 224; 225; 226; 227; 228; 229; 230; 231; 232; 238; 239; 240; 241; 242; 243; 244; 245; 246; 247; 248; 249; 268; 269; 270; 271; 272; 273; 274; 293; 294; 295; 296; 297; 298; 299; 305; 306; 307; 308; 309; 310; 311; 317; 318; 319; 357; 358; 359; 360; 361; 362; 363; 364; 365; 366; 367; 368; 394; 395; 396; 402; 403; 404; 405; 406; 407; 408; 409; 410; 411; 428; 429; 430; 437; 438; 439; 448; 449; 450; 451; 452; 453; 454; 455; 456; 470; 471; 472; 473; 474; 475; 476; 477; 478; 479; 502; 503; 504; 505; 506; 507; 508; 509; 515; 516; 517; 518; 519; 520; 521; 522; 528; 529; 530; 531; 532; 533; 534; 535; 544; 545; 546; 555; 556; 557; 558; 559; 560; 561; 562; 563; 564; 565; 566; 567; 568; 569; 570; 571; 572; 573; 574; 575; 576; 582; 583; 584; 585; 586; 608; 609; 610; 611; 612; 613; 614; 615; 616; 617; 618; 626; 627; 628; 629; 630; 631; 632; 633; 634; 635; 636; 637; 638; 639; 640; 647; 648; 649; 678; 679; 680; 681; 682; 683; 684; 685; 686; 687; 688; 689; 690; 691; 695; 696; 697; 698; 699; 700; 701; 702; 703; 704; 705; 706; 707; 708; 709; 720; 721; 722; 723; 724; 735; 736; 737; 738; 739; 740; 741; 742; 743; 744; 745; 746; 747; 748; 749; 767; |

TABLE 1-continued

| Tissue | Phenotype Category | Phenotype | Phenotype Description | Applications | Ceres ID | SEQ ID NO |
|---|---|---|---|---|---|---|
| | | | | | CLONE 17632; ANNOT 1474847; ANNOT 1474847; ANNOT 1507835; ANNOT 1507835; CLONE 17761; ANNOT 1481206; ANNOT 1481206; ANNOT 1534689; ANNOT 1534689; CLONE 17912; ANNOT 1514378; ANNOT 1514378; ANNOT 1494118; ANNOT 1494118; CLONE 18612; ANNOT 1522299; ANNOT 1522299; ANNOT 1527718; ANNOT 1527718; CLONE 19116; ANNOT 1467522; ANNOT 1467522; ANNOT 1467522; ANNOT 1526421; CLONE 19143; ANNOT 1442860; ANNOT 1442860; ANNOT 1442860; ANNOT 1459442; ANNOT 1452580; ANNOT 1452580; CLONE 19188; ANNOT 1445089; ANNOT 1445089; CLONE 19486; ANNOT 1452204; ANNOT 1452204; ANNOT 1443204; CLONE 19510; ANNOT 1501412; ANNOT 1501412; ANNOT 1490383; ANNOT 1490383; ANNOT 1448419; ANNOT 1448419; CLONE 20945; ANNOT 1519797; ANNOT 1519797; CLONE 21068; ANNOT 1463333; ANNOT 1463333; ANNOT 1505772; ANNOT 1505772; ANNOT 1495675; ANNOT 1495675; ANNOT 1469576; ANNOT 1469576; ANNOT 1442758; ANNOT 1442758; CLONE 21563; ANNOT 1438905; ANNOT 1438905; ANNOT 1483143; ANNOT 1483143; CLONE 23322; ANNOT 1512337; ANNOT 1517094; ANNOT 1517094; CLONE 23518; ANNOT 1475658; ANNOT 1475658; ANNOT 1449267; ANNOT 1449267; ANNOT 1507191; ANNOT 1507191; CLONE 23523; ANNOT 1453919; ANNOT 1453919; CLONE 23771; ANNOT 1444030; ANNOT 1444030; ANNOT 1486813; ANNOT 1486813; ANNOT 1485303; ANNOT 1485303; ANNOT 1446796; ANNOT 1446796; CLONE 24644; ANNOT 1463301; ANNOT 1463301; ANNOT 1459811; ANNOT 1459811; CLONE 24885; ANNOT 1485102; ANNOT 1485102; CLONE 25380; ANNOT 1512618; ANNOT 1512618; ANNOT 1459357; ANNOT 1459357; ANNOT 1463526; ANNOT 1463526; CLONE 25538; ANNOT 1480776; ANNOT 1480776; CLONE 25796; ANNOT 1522583; ANNOT 1522583; CLONE 25886; ANNOT 1446650; ANNOT 1446650; ANNOT 1439514; ANNOT 1439514; ANNOT 1477202; ANNOT 1477202; ANNOT 1455325; ANNOT 1455325; CLONE 26542; ANNOT 1475323; ANNOT 1475323; ANNOT 1538272; ANNOT 1538272; CLONE 26560; ANNOT 1536088; ANNOT 1536088; ANNOT 1482610; ANNOT 1482610; CLONE 26637; ANNOT 1451045; ANNOT 1451045; CLONE 26907; ANNOT 1484074; ANNOT 1484074; ANNOT 1440016; ANNOT 1440016; ANNOT 1477202; ANNOT 1518242; ANNOT 1518242; ANNOT 1448819; ANNOT 1448819; ANNOT 1465787; ANNOT 1465787; ANNOT 1465787; ANNOT 1474460; ANNOT 1474847; ANNOT 1474847; ANNOT 1507835; CLONE 27460; CLONE 27464; ANNOT 1453044; ANNOT 1453044; ANNOT 1507835; ANNOT 1507835; ANNOT 1451171; ANNOT 1451171; CLONE 28033; ANNOT 1459086; ANNOT 1459086; CLONE 28528; ANNOT 1477416; ANNOT 1477416; CLONE 28602; ANNOT 1461728; ANNOT 1461728; ANNOT 1488330; ANNOT 1488330; ANNOT 1479711; ANNOT 1460480; ANNOT 1460480; ANNOT 1461614; ANNOT 1461614; ANNOT 1479711; ANNOT 1479711; ANNOT 1479712; ANNOT 1479712; ANNOT 1488329; ANNOT 1488329; ANNOT 1488329; ANNOT 1460481; ANNOT 1460481; ANNOT 1461613; ANNOT 1461613; ANNOT 1458198; ANNOT 1458198; ANNOT 1488327; ANNOT 1488327; CLONE 31014; ANNOT 1527449; ANNOT 1527449; ANNOT 1484207; ANNOT 1484207; CLONE 31044; ANNOT 1486207; ANNOT 1486207; ANNOT 1446894; ANNOT 1446894; ANNOT 1496976; ANNOT 1496976; CLONE 32082; ANNOT 1446894; ANNOT 1446894; ANNOT 1543513; ANNOT 1543513; CLONE 32348; ANNOT 1470719; ANNOT 1470719; ANNOT 1543728; ANNOT 1543728; ANNOT 1482066; ANNOT 1482066; CLONE 32548; ANNOT 1450324; ANNOT 1450324; ANNOT 1460836; ANNOT 1460836; CLONE 32612; ANNOT 1484890; ANNOT 1484890; CLONE 32737; ANNOT 1536373; ANNOT 1536373; ANNOT 1451171; ANNOT 1482905; ANNOT 1482905; CLONE 32751; ANNOT 1480607; ANNOT 1480607; ANNOT 1451171; CLONE 32753; ANNOT 1480607; ANNOT 1480607; | 768; 769; 770; 771; 772; 773; 774; 775; 776; 777; 778; 818; 819; 820; 821; 822; 823; 824; 825; 826; 827; 828; 829; 830; 831; 842; 843; 844; 845; 846; 897; 898; 899; 900; 901; 907; 908; 909; 910; 911; 912; 913; 914; 915; 916; 928; 929; 930; 931; 932; 933; 934; 935; 936; 944; 945; 946; 947; 948; 949; 950; 951; 960; 961; 962; 963; 964; 965; 966; 967; 968; 969; 983; 984; 985; 986; 987; 988; 989; 990; 991; 992; 993; 994; 1010; 1011; 1012; 1013; 1014; 1015; 1016; 1017; 1018; 1019; 1020; 1021; 1022; 1043; 1044; 1045; 1046; 1047; 1048; 1049; 1050; 1051; 1052; 1053; 1054; 1055; 1056; 1057; 1058; 1059; 1060; 1061; 1062; 1063; 1064; 1085; 1086; 1087; 1096; 1097; 1098; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1185; 1186; 1187; 1188; 1189; 1190; 1191; 1192; 1193; 1194; 1201; 1202; 1203; 1204; 1205; 1219; 1220; 1221; 1222; 1223; 1224; 1225; 1231; 1232; 1233; 1234; 1235; 1236; 1237; 1238; 1242; 1243; 1244; 1245; 1246; 1247; 1248; 1249; 1250; 1251; 1252; 1253; 1254; 1255; 1256; 1257; 1263; 1264; 1265; 1266; 1267; 1287; 1288; 1289; 1290; 1291; 1292; 1293; 1294; 1295; 1296; 1297; 1298; 1299; 1300; 1301; 1302; 1303; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1472242; ANNOT 1472242; CLONE 3791; ANNOT 1540248; ANNOT 1540248; CLONE 33232; ANNOT 1504045; ANNOT 1504045; ANNOT 1450983; ANNOT 1450983; CLONE 33554; ANNOT 1445599; ANNOT 1445599; ANNOT 1471882; ANNOT 1471882; ANNOT 1452398; ANNOT 1452398; ANNOT 1443041; ANNOT 1443041; ANNOT 1452397; ANNOT 1452397; ANNOT 1505498; ANNOT 1505498; ANNOT 1505497; ANNOT 1505497; ANNOT 1443040; ANNOT 1443040; ANNOT 1495964; ANNOT 1495964; ANNOT 1498580; ANNOT 1498580; ANNOT 1495637; ANNOT 1495637; ANNOT 1466060; CLONE 33802; ANNOT 1452709; ANNOT 1452709; ANNOT 1442724; ANNOT 1442724; CLONE 34167; ANNOT 1538733; ANNOT 1538733; ANNOT 1499810; ANNOT 1499810; ANNOT 1485323; ANNOT 1485323; CLONE 34385; ANNOT 1445331; ANNOT 1445331; ANNOT 1498316; ANNOT 1498316; CLONE 34412; ANNOT 1449739; ANNOT 1449739; ANNOT 1449738; ANNOT 1449738; ANNOT 1458830; ANNOT 1458830; CLONE 34480; ANNOT 1502362; ANNOT 1502362; ANNOT 1449358; ANNOT 1449358; CLONE 34549; ANNOT 1442496; ANNOT 1442496; CLONE 34552; ANNOT 1516449; ANNOT 1516449; ANNOT 1512976; ANNOT 1512976; ANNOT 34612; CLONE 34612; ANNOT 1479009; ANNOT 1479009; ANNOT 1469640; ANNOT 1469640; CLONE 34635; ANNOT 1487773; ANNOT 1487773; ANNOT 1457333; ANNOT 1457333; ANNOT 1442634; ANNOT 1442634; CLONE 34783; ANNOT 1466952; ANNOT 1466952; ANNOT 1523551; ANNOT 1523551; ANNOT 1470164; ANNOT 1470164; CLONE 34976; ANNOT 1507231; ANNOT 1507231; CLONE 35015; ANNOT 1443033; ANNOT 1443033; ANNOT 1438730; CLONE 1438730; ANNOT 1452408; ANNOT 1452408; ANNOT 1505508; ANNOT 1505508; CLONE 35733; ANNOT 1486258; ANNOT 1486258; ANNOT 1443988; ANNOT 1443988; CLONE 35742; ANNOT 1478035; ANNOT 1478035; CLONE 35999; ANNOT 1515818; ANNOT 1515818; CLONE 36094; ANNOT 1440660; ANNOT 1440660; CLONE 36518; ANNOT 1471507; ANNOT 1471507; ANNOT 1444893; ANNOT 1444893; ANNOT 1458642; ANNOT 1458642; ANNOT 1522497; ANNOT 1522497; ANNOT 1469105; ANNOT 1469105; ANNOT 1484993; ANNOT 1484993; CLONE 36709; ANNOT 1495936; ANNOT 1495936; CLONE 36891; ANNOT 1480518; ANNOT 1480518; ANNOT 1442194; ANNOT 1442194; ANNOT 1454127; ANNOT 1454127; ANNOT 1461716; ANNOT 1461716; ANNOT 1440277; ANNOT 1440277; ANNOT 1461415; ANNOT 1461415; ANNOT 1461414; ANNOT 1461414; ANNOT 1447424; ANNOT 1447424; ANNOT 1528127; ANNOT 1528127; ANNOT 1438717; ANNOT 1438717; ANNOT 1440276; ANNOT 1440276; ANNOT 1442556; ANNOT 1442556; ANNOT 1452873; ANNOT 1452873; ANNOT 1453483; ANNOT 1453483; ANNOT 1473384; ANNOT 1473384; ANNOT 1475808; ANNOT 1475808; ANNOT 1474708; ANNOT 1474708; ANNOT 1438698; ANNOT 1438698; CLONE 36904; ANNOT 1526083; ANNOT 1526083; ANNOT 1498856; ANNOT 1498856; ANNOT 1445872; ANNOT 1445872; ANNOT 1472663; ANNOT 1472663; CLONE 37019; ANNOT 1517849; ANNOT 1517849; ANNOT 1511684; ANNOT 1511684; ANNOT 1464532; ANNOT 1464532; ANNOT 1458439; ANNOT 1458439; ANNOT 1540674; ANNOT 1540674; CLONE 37229; ANNOT 1485157; ANNOT 1485157; ANNOT 1476218; ANNOT 1476218; CLONE 37298; ANNOT 1476538; ANNOT 1476538; ANNOT 1493576; ANNOT 1493576; CLONE 37493; ANNOT 1494370; ANNOT 1494370; ANNOT 1441478; ANNOT 1441478; ANNOT 1486562; ANNOT 1486562; CLONE 37543; ANNOT 1539972; ANNOT 1539972; ANNOT 1443794; ANNOT 1443794; CLONE 37589; ANNOT 1496735; ANNOT 1496735; ANNOT 1443794; ANNOT 1443794; CLONE 37658; ANNOT 1440727; ANNOT 1440727; ANNOT 1497485; ANNOT 1497485; ANNOT 1497485; ANNOT 1454656; ANNOT 1454656; ANNOT 1528263; CLONE 38101; | 1304; 1305; 1306; 1307; 1308; 1309; 1321; 1322; 1323; 1324; 1325; 1326; 1327; 1343; 1344; 1345; 1346; 1347; 1348; 1349; 1364; 1365; 1366; 1367; 1368; 1376; 1377; 1378; 1379; 1380; 1381; 1382; 1398; 1399; 1400; 1401; 1402; 1403; 1404; 1405; 1406; 1407; 1408; 1409; 1410; 1411; 1412; 1413; 1414; 1415; 1416; 1417; 1418; 1419; 1420; 1421; 1422; 1423; 1424; 1425; 1426; 1427; 1428; 1429; 1435; 1436; 1437; 1438; 1439; 1440; 1441; 1442; 1443; 1444; 1445; 1446; 1447; 1476; 1477; 1478; 1479; 1480; 1481; 1482; 1483; 1487; 1488; 1489; 1490; 1491; 1492; 1505; 1506; 1507; 1508; 1509; 1510; 1511; 1512; 1513; 1514; 1515; 1516; 1517; 1545; 1546; 1547; 1548; 1549; 1550; 1551; 1552; 1553; 1554; 1555; 1556; 1557; 1558; 1559; 1560; 1561; 1562; 1563; 1564; 1565; 1566; 1567; 1568; 1569; 1570; 1571; 1572; 1573; 1574; 1575; 1576; 1577; 1578; 1579; 1580; 1581; 1582; 1583; 1584; 1585; 1586; 1587; 1588; 1589; 1590; 1591; 1592; 1593; 1599; 1600; 1601; 1602; 1603; 1604; 1605; 1606; 1607; 1608; 1609; 1617; 1618; 1619; 1620; 1621; 1625; 1626; 1627; 1628; 1629; 1637; 1638; 1639; 1640; 1641; 1642; 1643; 1644; 1645; 1646; 1647; 1648; 1649; 1650; 1651; 1652; 1653; 1654; 1655; 1656; 1682; 1683; 1684; 1685; 1686; 1687; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1528263; ANNOT 1458103; ANNOT 1458103; ANNOT 1464899; ANNOT 1464899; ANNOT 1482966; ANNOT 1482966; ANNOT 1441039; ANNOT 1441039; ANNOT 1520449; ANNOT 1520449; CLONE 38105; ANNOT 1473032; ANNOT 1473032; ANNOT 1467499; ANNOT 1467499; ANNOT 1526442; ANNOT 1526442; CLONE 38277; ANNOT 1512884; ANNOT 1512884; CLONE 38370; ANNOT 1471869; ANNOT 1471869; ANNOT 1448032; ANNOT 1448032; ANNOT 1448031; ANNOT 1448031; ANNOT 1438060; ANNOT 1438060; ANNOT 1438061; ANNOT 1438061; ANNOT 1448030; ANNOT 1448030; ANNOT 1437831; ANNOT 1437831; ANNOT 38419; ANNOT 1542971; ANNOT 1542971; ANNOT 1521332; ANNOT 1521332; ANNOT 1528846; ANNOT 1528846; ANNOT 1467961; ANNOT 1467961; CLONE 38757; ANNOT 1528846; ANNOT 1528846; ANNOT 1538329; ANNOT 1538329; CLONE 38843; ANNOT 1447896; ANNOT 1447896; ANNOT 1438197; ANNOT 1438197; CLONE 39286; ANNOT 1447961; ANNOT 1447961; ANNOT 1490936; ANNOT 1490936; CLONE 39319; ANNOT 1456036; ANNOT 1456036; ANNOT 1470131; ANNOT 1470131; ANNOT 1466936; ANNOT 1466936; ANNOT 1541455; ANNOT 1541455; ANNOT 1456037; CLONE 39740; ANNOT 1483180; ANNOT 1483180; ANNOT 1480950; ANNOT 1480950; CLONE 39890; ANNOT 1511886; ANNOT 1511886; ANNOT 1517635; ANNOT 1517635; CLONE 40508; ANNOT 1453626; ANNOT 1453626; CLONE 40538; ANNOT 1452757; ANNOT 1452757; CLONE 40692; ANNOT 1455695; ANNOT 1455695; CLONE 40729; ANNOT 1481678; ANNOT 1481678; CLONE 40824; ANNOT 1509015; ANNOT 1509015; ANNOT 1535964; ANNOT 1535962; ANNOT 1535962; ANNOT 1458815; ANNOT 1455815; ANNOT 1455817; ANNOT 1455817; ANNOT 1482502; ANNOT 1482502; ANNOT 1482502; ANNOT 1527449; ANNOT 1509035; ANNOT 1509035; ANNOT 1482477; ANNOT 1482477; ANNOT 1509013; ANNOT 1509013; ANNOT 1535990; ANNOT 1535990; ANNOT 1455837; ANNOT 1455837; CLONE 41306; ANNOT 1475806; ANNOT 1475806; ANNOT 1454125; ANNOT 1454125; CLONE 41320; ANNOT 1541929; ANNOT 1541929; ANNOT 1460282; ANNOT 1460282; ANNOT 1488507; ANNOT 1488507; CLONE 41439; CLONE 42141; ANNOT 1473839; ANNOT 1473839; CLONE 42925; ANNOT 1462354; ANNOT 1462354; CLONE 92670; ANNOT 1531919; ANNOT 1531919; CLONE 93867; ANNOT 1474944; ANNOT 1474944; ANNOT 1506849; ANNOT 1506849; ANNOT 1492957; ANNOT 1492957; CLONE 95135; ANNOT 1527449; ANNOT 1537653; ANNOT 1537653; ANNOT 1473733; ANNOT 1473733; ANNOT 1468537; ANNOT 1468537; CLONE 95453; ANNOT 1460836; ANNOT 1460836; ANNOT 1450324; ANNOT 1450324; CLONE 95677; ANNOT 1459723; ANNOT 1459723; ANNOT 1516455; ANNOT 1516455; CLONE 96020; ANNOT 1450365; ANNOT 1450365; ANNOT 1460794; ANNOT 1460794; CLONE 97434; ANNOT 1488311; ANNOT 1488311; ANNOT 1518776; ANNOT 1518776; CLONE 99784; ANNOT 1521032; ANNOT 1521032; ANNOT 1472909; ANNOT 1472909; ANNOT 1467665; ANNOT 1467665; ANNOT 100047; ANNOT 1532164; ANNOT 1532164; ANNOT 1479341; ANNOT 1479341; ANNOT 1479350; ANNOT 1479350; ANNOT 1442450; CLONE 100245; ANNOT 1535451; ANNOT 1535451; ANNOT 1532285; ANNOT 1532285; ANNOT 1480241; ANNOT 1480241; ANNOT 1446025; CLONE 100319; ANNOT 1503141; ANNOT 1503141; ANNOT 1521524; ANNOT 1521524; CLONE 100465; ANNOT 1466439; ANNOT 1466439; ANNOT 1448977; ANNOT 1448977; ANNOT 1519767; ANNOT 1519767; ANNOT 1501982; ANNOT 1501982; CLONE 101798; ANNOT 1449432; ANNOT 1449432; ANNOT 1449431; ANNOT 1449431; ANNOT 1502439; CLONE 102017; ANNOT 1448974; ANNOT 1448974; ANNOT 1496840; ANNOT | 1688; 1689; 1690; 1691; 1692; 1693; 1694; 1695; 1696; 1697; 1698; 1699; 1700; 1701; 1702; 1703; 1714; 1715; 1716; 1732; 1733; 1734; 1735; 1736; 1737; 1738; 1739; 1740; 1741; 1742; 1743; 1744; 1745; 1746; 1747; 1748; 1749; 1750; 1751; 1752; 1753; 1791; 1792; 1793; 1794; 1795; 1801; 1802; 1803; 1804; 1805; 1838; 1839; 1840; 1841; 1842; 1843; 1844; 1845; 1846; 1847; 1848; 1849; 1850; 1851; 1852; 1853; 1877; 1878; 1879; 1880; 1881; 1882; 1883; 1884; 1885; 1886; 1912; 1913; 1914; 1915; 1916; 1917; 1918; 1919; 1920; 1930; 1931; 1932; 1939; 1940; 1941; 1942; 1943; 1944; 1945; 1946; 1947; 1948; 1949; 1950; 1951; 1952; 1953; 1954; 1955; 1956; 1957; 1958; 1959; 1960; 1961; 1976; 1977; 1978; 1979; 1980; 1981; 1982; 1983; 1984; 1985; 1986; 1987; 1998; 2015; 2016; 2017; 2045; 2046; 2047; 2061; 2062; 2063; 2064; 2065; 2066; 2067; 2068; 2069; 2070; 2076; 2077; 2078; 2079; 2080; 2081; 2082; 2083; 2084; 2085; 2086; 2087; 2088; 2089; 2090; 2091; 2092; 2093; 2094; 2095; 2096; 2097; 2098; 2099; 2103; 2104; 2105; 2106; 2107; 2161; 2162; 2163; 2164; 2165; 2166; 2167; 2173; 2174; 2175; 2176; 2177; 2178; 2179; 2180; 2181; 2182; 2183; 2184; 2185; 2186; 2187; 2188; 2189; 2190; 2191; 2192; 2193; 2194; 2195; |

TABLE 1-continued

| Tissue | Phenotype Category | Phenotype | Phenotype Description | Applications | Ceres ID | SEQ ID NO |
|---|---|---|---|---|---|---|
| | | | | | 1496840; CLONE 104929; ANNOT 1449020; CLONE 108056; ANNOT 1464935; ANNOT 1464935; ANNOT 1458064; ANNOT 1458064; ANNOT 1511298; ANNOT 1511298; ANNOT 1458065; ANNOT 1458065; ANNOT 1511299; ANNOT 1511299; CLONE 110454; CLONE 111209; ANNOT 1494507; ANNOT 1494507; CLONE 113719; ANNOT 1513206; ANNOT 1513206; ANNOT 1516003; ANNOT 1516003; ANNOT 1462703; CLONE 113990; ANNOT 1438327; ANNOT 1438327; ANNOT 1447769; ANNOT 1447769; CLONE 114602; ANNOT 1450785; ANNOT 1450785; ANNOT 1456283; ANNOT 1456283; ANNOT 1460638; ANNOT 1460638; ANNOT 1513900; ANNOT 1513900; ANNOT 1540271; ANNOT 1540271; CLONE 115975; ANNOT 1507138; ANNOT 1507138; CLONE 116117; ANNOT 1456955; ANNOT 1456955; ANNOT 1451365; ANNOT 1451365; ANNOT 1504433; ANNOT 1504433; CLONE 116237; ANNOT 1455816; ANNOT 1455816; ANNOT 1482502; ANNOT 1482502; ANNOT 1482508; ANNOT 1482508; CLONE 1535990; ANNOT 1535990; ANNOT 1509013; ANNOT 1509013; CLONE 119256; ANNOT 1469636; ANNOT 1469636; ANNOT 1479002; ANNOT 1479002; CLONE 123279; ANNOT 1508945; ANNOT 1508945; ANNOT 1531332; ANNOT 1531332; ANNOT 1482544; ANNOT 1482544; ANNOT 1478226; ANNOT 1478226; CLONE 124720; ANNOT 1441430; ANNOT 1441430; CLONE 141890; ANNOT 1494533; ANNOT 1494533; ANNOT 1466313; ANNOT 1466313; CLONE 147358; ANNOT 1493111; ANNOT 1493111; ANNOT 1461452; ANNOT 1461452; CLONE 147593; ANNOT 1475653; ANNOT 1475653; ANNOT 1458131; ANNOT 1458131; ANNOT 1461780; ANNOT 1461780; CLONE 148943; ANNOT 1472949; ANNOT 1472949; CLONE 149380; ANNOT 1461440; ANNOT 1461440; ANNOT 1461430; ANNOT 1461430; ANNOT 1461427; ANNOT 1461427; ANNOT 1440253; ANNOT 1440253; ANNOT 1440253; CLONE 150912; ANNOT 1533910; ANNOT 1533910; ANNOT 1480439; ANNOT 1480439; CLONE 152076; ANNOT 1493664; ANNOT 1493664; CLONE 152141; ANNOT 1439403; ANNOT 1439403; CLONE 154718; ANNOT 1457453; ANNOT 1457453; CLONE 157547; ANNOT 1473898; ANNOT 1473898; CLONE 158333; ANNOT 1466505; ANNOT 1466505; ANNOT 1449026; ANNOT 1449026; CLONE 158734; ANNOT 1477956; ANNOT 1477956; CLONE 159318; ANNOT 1485362; ANNOT 1485362; CLONE 205648; ANNOT 1456842; ANNOT 1456842; ANNOT 1504224; ANNOT 1504224; CLONE 225200; ANNOT 1471976; ANNOT 1471976; ANNOT 1465507; ANNOT 1465507; CLONE 225601; ANNOT 1457617; ANNOT 1457617; ANNOT 1465289; ANNOT 1465289; ANNOT 1478647; ANNOT 1478647; ANNOT 1453865; ANNOT 1453865; ANNOT 1438014; ANNOT 1438014; CLONE 235706; ANNOT 1462351; ANNOT 1462351; ANNOT 1469462; ANNOT 1469462; ANNOT 1488821; ANNOT 1488821; CLONE 241379; ANNOT 1526950; ANNOT 1526950; ANNOT 1477361; ANNOT 1508362; ANNOT 1508362; ANNOT 1477361; CLONE 254065; ANNOT 1485544; ANNOT 1485544; ANNOT 1447051; ANNOT 1447051; ANNOT 1517016; ANNOT 1517016; CLONE 262460; ANNOT 1530053; ANNOT 1530053; ANNOT 1493414; ANNOT 1493414; CLONE 264705; ANNOT 1485750; ANNOT 1485750; ANNOT 1440730; ANNOT 1440730; CLONE 266142; ANNOT 1449110; ANNOT 1449110; ANNOT 1448105; ANNOT 1448105; CLONE 267564; ANNOT 1473933; ANNOT 1473933; ANNOT 1468704; ANNOT 1468704; CLONE 267626; ANNOT 1484074; ANNOT 1484074; ANNOT 1518242; ANNOT 1518242; ANNOT 1464923; ANNOT 1464923; CLONE 268505; ANNOT 1496682; ANNOT 1496682; ANNOT 1443744; ANNOT 1443744; CLONE 283597; ANNOT 1482074; ANNOT 1482074; ANNOT 1453923; ANNOT 1453923; CLONE 292789; ANNOT 1442040; ANNOT 1442040; ANNOT 1482966; ANNOT 1482966; ANNOT 1454656; ANNOT 1454656; ANNOT 1458103; ANNOT 1458103; ANNOT | 2196; 2197; 2198; 2199; 2200; 2201; 2202; 2203; 2204; 2219; 2220; 2221; 2222; 2223; 2224; 2225; 2226; 2227; 2228; 2232; 2233; 2234; 2235; 2236; 2237; 2238; 2239; 2281; 2282; 2283; 2284; 2285; 2286; 2287; 2288; 2289; 2290; 2291; 2313; 2314; 2315; 2316; 2333; 2334; 2335; 2336; 2337; 2338; 2339; 2340; 2341; 2342; 2343; 2344; 2350; 2351; 2352; 2353; 2354; 2355; 2356; 2357; 2358; 2359; 2360; 2373; 2374; 2375; 2376; 2377; 2378; 2379; 2380; 2381; 2382; 2383; 2384; 2385; 2386; 2387; 2388; 2389; 2390; 2391; 2392; 2393; 2451; 2452; 2453; 2454; 2455; 2492; 2493; 2494; 2495; 2496; 2497; 2498; 2499; 2500; 2501; 2502; 2503; 2523; 2524; 2525; 2526; 2527; 2528; 2529; 2530; 2531; 2532; 2533; 2534; 2535; 2536; 2537; 2538; 2539; 2543; 2544; 2545; 2546; 2547; 2548; 2549; 2550; 2551; 2552; 2553; 2554; 2555; 2556; 2557; 2558; 2559; 2565; 2566; 2567; 2568; 2569; 2570; 2577; 2578; 2579; 2593; 2594; 2595; 2611; 2612; 2613; 2614; 2615; 2619; 2620; 2621; 2622; 2623; 2624; 2625; 2626; 2627; 2628; 2629; 2655; 2656; 2657; 2658; 2659; 2665; 2666; 2667; 2668; 2669; 2670; 2671; 2672; 2673; 2674; 2675; 2705; 2706; 2707; 2708; 2709; 2710; 2711; 2718; 2719; 2720; 2721; 2722; 2723; 2724; 2731; 2732; 2733; 2734; 2735; |

TABLE 1-continued

| Tissue | Phenotype Category | Phenotype | Phenotype Description | Applications | Ceres ID | SEQ ID NO |
|---|---|---|---|---|---|---|
| | | | | | 1464899; ANNOT 1464899; ANNOT 1474837; ANNOT 1520449; ANNOT 1520449; ANNOT 1538169; ANNOT 1538169; ANNOT 1511505; ANNOT 1511505; CLONE 464504; ANNOT 1438401; ANNOT 1438401; CLONE 536457; ANNOT 1490030; ANNOT 1493787; ANNOT 1493787; CLONE 536726; ANNOT 1498226; ANNOT 1498226; ANNOT 1445243; ANNOT 1445243; ANNOT 1525386; ANNOT 1448522; ANNOT 1448522; ANNOT 1465506; ANNOT 1497017; ANNOT 1497017; ANNOT 1447240; ANNOT 1447240; ANNOT 1539566; ANNOT 1539566; ANNOT 1444070; ANNOT 1444070; CLONE 536796; ANNOT 1484779; ANNOT 1484779; ANNOT 1538185; ANNOT 1538185; ANNOT 1455109; ANNOT 1455109; ANNOT 1477384; ANNOT 1477384; CLONE 537272; ANNOT 1518918; ANNOT 1518918; ANNOT 1535677; ANNOT 1535677; CLONE 538933; ANNOT 1466193; ANNOT 1466193; ANNOT 1494416; ANNOT 1494416; CLONE 557009; ANNOT 1474923; ANNOT 1474923; CLONE 590462; ANNOT 1490788; ANNOT 1490788; ANNOT 1502230; ANNOT 1502230; CLONE 608818; ANNOT 1528780; ANNOT 1528780; ANNOT 1518351; ANNOT 1518351; ANNOT 1525569; ANNOT 1525569; ANNOT 1453192; ANNOT 1453192; ANNOT 1441586; ANNOT 1441586; ANNOT 1509714; ANNOT 1509714; CLONE 609573; ANNOT 1473808; ANNOT 1473808; ANNOT 1476668; ANNOT 1476668; ANNOT 1474436; ANNOT 1474436; ANNOT 1513750; ANNOT 1513750; ANNOT 1510994; ANNOT 1510994; ANNOT 1457771; ANNOT 1457771; CLONE 627596; ANNOT 1500987; ANNOT 1500987; ANNOT 1490915; ANNOT 1490915; CLONE 641355; ANNOT 1463335; ANNOT 1463335; ANNOT 1463334; ANNOT 1463334; ANNOT 1452665; ANNOT 1452665; CLONE 660003; ANNOT 1508184; ANNOT 1508184; ANNOT 1528645; ANNOT 1528645; CLONE 681088; ANNOT 1471330; ANNOT 1471330; ANNOT 1444437; ANNOT 1444437; ANNOT 1444439; ANNOT 1444439; ANNOT 1486891; ANNOT 1486891; ANNOT 1479637; ANNOT 1479637; ANNOT 1446530; ANNOT 1446530; CLONE 708342; ANNOT 1538185; ANNOT 1538185; CLONE 965175; ANNOT 1479013; ANNOT 1479013; CLONE 1002819; ANNOT 1474290; ANNOT 1474290; ANNOT 1522314; ANNOT 1522314; ANNOT 1497147; ANNOT 1497147; ANNOT 1471045; ANNOT 1471045; CLONE 1006934; ANNOT 1532963; ANNOT 1532963; CLONE 1007549; ANNOT 1458198; ANNOT 1458198; ANNOT 1439989; ANNOT 1439989; ANNOT 1464789; ANNOT 1464789; ANNOT 1461728; ANNOT 1461728; ANNOT 1479711; ANNOT 1479711; ANNOT 1440649; ANNOT 1440649; ANNOT 1464547; ANNOT 1464547; ANNOT 1454104; ANNOT 1454104; CLONE 1011386; ANNOT 1531134; ANNOT 1531134; ANNOT 1508758; ANNOT 1508758; CLONE 1011537; ANNOT 1473879; ANNOT 1473879; ANNOT 1468666; ANNOT 1468666; ANNOT 1438163; ANNOT 1438163; CLONE 1029167; ANNOT 1453409; ANNOT 1453409; ANNOT 1474630; ANNOT 1474630; ANNOT 1450948; ANNOT 1450948; CDNA 12672729; ANNOT 1500350; ANNOT 1500350; CDNA 23493481; ANNOT 1460973; ANNOT 1460973; CDNA 23494371; ANNOT 1485236; ANNOT 1485236; ANNOT 1446740; ANNOT 1446740; CDNA 23494432; CDNA 23495481; ANNOT 1485271; ANNOT 1485271; ANNOT 1447245; ANNOT 1447245; CDNA 23498145; ANNOT 1482362; ANNOT 1482362; ANNOT 1489077; ANNOT 1489077; CDNA 23505103; CDNA 23507479; ANNOT 1510416; ANNOT 1510416; ANNOT 1541253; ANNOT 1541253; CDNA 23345147; ANNOT 1443044; ANNOT 1443044; CDNA 36507011; ANNOT 1442604; ANNOT 1442604; ANNOT 1442612; ANNOT 1442612; ANNOT 1442608; ANNOT 1442608; ANNOT 1452827; ANNOT 1452827; CDNA 36514446; ANNOT 1460973; CDNA 23494371; ANNOT 1475322; ANNOT 1475322; CDNA 36534269; ANNOT 1457794; ANNOT 1457794; ANNOT 1524172; ANNOT 1524172; CDNA 36535618; ANNOT 1459998; ANNOT | 2736; 2737; 2774; 2775; 2776; 2777; 2778; 2779; 2780; 2781; 2782; 2783; 2784; 2785; 2786; 2787; 2788; 2789; 2790; 2791; 2792; 2793; 2794; 2795; 2796; 2797; 2798; 2799; 2800; 2806; 2807; 2808; 2809; 2810; 2833; 2834; 2835; 2836; 2837; 2852; 2853; 2854; 2855; 2856; 2857; 2858; 2859; 2860; 2861; 2862; 2863; 2864; 2865; 2866; 2867; 2868; 3003; 3004; 3005; 3006; 3007; 3008; 3130; 3131; 3132; 3133; 3134; 3135; 3136; 3137; 3138; 3139; 3140; 3141; 3142; 3143; 3144; 3145; 3146; 3147; 3148; 3149; 3150; 3151; 3152; 3153; 3154; 3155; 3156; 3157; 3158; 3159; 3160; 3161; 3162; 3163; 3164; 3165; 3166; 3167; 3168; 3169; 3170; 3171; 3172; 3221; 3222; 3223; 3255; 3256; 3257; 3258; 3259; 3273; 3274; 3275; 3276; 3277; 3278; 3279; 3280; 3281; 3282; 3283; 3284; 3285; 3286; 3287; 3288; 3289; 3290; 3291; 3292; 3293; 3294; 3295; 3296; 3297; 3298; 3299; 3300; 3301; 3302; 3303; 3304; 3305; 3306; 3307; 3308; 3309; 3310; 3314; 3315; 3316; 3317; 3318; 3345; 3346; 3347; 3348; 3349; 3350; 3351; 3352; 3353; 3354; 3355; 3356; 3357; 3361; 3362; 3363; 3388; 3389; 3390; 3428; 3429; 3430; 3431; 3432; 3433; 3434; 3435; 3436; 3437; 3438; 3439; 3440; 3441; 3442; 3443; 3444; 3445; 3446; 3447; 3448; 3449; 3450; 3451; 3452; |

TABLE 1-continued

| Tissue | Phenotype Category | Phenotype | Phenotype Description | Applications | Ceres ID | SEQ ID NO |
|---|---|---|---|---|---|---|
| | | | | | 1459998; ANNOT 1513263; CDNA 36566773; ANNOT 1464046; ANNOT 1464046; ANNOT 1458861; ANNOT 1458861; CDNA 36571789; ANNOT 1444156; ANNOT 1444156; ANNOT 1497097; CDNA 36575796; ANNOT 1486224; ANNOT 1486224; ANNOT 1444021; ANNOT 1444021; CDNA 36579424; ANNOT 1455663; ANNOT 1455663; ANNOT 1438024; ANNOT 1448068; ANNOT 1448068; CDNA 36697835; ANNOT 1451434; ANNOT 1451434; CDNA 36697835; ANNOT 1461440; ANNOT 1461427; ANNOT 1461427; ANNOT 1461430; ANNOT 1461440; ANNOT 1461253; ANNOT 1440253; ANNOT 1447690; ANNOT 1491278; ANNOT 1491278; ANNOT 1500987; ANNOT 1500987; ANNOT 1490915; ANNOT 1490915; | 3453; 3454; 3455; 3456; 3462; 3463; 3464; 3465; 3466; 3467; 3468; 3469; 3470; 3471; 3472; 3473; 3474; 3475; 3476; 3477; 3478; 3479; 3480; 3517; 3518; 3519; 3613; 3614; 3615; 3616; 3617; 3618; 3619; 3620; 3621; 3622; 3623; 3624; 3625; 3626; 3641; 3642; 3643; 3644; 3645; 3687; 3704; 3705; 3706; 3707; 3708; 3813; 3814; 3815; 3875; 3876; 3877; 3878; 3879; 3880; 3881; 3882; 3883; 3905; 3906; 3907; 3938; 3939; 3940; 3941; 3942; 3951; 3952; 3953; 3954; 3955; 4018; 4019; 4020; 4021; 4022; 4043; 4044; 4045; 4046; 4047; 4053; 4054; 4055; 4056; 4057; 4063; 4064; 4065; 4066; 4067; 4068; 4069; 4070; 4071; 4072; 4073; 4074; 4075; 4076; 4077; 4078; 4079; 4080; 4081; 3688; 3689; 3690; 3691; 3692; 3693; 3694; 3695; |
| CAULINE LEAVES | Biomass | Small | The cauline leaves are abnormally small. | Useful for making plants with increased biomass and foliage | CLONE 13757; ANNOT 1471425; ANNOT 1503551; ANNOT 1471425; CLONE 39351; ANNOT 1503551; ANNOT 1513952; ANNOT 1460689; ANNOT 1513952; ANNOT 1513952; ANNOT 1450495; ANNOT 1450495; CLONE 40508; ANNOT 1453626; ANNOT 1453626; CLONE 267657; ANNOT 1471473; ANNOT 1471473; ANNOT 1444931; ANNOT 1444931; | 564; 565; 566; 1854; 1855; 1856; 1857; 1858; 1859; 1860; 1861; 1862; 1912; 1913; 1914; 2801; 2802; 2803; 2804; 2805; |
| WHOLE PLANT | Biomass, Architecture | Standing Rosette Shaped | The petioles have a very large liminal angle, i.e., it appears as though the leaves are standing up instead of having their usual small vertical angle from the soil. | Useful for making plants with improved architecture and with increased biomass and foliage | CLONE 13757; ANNOT 1471425; CLONE 28602; ANNOT 1461728; ANNOT 1471425; CLONE 28602; ANNOT 1460480; ANNOT 1488330; ANNOT 1460480; ANNOT 1460480; ANNOT 1461614; ANNOT 1479711; ANNOT 1479711; ANNOT 1479712; ANNOT 1488329; ANNOT 1488329; ANNOT 1460481; ANNOT 1460481; ANNOT 1461613; ANNOT 1461613; ANNOT 1458198; ANNOT 1458198; ANNOT 1488327; CLONE 38690; ANNOT 1525183; ANNOT 1525183; CLONE 158333; ANNOT 1466505; ANNOT 1466505; ANNOT 1449026; ANNOT 1449026; | 564; 565; 566; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1774; 1775; 1776; 2611; 2612; 2613; 2614; 2615; |
| INFLORESCENCE | Biomass | Tall | The inflorescences | Useful for making taller | CLONE 332; ANNOT 1474923; ANNOT 1474923; CLONE 4067; ANNOT 1514362; ANNOT 1514362; ANNOT 1494090; ANNOT 1494090; CLONE 5597; ANNOT | 12; 13; 14; 196; 197; 198; 199; 200; 233; 234; |

TABLE 1-continued

| Tissue | Phenotype Category | Phenotype | Phenotype Description | Applications | Ceres ID | SEQ ID NO |
|---|---|---|---|---|---|---|
| | | | of the plants are abnormally long. | plants and plants with longer inflorescences | 1507708; ANNOT 1507708; ANNOT 1475094; CLONE 23322; ANNOT 1512337; ANNOT 1512337; ANNOT 1517094; CLONE 28643; ANNOT 1469464; ANNOT 1469464; ANNOT 1463508; ANNOT 1459366; ANNOT 1459366; ANNOT 1542246; ANNOT 1463508; CLONE 32152; ANNOT 1450535; ANNOT 1450535; ANNOT 1513913; ANNOT 1460651; ANNOT 1460651; ANNOT 1442535; ANNOT 1513913; ANNOT 1452888; ANNOT 1452888; ANNOT 148705; CLONE 33559; ANNOT 1481146; ANNOT 1481146; ANNOT 1481150; ANNOT 148705; ANNOT 1481138; ANNOT 1481138; ANNOT 1485824; ANNOT 1534622; ANNOT 1534622; CLONE 98855; ANNOT 1460836; ANNOT 1460836; ANNOT 1450324; ANNOT 1450324; CLONE 99657; ANNOT 1461858; ANNOT 1461858; ANNOT 1461858; ANNOT 1461858; ANNOT 1440018; ANNOT 1440018; ANNOT 1440018; ANNOT 1440019; ANNOT 1511305; ANNOT 1511305; ANNOT 1511305; ANNOT 1440019; ANNOT 1511305; ANNOT 1464927; ANNOT 1464927; ANNOT 1464927; CLONE 99784; ANNOT 1521032; ANNOT 1521032; ANNOT 1472909; ANNOT 1472909; ANNOT 1467665; ANNOT 1467665; CLONE 100319; ANNOT 1503141; ANNOT 1503141; ANNOT 1521524; ANNOT 1521524; CLONE 105554; ANNOT 1451783; ANNOT 1451783; CLONE 106011; ANNOT 1533498; ANNOT 1533498; ANNOT 1524067; ANNOT 1524067; CLONE 110247; ANNOT 1528846; ANNOT 1528846; ANNOT 1538329; CLONE 112955; ANNOT 1447634; ANNOT 1447634; CLONE 156655; ANNOT 1538329; ANNOT 1441740; ANNOT 1441740; CLONE 157730; ANNOT 1532681; ANNOT 1532681; ANNOT 1469739; ANNOT 1469739; CLONE 270875; ANNOT 1457048; ANNOT 1457048; ANNOT 1510252; ANNOT 1510252; CLONE 1002819; ANNOT 1474290; ANNOT 1474290; ANNOT 1522314; ANNOT 1522314; ANNOT 1497147; ANNOT 1497147; ANNOT 1471045; ANNOT 1471045; CLONE 1011386; ANNOT 1531134; ANNOT 1531134; ANNOT 1508758; ANNOT 1508758; CDNA 2305103; CDNA 3651290; ANNOT 1471370; ANNOT 1471370; ANNOT 1447690; ANNOT 1444471; ANNOT 1491278; ANNOT 1491278; ANNOT 1447690; ANNOT 1447690; CDNA 3656910S; ANNOT 1463445; ANNOT 1463445; ANNOT 1512677; ANNOT 1512677; ANNOT 1459412; ANNOT 1459412; ANNOT 1447690; ANNOT 1491278; ANNOT 1491278; ANNOT 1491278; ANNOT 1500987; ANNOT 1500987; ANNOT 1490915; ANNOT 1490915; | 235; 236; 237; 897; 898; 899; 900; 901; 1122; 1123; 1124; 1125; 1126; 1127; 1128; 1129; 1130; 1206; 1207; 1208; 1209; 1210; 1211; 1212; 1213; 1214; 1215; 1216; 1217; 1218; 1310; 1311; 1312; 1313; 1314; 1315; 1316; 1317; 1318; 1319; 1320; 2118; 2119; 2120; 2121; 2122; 2142; 2143; 2144; 2145; 2146; 2147; 2148; 2149; 2150; 2151; 2152; 2153; 2154; 2155; 2156; 2157; 2158; 2159; 2160; 2161; 2162; 2163; 2164; 2165; 2166; 2167; 2191; 2192; 2193; 2194; 2195; 2247; 2248; 2249; 2250; 2251; 2252; 2253; 2254; 2308; 2309; 2310; 2311; 2312; 2330; 2331; 2332; 2580; 2581; 2582; 2601; 2602; 2603; 2604; 2605; 2811; 2812; 2813; 2814; 2815; 3428; 3429; 3430; 3431; 3432; 3433; 3434; 3435; 3436; 3462; 3463; 3464; 3465; 3466; 3687; 3896; 3897; 3898; 3899; 3900; 3901; 3902; 3903; 3904; 4036; 4037; 4038; 4039; 4040; 4041; 4042; 3688; 3689; 3690; 3691; 3692; 3693; 3694; 3695; |
| CAULINE LEAVES | Biomass | Undulate Shaped | The leaves are wavy in appearance compared to wild-type plants. | Useful for making plants with increased biomass and foliage | CLONE 4067; ANNOT 1514362; ANNOT 1494090; ANNOT 1494090; CLONE 36904; ANNOT 1526083; ANNOT 1498856; ANNOT 1498856; ANNOT 1445872; ANNOT 1472663; ANNOT 1472663; | 196; 197; 198; 199; 200; 1585; 1586; 1587; 1588; 1589; 1590; 1591; 1592; 1593; |
| INFLORESCENCE | Biomass, Architecture | No Branching | There is no branching. | Useful for modifying plant architecture, i.e. amount of branching | CLONE 3000; ANNOT 1518918; ANNOT 1535677; ANNOT 1535677; ANNOT 1482181; ANNOT 1482181; CLONE 13391; ANNOT 1445555; ANNOT 1445555; ANNOT 1445555; ANNOT 1502315; ANNOT 1502315; CLONE 13757; ANNOT 1471425; ANNOT 1471425; CLONE 14555; ANNOT 1511392; ANNOT 1511392; ANNOT 1469356; ANNOT 1469356; ANNOT 1517500; ANNOT 1517500; ANNOT 1458151; ANNOT 1458151; ANNOT 1522757; CLONE 20760; ANNOT 1462351; ANNOT 1462351; ANNOT 1488821; ANNOT 1488821; ANNOT 1469462; ANNOT 1469462; CLONE 34412; ANNOT 1449739; ANNOT 1449739; ANNOT 1449738; ANNOT 1449738; ANNOT 1458830; ANNOT 1458830; CLONE | 111; 112; 113; 114; 115; 116; 117; 539; 540; 541; 542; 543; 564; 565; 566; 608; 609; 610; 611; 612; 613; 614; 615; 616; 617; 618; 808; 809; 810; 811; 812; 813; 814; 1376; 1377; 1378; 1379; 1380; 1381; 1382; 1545; 1546; |

TABLE 1-continued

| Tissue | Phenotype Category | Phenotype | Phenotype Description | Applications | Ceres ID | SEQ ID NO |
|---|---|---|---|---|---|---|
| INFLORESCENCE | Biomass, Architecture | Short Internode | The internode is abnormally short. | Useful for making modulating plant height and plants with modified flowers | 36709; ANNOT 1499936; ANNOT 1499936; CLONE 157547; ANNOT 1473898; ANNOT 1473898; CLONE 241379; ANNOT 1526950; ANNOT 1526950; ANNOT 1508362; ANNOT 1508362; ANNOT 1477361; ANNOT 1477361; CLONE 641355; ANNOT 1463335; ANNOT 1463335; ANNOT 1463334; ANNOT 1463334; ANNOT 1452665; ANNOT 1452665; CLONE 332; ANNOT 1474923; ANNOT 1474923; CLONE 3062; ANNOT 1504677; ANNOT 1504677; ANNOT 1451593; ANNOT 1451593; CLONE 9132; ANNOT 1458620; ANNOT 1458620; CLONE 12993; ANNOT 1479464; ANNOT 1479464; CLONE 13186; ANNOT 1464566; ANNOT 1464566; ANNOT 1458408; ANNOT 1458408; CLONE 13757; ANNOT 1471425; ANNOT 1471425; CLONE 14555; ANNOT 1511392; ANNOT 1511392; ANNOT 1469356; ANNOT 1469356; ANNOT 1517500; ANNOT 1517500; ANNOT 1458151; ANNOT 1458151; ANNOT 1522757; ANNOT 1522757; CLONE 14583; ANNOT 1530256; ANNOT 1530256; ANNOT 1476783; ANNOT 1476783; ANNOT 1503166; ANNOT 1503166; CLONE 19116; ANNOT 1467522; ANNOT 1467522; ANNOT 1526421; ANNOT 1526421; CLONE 24266; ANNOT 1463475; ANNOT 1463475; ANNOT 1443033; ANNOT 1540920; ANNOT 1540920; ANNOT 1487528; ANNOT 1487528; CLONE 25758; ANNOT 1473748; ANNOT 1473748; CLONE 28326; ANNOT 1468461; ANNOT 1468461; CLONE 34385; ANNOT 1445331; ANNOT 1445331; ANNOT 1498316; ANNOT 1498316; CLONE 35051; ANNOT 1443033; ANNOT 1443033; ANNOT 1452408; ANNOT 1452408; ANNOT 1505508; ANNOT 1505508; CLONE 40508; ANNOT 1453626; ANNOT 1453626; CLONE 40538; ANNOT 1452757; ANNOT 1452757; CLONE 40729; ANNOT 1481678; ANNOT 1481678; CLONE 40824; ANNOT 1509015; ANNOT 1509015; ANNOT 1535964; ANNOT 1535964; ANNOT 1535962; ANNOT 1455815; ANNOT 1455815; ANNOT 1455817; ANNOT 1455817; ANNOT 1482502; ANNOT 1482502; ANNOT 1509035; ANNOT 1509035; ANNOT 1482477; ANNOT 1482477; ANNOT 1509013; ANNOT 1509013; ANNOT 1535990; ANNOT 1535990; ANNOT 1455837; ANNOT 1455837; CLONE 100047; ANNOT 1532164; ANNOT 1532164; ANNOT 1479341; ANNOT 1479341; ANNOT 1479350; ANNOT 1479350; ANNOT 1442450; ANNOT 1442450; CLONE 102248; ANNOT 1456981; ANNOT 1456981; CLONE 115946; ANNOT 1456342; ANNOT 1456342; CLONE 118337; ANNOT 1454773; ANNOT 1454773; ANNOT 1511811; ANNOT 1511811; ANNOT 1478364; ANNOT 1478364; ANNOT 1464394; ANNOT 1464394; CLONE 147593; ANNOT 1475653; ANNOT 1475653; ANNOT 1458131; ANNOT 1458131; ANNOT 1461780; ANNOT 1461780; CLONE 222601; ANNOT 1457617; ANNOT 1457617; ANNOT 1465289; ANNOT 1465289; ANNOT 1478647; ANNOT 1478647; ANNOT 1453865; ANNOT 1453865; ANNOT 1438014; ANNOT 1438014; CLONE 464504; ANNOT 1438401; ANNOT 1438401; CLONE 482122; ANNOT 1438776; ANNOT 1438776; CLONE 536726; ANNOT 1498226; ANNOT 1498226; ANNOT 1445243; ANNOT 1445243; ANNOT 1525386; ANNOT 1525386; ANNOT 1448522; ANNOT 1448522; ANNOT 1465506; ANNOT 1465506; ANNOT 1497017; ANNOT 1497017; ANNOT 1447240; ANNOT 1447240; ANNOT 1539566; ANNOT 1539566; ANNOT 1444070; ANNOT 1444070; | 1547; 2593; 2594; 2595; 2718; 2719; 2720; 2721; 2722; 2723; 2724; 3304; 3305; 3306; 3307; 3308; 3309; 3310; 12; 13; 14; 124; 125; 126; 127; 128; 391; 392; 393; 520; 521; 522; 531; 532; 533; 534; 535; 564; 565; 566; 608; 609; 610; 611; 612; 613; 614; 615; 616; 617; 618; 619; 620; 621; 622; 623; 624; 625; 735; 736; 737; 738; 739; 937; 938; 939; 940; 941; 942; 943; 973; 974; 975; 1088; 1089; 1090; 1364; 1365; 1366; 1367; 1368; 1441; 1442; 1443; 1444; 1445; 1446; 1447; 1912; 1913; 1914; 1915; 1916; 1917; 1930; 1931; 1932; 1939; 1940; 1941; 1942; 1943; 1944; 1945; 1946; 1947; 1948; 1949; 1950; 1951; 1952; 1953; 1954; 1955; 1956; 1957; 1958; 1959; 1960; 1961; 2173; 2174; 2175; 2176; 2177; 2178; 2179; 2180; 2181; 2229; 2230; 2231; 2370; 2371; 2372; 2417; 2418; 2419; 2420; 2421; 2422; 2423; 2424; 2425; 2533; 2534; 2535; 2536; 2537; 2538; 2539; 2665; 2666; 2667; 2668; 2669; 2670; 2671; 2672; 2673; 2674; 2675; 3006; 3007; 3008; 3049; 3050; 3051; 3135; 3136; 3137; 3138; 3139; 3140; 3141; 3142; 3143; 3144; 3145; 3146; 3147; 3148; 3149; 3150; 3151; 3152; 3153; |
| INFLORESCENCE | Biomass, Architecture | Two Leaf Branching | Two cauline leaves subtend branches instead of one. | Useful for modifying plant architecture, i.e. increasing | CLONE 38973; ANNOT 1451899; ANNOT 1451899; ANNOT 1496367; ANNOT 1496367; | 1818; 1819; 1820; 1821; 1822; |

TABLE 1-continued

| Tissue | Phenotype Category | Phenotype | Phenotype Description | Applications | Ceres ID | SEQ ID NO |
|---|---|---|---|---|---|---|
| WHOLE PLANT | Composition | Activates expression of the gene endogenous to the AtATCPS1 (SEQ ID NO 4091) regulatory region | Overexpression of the regulatory protein is able to promote the expression of the gene operably linked to the AtATCPS1 (SEQ ID NO 4091) regulatory region | foliage Useful for modulating Terpenoid Biosynthesis | CLONE ID no. 475689; ANNOT 1472897; ANNOT 1472897; ANNOT 1467673; ANNOT 1467673; ANNOT 1445014; ANNOT 1445014; ANNOT 1471808; ANNOT 1471808; ANNOT 1454998; ANNOT 1454998; ANNOT 1475212; ANNOT 1475212; | 3021; 3022; 3023; 3024; 3025; 3026; 3027; 3028; 3029; 3030; 3031; 3032; 3033; |
| WHOLE PLANT | Composition | Activates expression of the gene endogenous to the AtATTPS3 (SEQ ID NO 4108) regulatory region | Overexpression of the regulatory protein is able to promote the expression of the gene operably linked to the AtATTPS3 (SEQ ID NO 4108) regulatory region | Useful for modulating Terpenoid Biosynthesis | CLONE ID no. 45; ANNOT 1447323; ANNOT 1447323; ANNOT 1491680; ANNOT 1491680; CLONE ID no. 3997; ANNOT 1455209; ANNOT 1455209; ANNOT 1446198; ANNOT 1446198; ANNOT 1490273; ANNOT 1490273; ANNOT 1530603; ANNOT 1530603; CLONE ID no. 11130; ANNOT 1466979; ANNOT 1466979; CLONE ID no. 14246; ANNOT 1454534; ANNOT 1454534; ANNOT 1507701; ANNOT 1507701; CLONE ID no. 21075; ANNOT 1520467; ANNOT 1520467; ANNOT 1494915; ANNOT 1494915; CLONE ID no. 25795; ANNOT 1471291; ANNOT 1471291; ANNOT 1444391; ANNOT 1444391; ANNOT 1488042; ANNOT 1488042; CLONE ID no. 29310; ANNOT 1455209; ANNOT 1455209; ANNOT 1446198; ANNOT 1446198; ANNOT 1490273; ANNOT 1490273; ANNOT 1530603; ANNOT 1530603; CLONE ID no. 36927; ANNOT 1447997; ANNOT 1447997; ANNOT 1438091; ANNOT 1438091; ANNOT 143891; CLONE ID no. 98140; ANNOT 1518036; ANNOT 1518036; ANNOT 1518036; ANNOT 1511508; ANNOT 1511508; ANNOT 1464717; ANNOT 1464717; CLONE ID no. 103581; ANNOT 1486398; ANNOT 1486398; ANNOT 1496840; ANNOT 1496840; CLONE ID no. 119104; ANNOT 1465284; ANNOT 1465284; ANNOT 1518608; ANNOT 1518608; ANNOT 1443642; ANNOT 1443642; CLONE ID no. 286402; ANNOT 1539856; ANNOT 1539856; ANNOT 1486441; ANNOT 1486441; ANNOT 1443875; ANNOT 1443875; CLONE ID no. 306497; ANNOT 1529923; ANNOT 1529923; ANNOT 1440964; ANNOT 1440964; ANNOT 1493847; ANNOT 1493847; ANNOT 1533800; CLONE ID no. 333416; ANNOT 1469082; ANNOT 1469082; ANNOT 1522474; ANNOT 1522474; ANNOT 1486441; ANNOT 1486441; ANNOT 1511636; ANNOT 1511636; ANNOT 1517906; ANNOT 1517906; CLONE ID no. 335011; ANNOT 481915; ANNOT 481915; ANNOT 1466775; ANNOT 1466775; ANNOT 1517906; CLONE ID no. 660003; ANNOT 1508184; ANNOT 1508184; ANNOT 1528645; ANNOT 1528645; CLONE ID no. 955048; ANNOT 1466002; ANNOT 1466002; ANNOT 1450256; ANNOT 1450256; | 1; 2; 3; 4; 5; 178; 179; 180; 181; 182; 183; 184; 185; 186; 445; 446; 447; 603; 604; 605; 606; 607; 832; 833; 834; 835; 836; 976; 977; 978; 979; 980; 981; 982; 1134; 1135; 1136; 1137; 1138; 1139; 1140; 1141; 1142; 1594; 1595; 1596; 1597; 1598; 2111; 2112; 2113; 2114; 2115; 2116; 2117; 2232; 2233; 2234; 2235; 2236; 2444; 2445; 2446; 2447; 2448; 2449; 2450; 2838; 2839; 2840; 2841; 2842; 2843; 2844; 2893; 2894; 2895; 2896; 2897; 2898; 2899; 2900; 2901; 2919; 2920; 2921; 2922; 2923; 2929; 2930; 2931; 2932; 2933; 3046; 3047; 3048; 3314; 3315; 3316; 3317; 3318; 3372; 3373; 3374; 3375; 3376; |
| WHOLE PLANT | Composition | Activates expression of the gene endogenous to the AtBBE2 (SEQ ID NO 4094) regulatory region | Overexpression of the regulatory protein is able to promote the expression of the gene operably linked to the AtBBE2 (SEQ ID NO 4094) regulatory region | Useful for modulating Alkaloid Biosynthesis | CLONE ID no. 355209; ANNOT 1498695; CLONE ID no. 475001; ANNOT 1467833; ANNOT 1467833; ANNOT 1526695; ANNOT 1526695; ANNOT 1521201; ANNOT 1521201; CLONE ID no. 534282; ANNOT 1515278; ANNOT 1515278; ANNOT 1439721; ANNOT 1439721; ANNOT 1474632; ANNOT 1474632; CLONE ID no. 563878; ANNOT 1474489; ANNOT 1474489; ANNOT 1453294; ANNOT 1453294; | 2975; 2976; 2977; 3014; 3015; 3016; 3017; 3018; 3019; 3020; 3086; 3087; 3088; 3089; 3090; 3091; 3092; 3236; 3237; 3238; 3239; 3240; |

TABLE 1-continued

| Tissue | Phenotype Category | Phenotype | Phenotype Description | Applications | Ceres ID | SEQ ID NO |
|---|---|---|---|---|---|---|
| WHOLE PLANT | Composition | Activates expression of the gene endogenous to the AtCR2 (SEQ ID NO 4096) regulatory region and/or the AtROX6 (SEQ ID NO 4097) regulatory region. | Overexpression of the regulatory protein is able to promote the expression of the gene operably linked to the AtCR2 (SEQ ID NO 4096) regulatory region and/or the AtROX6(SEQ ID NO 4097) regulatory region. | Useful for modulating Alkaloid Biosynthesis | CLONE ID no. 8788; ANNOT 1474018; ANNOT 1474018; CLONE ID no. 11130; ANNOT 1466979; ANNOT 1466979; CLONE ID no. 21634; ANNOT 1458524; ANNOT 1458524; ANNOT 1464441; ANNOT 1464441; CLONE ID no. 34385; ANNOT 1445331; ANNOT 1445331; ANNOT 1498316; ANNOT 1498316; CLONE ID no. 34414; ANNOT 1471525; ANNOT 1471525; ANNOT 1497838; ANNOT 1497838; ANNOT 1511908; ANNOT 1511908; ANNOT 1464305; ANNOT 1464305; ANNOT 1451416; ANNOT 1451416; ANNOT 1514324; ANNOT 1514324; ANNOT 1461050; ANNOT 1461050; CLONE ID no. 34944; ANNOT 1485544; ANNOT 1485544; ANNOT 1447051; ANNOT 1447051; CLONE ID no. 35228; ANNOT 1445433; ANNOT 1445433; ANNOT 1498413; ANNOT 1498413; CLONE ID no. 35594; ANNOT 1514436; ANNOT 1514436; ANNOT 1461164; ANNOT 1461164; ANNOT 1494183; ANNOT 1494183; ANNOT 1441280; ANNOT 1441280; CLONE ID no. 39231; ANNOT 1511404; ANNOT 1511404; ANNOT 1464821; ANNOT 1464821; CLONE ID no. 39893; ANNOT 1530660; ANNOT 1530660; ANNOT 1455308; ANNOT 1455308; CLONE ID no. 41104; ANNOT 1489751; ANNOT 1489751; ANNOT 1446209; ANNOT 1446209; CLONE ID no. 41105; ANNOT 1500974; ANNOT 1500974; ANNOT 1490929; ANNOT 1490929; ANNOT 1438118; ANNOT 1438118; ANNOT 1482024; ANNOT 1482024; CLONE ID no. 208429; ANNOT 1457538; ANNOT 1457538; ANNOT 1510743; ANNOT 1510743; CLONE ID no. 229604; ANNOT 1480703; ANNOT 1480703; ANNOT 1454366; ANNOT 1454366; CLONE ID no. 471089; ANNOT 1531777; ANNOT 1531777; ANNOT 1508033; ANNOT 1508033; CLONE ID no. 480900; ANNOT 1461433; ANNOT 1461433; ANNOT 1487252; ANNOT 1487252; CLONE ID no. 597609; ANNOT 1538274; ANNOT 1538274; ANNOT 1528771; ANNOT 1528771; ANNOT 1484866; ANNOT 1484866; CLONE ID no. 957981; ANNOT 1515625; ANNOT 1515625; ANNOT 1489205; ANNOT 1489205; CLONE ID no. 960560; ANNOT 1446751; ANNOT 1446751; CLONE ID no. 965028; ANNOT 1438401; ANNOT 1438401; CDNA ID no. 12676498; ANNOT 1522070; ANNOT 1525070; ANNOT 1525070; ANNOT 1471655; ANNOT 1471655; ANNOT 1525069; ANNOT 1525069; ANNOT 1471654; ANNOT 1471654; CDNA ID no. 13579142; ANNOT 1522260; ANNOT 1522260; ANNOT 1527806; ANNOT 1527806; CDNA ID no. 13610509; ANNOT 1531291; ANNOT 1531291; CDNA ID no. 13653045; ANNOT 1463563; ANNOT 1463563; CDNA ID no. 23447462; ANNOT 1440467; ANNOT 1440467; ANNOT 1476600; ANNOT 1476600; ANNOT 1493336; ANNOT 1493336; CDNA ID no. 23458190; ANNOT 1522260; ANNOT 1522260; ANNOT 1527806; ANNOT 1527806; CDNA ID no. 23477523; ANNOT 1443651; ANNOT 1443651; ANNOT 1451622; ANNOT 1451622; ANNOT 1455533; ANNOT 1455533; CDNA ID no. 23503364; CDNA ID no. 23544026; ANNOT 1508925; ANNOT 1508925; ANNOT 1531291; ANNOT 1531291; CDNA ID no. 23640482; ANNOT 1446359; ANNOT 1446359; ANNOT 1464743; ANNOT 1464743; ANNOT 1438865; ANNOT 1438865; CDNA ID no. 24374230; ANNOT 1464743; ANNOT 1464743; | 380; 381; 382; 445; 446; 447; 854; 855; 856; 857; 858; 1364; 1365; 1366; 1367; 1368; 1383; 1384; 1385; 1386; 1387; 1388; 1389; 1390; 1391; 1392; 1393; 1394; 1395; 1396; 1397; 1430; 1431; 1432; 1433; 1434; 1455; 1456; 1457; 1458; 1459; 1467; 1468; 1469; 1470; 1471; 1472; 1473; 1474; 1475; 1826; 1827; 1828; 1829; 1830; 1887; 1888; 1889; 1890; 1891; 1962; 1963; 1964; 1965; 1966; 1967; 1968; 1969; 1970; 1971; 1972; 1973; 1974; 1975; 2644; 2645; 2646; 2647; 2648; 2697; 2698; 2699; 2700; 2701; 3009; 3010; 3011; 3012; 3013; 3043; 3044; 3045; 3197; 3198; 3199; 3260; 3261; 3262; 3263; 3264; 3265; 3266; 3377; 3378; 3379; 3380; 3381; 3382; 3383; 3384; 3385; 3386; 3387; 3520; 3521; 3522; 3523; 3524; 3525; 3526; 3527; 3528; 3546; 3547; 3548; 3549; 3550; 3551; 3552; 3553; 3554; 3563; 3564; 3565; 3566; 3567; 3568; 3569; 3570; 3571; 3572; 3573; 3574; 3594; 3595; 3596; 3597; 3598; 3681; 3797; 3798; 3799; 3816; 3817; 3818; 3819; 3820; 3835; 3836; 3837; 3838; 3839; 3869; 3870; 3871; |
| WHOLE PLANT | Composition | Activates expression of the gene endogenous to the AtDXPR (SEQ ID NO 4086) regulatory region | Overexpression of the regulatory protein is able to promote the expression of the gene operably linked to the AtDXPR (SEQ ID NO | Useful for modulating Terpenoid Biosynthesis | CLONE ID no. 6066; ANNOT 1458359; ANNOT 1458359; ANNOT 1517940; ANNOT 1517940; CLONE ID no. 8788; ANNOT 1474018; ANNOT 1474018; ANNOT 1464628; ANNOT 1464628; CLONE ID no. 12997; ANNOT 1483367; ANNOT 1483367; ANNOT 1483367; ANNOT 1483367; ANNOT 1474088; ANNOT 1474088; CLONE ID no. 27793; ANNOT 1517449; ANNOT 1517449; ANNOT 1512061; ANNOT 1512061; CLONE ID no. 34060; ANNOT 1507094; ANNOT 1507094; ANNOT 1535523; ANNOT 1535523; ANNOT 1490409; ANNOT 1490409; ANNOT 1535523; CLONE ID no. 34406; ANNOT 1437614; ANNOT 1437614; CLONE ID no. 36272; ANNOT 1501426; ANNOT 1501426; ANNOT 1513277; ANNOT 1513277; ANNOT 1469342; ANNOT 1469342; | 261; 262; 263; 264; 265; 266; 267; 380; 381; 382; 523; 524; 525; 526; 527; 1070; 1071; 1072; 1073; 1074; 1333; 1334; 1335; 1336; 1337; 1369; 1370; 1371; 1372; 1373; 1374; 1375; 1493; 1494; 1495; 1496; 1497; 1498; 1499; |

TABLE 1-continued

| Tissue | Phenotype Category | Phenotype | Phenotype Description | Applications | Ceres ID | SEQ ID NO |
|---|---|---|---|---|---|---|
| | | | 4086) regulatory region | | ANNOT 1470275; ANNOT 1470275; CLONE ID no. 37792; ANNOT 1467441; ANNOT 1467441; ANNOT 1473092; ANNOT 1473092; ANNOT 1476838; ANNOT 1476838; CLONE ID no. 38950; ANNOT 1528409; ANNOT 1528409; ANNOT 1526895; ANNOT 1526895; ANNOT 1453647; ANNOT 1453647; CLONE ID no. 42713; ANNOT 1477897; ANNOT 1477897; ANNOT 1480898; ANNOT 1480898; CLONE ID no. 99519; ANNOT 1520166; ANNOT 1520166; ANNOT 1519131; ANNOT 1519131; ANNOT 1501805; ANNOT 1501805; CLONE ID no. 106078; ANNOT 1469354; ANNOT 1469354; ANNOT 1522753; ANNOT 1522753; ANNOT 1488939; ANNOT 1488939; CLONE ID no. 108509; ANNOT 1469082; ANNOT 1469082; ANNOT 1522474; ANNOT 1522474; CLONE ID no. 115924; ANNOT 1453127; ANNOT 1453127; ANNOT 1506261; ANNOT 1506261; ANNOT 1480332; ANNOT 1480332; ANNOT 1454197; ANNOT 1454197; CLONE ID no. 117089; ANNOT 1471301; ANNOT 1471301; CLONE ID no. 154718; ANNOT 1457453; ANNOT 1457453; CLONE ID no. 207419; ANNOT 1517208; ANNOT 1517208; CLONE ID no. 208303; ANNOT 1477838; ANNOT 1477838; CLONE ID no. 225321; ANNOT 1504670; ANNOT 1504670; ANNOT 1451585; ANNOT 1451585; CLONE ID no. 237356; ANNOT 1480939; ANNOT 1480939; CLONE ID no. 272716; ANNOT 1497642; ANNOT 1497642; ANNOT 1471648; ANNOT 1471648; CLONE ID no. 283597; ANNOT 1482074; ANNOT 1482074; ANNOT 1453923; ANNOT 1453923; CLONE ID no. 304523; ANNOT 1445647; ANNOT 1445647; ANNOT 1448043; ANNOT 1448043; ANNOT 1438053; ANNOT 1438053; CLONE ID no. 306497; ANNOT 1529923; ANNOT 1529923; ANNOT 1440964; ANNOT 1440964; ANNOT 1493847; ANNOT 1493847; ANNOT 1533800; ANNOT 1533800; CLONE ID no. 389585; ANNOT 1500154; ANNOT 1500154; ANNOT 534311; ANNOT 1440272; ANNOT 1440272; ANNOT 1474707; ANNOT 1474707; CDNA ID no. 1653045; ANNOT 1463563; ANNOT 1463563; CDNA ID no. 23486285; ANNOT 1452123; ANNOT 1452123; CDNA ID no. 23515088; ANNOT 1462217; ANNOT 1462217; ANNOT 1535433; ANNOT 1535433; ANNOT 1475615; ANNOT 1475615; CDNA ID no. 23522373; ANNOT 1538994; ANNOT 1538994; ANNOT 1447080; ANNOT 1447080; CDNA ID no. 23529806; ANNOT 1443631; ANNOT 1443631; CDNA ID no. 23544992; ANNOT 1454621; ANNOT 1454621; CDNA ID no. 23651543; ANNOT 1447411; ANNOT 1447411; CDNA ID no. 24374230; ANNOT 1464743; ANNOT 1464743; | 1662; 1663; 1664; 1665; 1666; 1667; 1668; 1811; 1812; 1813; 1814; 1815; 1816; 1817; 2040; 2041; 2042; 2043; 2044; 2135; 2136; 2137; 2138; 2139; 2140; 2141; 2255; 2256; 2257; 2258; 2259; 2260; 2261; 2293; 2294; 2295; 2296; 2297; 2361; 2362; 2363; 2364; 2365; 2366; 2367; 2368; 2369; 2404; 2405; 2406; 2577; 2578; 2579; 2635; 2636; 2637; 2641; 2642; 2643; 2660; 2661; 2662; 2663; 2664; 2715; 2716; 2717; 2821; 2822; 2823; 2824; 2825; 2833; 2834; 2835; 2836; 2837; 2877; 2878; 2879; 2880; 2881; 2882; 2883; 2893; 2894; 2895; 2896; 2897; 2898; 2899; 2900; 2901; 2991; 2992; 2993; 3093; 3094; 3095; 3096; 3097; 3552; 3553; 3554; 3604; 3605; 3606; 3717; 3718; 3719; 3720; 3721; 3722; 3723; 3761; 3762; 3763; 3764; 3765; 3778; 3779; 3780; 3810; 3811; 3812; 3840; 3841; 3842; 3869; 3870; 3871; |
| WHOLE PLANT | Composition | Activates expression of the gene endogenous to the AtFPPS (SEQ ID NO 4088) regulatory region and/or the AtHMGR(SEQ ID NO 4107) regulatory region. | Overexpression of the regulatory protein is able to promote the expression of the gene operably linked to the AtFPPS (SEQ ID NO 4088) regulatory region and/or the AtHMGR(SEQ ID NO 4107) regulatory region. | Useful for modulating Terpenoid Biosynthesis | CLONE ID no. 42960; ANNOT 1481711; ANNOT 1481711; ANNOT 1446703; CLONE ID no. 36323; ANNOT 1491629; ANNOT 1491629; ANNOT 1531927; ANNOT 1531927; ANNOT 1507861; ANNOT 1507861; CLONE ID no. 374674; ANNOT 1522299; ANNOT 1522299; ANNOT 1527718; ANNOT 1527718; CLONE ID no. 471089; ANNOT 1531777; ANNOT 1531777; ANNOT 1508033; ANNOT 1508033; CLONE ID no. 533314; ANNOT 1528846; ANNOT 1528846; ANNOT 1538329; ANNOT 1538329; CLONE ID no. 556734; ANNOT 1495750; ANNOT 1495750; ANNOT 1522920; ANNOT 1522920; ANNOT 1469532; ANNOT 1469532; ANNOT 1488767; ANNOT 1488767; ANNOT 1542198; ANNOT 1542198; ANNOT 1452612; ANNOT 1452612; ANNOT 1459467; ANNOT 1459467; ANNOT 1442831; ANNOT 1442831; ANNOT 1516688; ANNOT 1516688; ANNOT 1463396; CDNA ID no. 23492765; ANNOT 1521278; ANNOT 1521278; ANNOT 1467911; ANNOT 1467911; | 2051; 2052; 2053; 2054; 2055; 2947; 2948; 2949; 2950; 2951; 2952; 2953; 2981; 2982; 2983; 2984; 2985; 3009; 3010; 3011; 3012; 3013; 3076; 3077; 3078; 3079; 3080; 3200; 3201; 3202; 3203; 3204; 3205; 3206; 3207; 3208; 3209; 3210; 3211; 3212; 3213; 3214; 3215; 3216; 3217; 3218; 3219; 3220; 3607; 3608; 3609; 3610; 3611; |
| WHOLE PLANT | Composition | Activates | Overexpression | Useful for | CLONE ID no. 7805; ANNOT 1518351; ANNOT 1518351; ANNOT 1475331; | 333; 334; 335; 336; 337; |

| Tissue | Phenotype Category | Phenotype | Phenotype Description | Applications | Ceres ID | SEQ ID NO |
|---|---|---|---|---|---|---|
| | | | expression of the gene endogenous to the AtHMGS (SEQ ID NO 4087) regulatory region | modulating Terpenoid Biosynthesis | ANNOT 1475331; CLONE ID no. 13930; ANNOT 1475265; ANNOT 1455046; ANNOT 1455046; CLONE ID no. 14234; ANNOT 1502448; ANNOT 1502448; ANNOT 1498406; ANNOT 1498406; ANNOT 1441275; ANNOT 1441275; ANNOT 1445426; ANNOT 1445426; CLONE ID no. 17632; ANNOT 1474847; ANNOT 1474847; ANNOT 1507835; ANNOT 1507835; CLONE ID no. 19340; ANNOT 1524357; ANNOT 1524357; ANNOT 1497053; ANNOT 1497053; ANNOT 1500296; ANNOT 1500296; CLONE ID no. 26867; ANNOT 1486918; ANNOT 1486918; CLONE ID no. 29637; ANNOT 1458617; ANNOT 1458617; ANNOT 1464333; ANNOT 1464333; CLONE ID no. 31894; ANNOT 1478160; ANNOT 1478160; CLONE ID no. 35786; ANNOT 1447278; ANNOT 1447278; CLONE ID no. 38950; ANNOT 1528409; ANNOT 1528409; ANNOT 1526895; ANNOT 1526895; ANNOT 1453647; ANNOT 1453647; CLONE ID no. 39279; ANNOT 1525349; ANNOT 1525349; ANNOT 1445751; ANNOT 1445751; ANNOT 1498733; ANNOT 1498733; CLONE ID no. 98140; ANNOT 1518036; ANNOT 1518036; ANNOT 1511508; ANNOT 1511508; ANNOT 1464717; ANNOT 1464717; CLONE ID no. 99075; ANNOT 1490832; ANNOT 1490832; ANNOT 1501068; ANNOT 1501068; ANNOT 1438021; ANNOT 1438021; CLONE ID no. 158155; ANNOT 1446954; ANNOT 1446954; ANNOT 1514228; ANNOT 1514228; CLONE ID no. 333753; ANNOT 1442401; ANNOT 1442401; ANNOT 1506142; ANNOT 1506142; CLONE ID no. 335471; ANNOT 1514745; ANNOT 1514745; ANNOT 1493080; ANNOT 1493080; ANNOT 1461474; ANNOT 1461474; ANNOT 1440205; ANNOT 1440205; ANNOT 1501185; ANNOT 1501185; ANNOT 1437922; ANNOT 1437922; CLONE ID no. 362309; ANNOT 1539865; ANNOT 1539865; CLONE ID no. 674157; ANNOT 1469521; ANNOT 1469521; ANNOT 1488782; ANNOT 1488782; ANNOT 1542209; ANNOT 1542209; ANNOT 1492433; ANNOT 1492433; ANNOT 1439568; ANNOT 1439568; CDNA ID no. 2999012; ANNOT 2345742; ANNOT 1449879; ANNOT 1449879; CDNA ID no. 23500996; ANNOT 1459998; ANNOT 1459998; ANNOT 1513263; ANNOT 1513263; CDNA ID no. 23509939; ANNOT 1527683; ANNOT 1527683; CDNA ID no. 2354461; ANNOT 1541623; ANNOT 1541623; ANNOT 1509108; ANNOT 1509108; CDNA ID no. 23557940; ANNOT 1446018; ANNOT 1446018; | 577; 578; 579; 580; 581; 594; 595; 596; 597; 598; 599; 600; 601; 602; 695; 696; 697; 698; 699; 755; 756; 757; 758; 759; 760; 761; 1040; 1041; 1042; 1146; 1147; 1148; 1149; 1150; 1198; 1199; 1200; 1484; 1485; 1486; 1811; 1812; 1813; 1814; 1815; 1816; 1817; 1831; 1832; 1833; 1834; 1835; 1836; 1837; 2111; 2112; 2113; 2114; 2115; 2116; 2117; 2123; 2124; 2125; 2126; 2127; 2128; 2129; 2606; 2607; 2608; 2609; 2610; 2924; 2925; 2926; 2927; 2928; 2934; 2935; 2936; 2937; 2938; 2939; 2940; 2941; 2942; 2943; 2944; 2945; 2946; 2978; 2979; 2980; 3338; 3339; 3340; 3341; 3342; 3343; 3344; 3506; 3507; 3508; 3509; 3510; 3627; 3628; 3629; 3661; 3662; 3663; 3664; 3665; 3709; 3710; 3711; 3800; 3801; 3802; 3803; 3804; 3832; 3833; 3834; |
| WHOLE PLANT | Composition | Activates expression of the gene endogenous to the AtPES (SEQ ID NO 4085) regulatory region | Overexpression of the regulatory protein is able to promote the expression of the gene operably linked to the AtPES (SEQ ID NO 4085) regulatory region | Useful for modulating Terpenoid Biosynthesis | CLONE ID no. 7201; ANNOT 1531932; ANNOT 1531932; ANNOT 1454684; CLONE ID no. 10375; ANNOT 1449163; ANNOT 1449163; CLONE ID no. 92102; ANNOT 1484557; ANNOT 1484557; ANNOT 1438401; ANNOT 1438401; CLONE ID no. 125922; ANNOT 1450377; ANNOT 1450377; ANNOT 1438401; ANNOT 1514052; ANNOT 1514052; CLONE ID no. 208303; ANNOT 1477838; ANNOT 1477838; CLONE ID no. 316658; ANNOT 1470444; ANNOT 1470444; CLONE ID no. 331626; ANNOT 1479649; ANNOT 1479649; CLONE ID no. 336888; ANNOT 1449337; ANNOT 1449337; ANNOT 1498512; ANNOT 1498512; ANNOT 1517165; ANNOT 1517165; ANNOT 1539315; ANNOT 1539315; ANNOT 1463865; ANNOT 1463865; ANNOT 1502340; ANNOT 1502340; ANNOT 1512274; ANNOT 1512274; ANNOT 1459009; ANNOT 1459009; ANNOT 1445529; ANNOT 1445529; ANNOT 1485901; ANNOT 1485901; CLONE ID no. 968026; ANNOT 1473516; ANNOT 1473516; ANNOT 1526929; ANNOT 1526929; ANNOT 1513366; ANNOT 1513366; ANNOT 1460097; ANNOT 1460097; ANNOT 1459838; ANNOT 1459838; ANNOT 1463865; ANNOT 1474764; ANNOT 1474764; ANNOT 1453555; ANNOT 1453555; ANNOT 1512274; ANNOT 1448253; ANNOT 1448253; ANNOT 1437849; ANNOT 1437849; ANNOT 1443270; ANNOT 1443270; ANNOT 1496190; ANNOT 1496190; CDNA ID no. 23480178; ANNOT 1529639; ANNOT 1529639; ANNOT 1507454; ANNOT 1507454; CDNA ID no. 23497949; ANNOT 1452863; ANNOT 1452863; ANNOT 1442568; ANNOT 1442568; | 320; 321; 322; 323; 324; 431; 432; 433; 2056; 2057; 2058; 2059; 2060; 2507; 2508; 2509; 2510; 2511; 2641; 2642; 2643; 2902; 2903; 2904; 2916; 2917; 2918; 2954; 2955; 2956; 2957; 2958; 2959; 2960; 2961; 2962; 2963; 2964; 2965; 2966; 2967; 2968; 2969; 2970; 2971; 2972; 2973; 2974; 3391; 3392; 3393; 3394; 3395; 3396; 3397; 3398; 3399; 3400; 3401; 3402; 3403; 3404; 3405; 3406; 3407; 3408; 3409; 3410; 3411; 3412; 3413; 3599; 3600; 3601; 3602; 3603; 3630; |

| Tissue | Phenotype Category | Phenotype | Phenotype Description | Applications | Ceres ID | SEQ ID NO |
|---|---|---|---|---|---|---|
| | | | | | 1442568; ANNOT 1486734; ANNOT 1468322; ANNOT 1468322; ANNOT 1473531; ANNOT 1473531; CDNA ID no. 2303138; ANNOT 1507158; ANNOT 1507158; ANNOT 1454014; ANNOT 1454014; CDNA ID no. 23521525; ANNOT 1491996; ANNOT 1491996; ANNOT 1439136; ANNOT 1439136; CDNA ID no. 23544687; ANNOT 1517998; ANNOT 1517998; ANNOT 1458313; ANNOT 1458313; CDNA ID no. 23653450; ANNOT 1441536; ANNOT 1441536; | 3631; 3632; 3633; 3634; 3635; 3636; 3637; 3638; 3639; 3640; 3673; 3674; 3675; 3676; 3677; 3756; 3757; 3758; 3759; 3760; 3805; 3806; 3807; 3808; 3809; 3843; 3844; 3845; |
| WHOLE PLANT | Composition | Activates expression of the gene endogenous to the AtROX7 (SEQ ID NO 4098) regulatory region | Overexpression of the regulatory protein is able to promote the expression of the gene operably linked to the AtROX7 (SEQ ID NO 4098) regulatory region | Useful for modulating Alkaloid Biosynthesis | CDNA ID no. 24373996; ANNOT 1534046; ANNOT 1534046; ANNOT 1480559; ANNOT 1480559; | 3864; 3865; 3866; 3867; 3868; |
| WHOLE PLANT | Composition | Activates expression of the gene endogenous to the AtSQS1 (SEQ ID NO 4093) regulatory region | Overexpression of the regulatory protein is able to promote the expression of the gene operably linked to the AtSQS1 (SEQ ID NO 4093) regulatory region | Useful for modulating Terpenoid Biosynthesis | CLONE ID no. 20769; ANNOT 1443644; ANNOT 1443644; | 815; 816; 817; |
| WHOLE PLANT | Composition | Activates expression of the gene endogenous to the AtSS1 (SEQ ID NO 4101) regulatory region | Overexpression of the regulatory protein is able to promote the expression of the gene operably linked to the AtSS1 (SEQ ID NO 4101) regulatory region | Useful for modulating Alkaloid Biosynthesis | CLONE ID no. 11938; ANNOT 1442401; ANNOT 1442401; ANNOT 1506142; ANNOT 1506142; CDNA ID no. 12676498; ANNOT 1525070; ANNOT 1525070; ANNOT 1471655; ANNOT 1471655; ANNOT 1525069; ANNOT 1471654; ANNOT 1471654; CDNA ID no. 23539673; ANNOT 1472261; ANNOT 1472261; ANNOT 1445638; ANNOT 1445638; ANNOT 1483570; ANNOT 1483570; CDNA ID no. 24365511; ANNOT 1466223; ANNOT 1466223; ANNOT 1494350; ANNOT 1494350; | 497; 498; 499; 500; 501; 3520; 3521; 3522; 3523; 3524; 3525; 3526; 3527; 3528; 3790; 3791; 3792; 3793; 3794; 3795; 3796; 3859; 3860; 3861; 3862; 3863; |
| WHOLE PLANT | Composition | Activates expression of the gene endogenous to the AtSS3 (SEQ ID NO 4102) regulatory region and/or the AtROX7(SEQ | Overexpression of the regulatory protein is able to promote the expression of the gene operably linked to the AtSS3 (SEQ ID NO 4102) regulatory region | Useful for modulating Alkaloid Biosynthesis | CLONE ID no. 109490; ANNOT 1443194; ANNOT 1505312; ANNOT 1505312; CLONE ID no. 115946; ANNOT 1458342; ANNOT 1458342; CLONE ID no. 223419; ANNOT 1485423; ANNOT 1485423; CLONE ID no. 230582; ANNOT 1502431; ANNOT 1502431; CLONE ID no. 306497; ANNOT 1529923; ANNOT 1529923; ANNOT 1440964; ANNOT 1440964; ANNOT 1493847; ANNOT 1493847; ANNOT 1533800; ANNOT 1533800; CLONE ID no. 325800; ANNOT 1517851; ANNOT 1517851; ANNOT 1464534; ANNOT 1464534; ANNOT 1511678; ANNOT 1511678; ANNOT 1458433; ANNOT 1458433; ANNOT 1529923; ANNOT 1449885; CLONE ID no. 599633; ANNOT 1449885; CLONE ID no. 942964; ANNOT 1440785; ANNOT 1440785; CLONE ID no. 982869; ANNOT | 2298; 2299; 2300; 2301; 2302; 2370; 2371; 2372; 2649; 2650; 2651; 2702; 2703; 2704; 2893; 2894; 2895; 2896; 2897; 2898; 2899; 2900; 2901; 2905; 2906; 2907; 2908; 2909; 2910; 2911; 2912; 2913; 2914; 2915; 3270; 3271; 3272; 3364; 3365; 3366; |

TABLE 1-continued

| Tissue | Phenotype Category | Phenotype | Phenotype Description | Applications | Ceres ID | SEQ ID NO |
|---|---|---|---|---|---|---|
| | | ID NO 4098) regulatory region. | region and/or the AtROX7(SEQ ID NO 4098) regulatory region. | | 1458219; ANNOT 1458219; ANNOT 1464757; CDNA ID no. 23461192; ANNOT 1504431; ANNOT 1504431; ANNOT 1510151; ANNOT 1510151; ANNOT 1451363; ANNOT 1451363; ANNOT 1456957; ANNOT 1456957; ANNOT 1481026; ANNOT 1481026; CDNA ID no. 23467433; ANNOT 1488031; ANNOT 1488031; CDNA ID no. 23467847; ANNOT 1469679; ANNOT 1469679; ANNOT 1479180; ANNOT 1479180; CDNA ID no. 23493156; CDNA ID no. 23498294; ANNOT 1465158; ANNOT 1465158; ANNOT 23498685; ANNOT 1460742; ANNOT 1460742; CDNA ID no. 23502516; ANNOT 1449874; ANNOT 1449874; ANNOT 1492655; ANNOT 1492655; ANNOT 1439788; ANNOT 1439788; CDNA ID no. 2350138; ANNOT 1507158; ANNOT 1507158; ANNOT 1454014; ANNOT 1454014; CDNA ID no. 23503210; ANNOT 1455082; ANNOT 1455082; CDNA ID no. 23503364; CDNA ID no. 23503971; ANNOT 1452812; ANNOT 1452812; ANNOT 1442627; ANNOT 1442627; CDNA ID no. 23515088; ANNOT 1462217; ANNOT 1462217; ANNOT 1535433; ANNOT 1535433; ANNOT 1475615; ANNOT 1475615; CDNA ID no. 23515246; ANNOT 1539565; ANNOT 1539565; ANNOT 1486151; ANNOT 1486151; ANNOT 1497018; ANNOT 1497018; ANNOT 1444071; ANNOT 1444071; ANNOT 1497013; ANNOT 1497013; ANNOT 1444066; ANNOT 1444066; CDNA ID no. 23516818; ANNOT 1444427; ANNOT 1444427; CDNA ID no. 23522373; ANNOT 1538994; ANNOT 1538994; ANNOT 1447080; ANNOT 1447080; CDNA ID no. 23245514; ANNOT 1459467; ANNOT 1459467; ANNOT 1516688; ANNOT 1516688; ANNOT 1488767; ANNOT 1488767; ANNOT 1495750; ANNOT 1495750; ANNOT 1452612; ANNOT 1452612; CDNA ID no. 23529931; ANNOT 1520459; ANNOT 1520459; ANNOT 1494925; ANNOT 1494925; CDNA ID no. 23544992; ANNOT 1454621; ANNOT 1454621; CDNA ID no. 23553534; ANNOT 1469045; ANNOT 1469045; CDNA ID no. 23653450; ANNOT 1441536; ANNOT 1441536; CDNA ID no. 23655935; ANNOT 1459700; ANNOT 1459700; CDNA ID no. 23660631; ANNOT 1457646; ANNOT 1457646; ANNOT 1518640; ANNOT 1518640; CDNA ID no. 23660778; ANNOT 1510945; ANNOT 1510945; ANNOT 1465368; ANNOT 1465368; ANNOT 1459467; ANNOT 1466223; ANNOT 1466223; ANNOT 1466223; ANNOT 1494350; ANNOT 1494350; CDNA ID no. 24365511; ANNOT 24380616; ANNOT 1445708; ANNOT 1445708; | 3414; 3415; 3416; 3417; 3418; 3575; 3576; 3577; 3578; 3579; 3580; 3581; 3582; 3583; 3584; 3585; 3586; 3587; 3588; 3589; 3590; 3591; 3592; 3593; 3612; 3646; 3647; 3648; 3649; 3650; 3651; 3666; 3667; 3668; 3669; 3670; 3671; 3672; 3673; 3674; 3675; 3676; 3677; 3678; 3679; 3680; 3681; 3682; 3683; 3684; 3685; 3686; 3717; 3718; 3719; 3720; 3721; 3722; 3723; 3724; 3725; 3726; 3727; 3728; 3729; 3730; 3731; 3732; 3733; 3734; 3735; 3736; 3745; 3746; 3747; 3761; 3762; 3763; 3764; 3765; 3767; 3768; 3769; 3770; 3771; 3772; 3773; 3774; 3775; 3776; 3777; 3781; 3782; 3783; 3784; 3785; 3810; 3811; 3812; 3826; 3827; 3828; 3843; 3844; 3845; 3846; 3847; 3848; 3849; 3850; 3851; 3852; 3853; 3854; 3855; 3856; 3857; 3858; 3859; 3860; 3861; 3862; 3863; 3872; 3873; 3874; |
| WHOLE PLANT | Composition | Activates expression of the gene endogenous to the EcBBE (SEQ ID NO 4099) regulatory region and/or the EcNMCH3(SEQ ID NO 4100) regulatory region. | Overexpression of the regulatory protein is able to promote the expression of the gene operably linked to the EcBBE (SEQ ID NO 4099) regulatory region and/or the EcNMCH3(SEQ ID NO 4100) regulatory region. | Useful for modulating Alkaloid Biosynthesis | CLONE ID no. 4228; ANNOT 1504263; ANNOT 1504263; CLONE ID no. 6493; ANNOT 1446643; ANNOT 1446643; ANNOT 1492373; ANNOT 1492373; CLONE ID no. 7559; ANNOT 1469241; ANNOT 1469241; CLONE ID no. 7805; ANNOT 1518351; ANNOT 1518351; ANNOT 1475331; ANNOT 1475331; CLONE ID no. 8788; ANNOT 1474018; ANNOT 1474018; CLONE ID no. 18903; ANNOT 1490030; ANNOT 1490030; CLONE ID no. 21075; ANNOT 1520467; ANNOT 1520467; ANNOT 1494915; ANNOT 1494915; CLONE ID no. 21604; ANNOT 1473854; ANNOT 1473854; ANNOT 1521997; ANNOT 1521997; ANNOT 1468633; ANNOT 1468633; CLONE ID no. 28451; ANNOT 1486525; ANNOT 1486525; ANNOT 1443820; ANNOT 1443820; CLONE ID no. 32791; ANNOT 1540248; ANNOT 1540248; CLONE ID no. 33498; ANNOT 1511064; ANNOT 1511064; ANNOT 1518490; ANNOT 1518490; CLONE ID no. 34167; ANNOT 1538733; ANNOT 1538733; ANNOT 1499810; ANNOT 1499810; ANNOT 1485323; ANNOT 1485323; CLONE ID no. 38529; ANNOT 1511049; ANNOT 1511049; ANNOT 1457826; ANNOT 1457826; ANNOT 1530660; ANNOT 1530660; ANNOT 1518508; ANNOT 1518508; CLONE ID no. 39893; ANNOT 1455308; ANNOT 1455308; CLONE ID no. 39922; ANNOT 1485544; ANNOT 1485544; ANNOT 1447051; ANNOT 1447051; ANNOT 1482074; ANNOT 1482074; CLONE ID no. 40501; ANNOT 40501; ANNOT | 201; 202; 203; 300; 301; 302; 303; 304; 325; 326; 327; 333; 334; 335; 336; 337; 380; 381; 382; 732; 733; 734; 832; 833; 834; 835; 836; 847; 848; 849; 850; 851; 852; 853; 1091; 1092; 1093; 1094; 1095; 1255; 1256; 1257; 1282; 1283; 1284; 1285; 1286; 1343; 1344; 1345; 1346; 1347; 1348; 1349; 1754; 1755; 1756; 1757; 1758; 1759; 1760; 1887; 1888; 1889; 1890; 1891; 1892; 1893; 1894; 1895; 1896; 1907; 1908; 1909; 1910; 1911; 1930; 1931; |

TABLE 1-continued

| Tissue | Phenotype Category | Phenotype | Phenotype Description | Applications | Ceres ID | SEQ ID NO |
|---|---|---|---|---|---|---|
| | | Activates expression of the gene endogenous to the PsBBE (SEQ ID NO 4103) regulatory region | Overexpression of the regulatory protein is able to promote the expression of the gene operably linked to the PsBBE (SEQ ID NO 4103) regulatory region | Useful for modulating Alkaloid Biosynthesis | 1453923; CLONE ID no. 40729; ANNOT 1481678; ANNOT 1481678; CLONE ID no. 42530; ANNOT 1490273; ANNOT 1490273; ANNOT 1446198; ANNOT 1446198; ANNOT 1455209; ANNOT 1530603; ANNOT 1530603; CLONE ID no. 42654; ANNOT 1454375; ANNOT 1454375; CLONE ID no. 95453; ANNOT 1460836; ANNOT 1460836; ANNOT 1450324; CLONE ID no. 100319; ANNOT 1503141; ANNOT 1450324; ANNOT 1521524; ANNOT 1521524; CLONE ID no. 108109; CLONE ID no. 120302; ANNOT 1450548; ANNOT 1450548; ANNOT 1460633; ANNOT 1460633; CLONE ID no. 1480232; ANNOT 1480232; ANNOT 1478804; ANNOT 1478804; CLONE ID no. 123105; ANNOT 1498819; ANNOT 1498819; CLONE ID no. 152633; ANNOT 1469954; ANNOT 1469954; CLONE ID no. 158734; ANNOT 1477956; ANNOT 1477956; CLONE ID no. 236747; ANNOT 1519379; CLONE ID no. 244916; ANNOT 1510619; CLONE ID no. 297374; ANNOT 1510619; ANNOT 1510619; ANNOT 1496506; CLONE ID no. 325800; ANNOT 1517851; ANNOT 1517851; ANNOT 1464534; ANNOT 1464534; ANNOT 1511678; ANNOT 1511678; ANNOT 1458433; ANNOT 1458433; ANNOT 1529923; ANNOT 1529923; CLONE ID no. 531768; ANNOT 1456366; ANNOT 1456366; ANNOT 1450869; ANNOT 1450869; ANNOT 1447944; ANNOT 1447944; CLONE ID no. 533314; ANNOT 1528846; ANNOT 1528846; ANNOT 1538329; ANNOT 1538329; CLONE ID no. 534311; ANNOT 1440272; ANNOT 1440272; ANNOT 1474707; ANNOT 1474707; CLONE ID no. 534367; ANNOT 1479391; ANNOT 1479391; ANNOT 1469954; ANNOT 1469954; ANNOT 1447025; ANNOT 1447025; ANNOT 1558933; ANNOT 1558933; ANNOT 1485513; ANNOT 1485513; CLONE ID no. 942964; ANNOT 1440785; ANNOT 1440785; CLONE ID no. 982869; ANNOT 1458219; ANNOT 1458219; ANNOT 1464757; ANNOT 1464757; CDNA ID no. 23368554; ANNOT 1444863; ANNOT 1444863; CDNA ID no. 23486285; ANNOT 1452123; ANNOT 1452123; CDNA ID no. 23492765; ANNOT 1521278; ANNOT 1521278; ANNOT 1467911; ANNOT 1467911; CDNA ID no. 2499742; ANNOT 1449879; ANNOT 1449879; CDNA ID no. 23499964; ANNOT 1441358; ANNOT 1441358; ANNOT 1457434; ANNOT 1457434; ANNOT 1514509; ANNOT 1514509; ANNOT 1461236; ANNOT 1461236; CDNA ID no. 23503364; CDNA ID no. 23505323; ANNOT 1473621; ANNOT 1473621; ANNOT 1521779; ANNOT 1521779; CDNA ID no. 23516633; ANNOT 1524883; ANNOT 1524883; ANNOT 1499918; ANNOT 1499918; ANNOT 1471472; ANNOT 1471472; CDNA ID no. 23523867; CDNA ID no. 23544992; ANNOT 1454621; ANNOT 1454621; | 1932; 2021; 2022; 2023; 2024; 2025; 2026; 2027; 2028; 2029; 2037; 2038; 2039; 2085; 2086; 2087; 2088; 2089; 2191; 2192; 2193; 2194; 2195; 2292; 2466; 2467; 2468; 2469; 2470; 2471; 2472; 2473; 2474; 2484; 2485; 2486; 2571; 2572; 2573; 2619; 2620; 2621; 2712; 2713; 2714; 2725; 2726; 2727; 2869; 2870; 2871; 2872; 2873; 2905; 2906; 2907; 2908; 2909; 2910; 2911; 2912; 2913; 2914; 2915; 3069; 3070; 3071; 3072; 3073; 3074; 3075; 3076; 3077; 3078; 3079; 3080; 3093; 3094; 3095; 3096; 3097; 3098; 3099; 3100; 3101; 3102; 3103; 3104; 3105; 3106; 3107; 3108; 3364; 3365; 3366; 3414; 3415; 3416; 3417; 3418; 3560; 3561; 3562; 3604; 3605; 3606; 3607; 3608; 3609; 3610; 3611; 3627; 3628; 3629; 3652; 3653; 3654; 3655; 3656; 3657; 3658; 3659; 3660; 3681; 3699; 3700; 3701; 3702; 3703; 3738; 3739; 3740; 3741; 3742; 3743; 3744; 3766; 3810; 3811; 3812; |
| WHOLE PLANT | Composition | | | | CLONE ID no. 6397; ANNOT 1486285; ANNOT 1486285; CLONE ID no. 7559; ANNOT 1469241; ANNOT 1469241; CLONE ID no. 7805; ANNOT 1518351; ANNOT 1518351; ANNOT 1475331; ANNOT 1475331; CLONE ID no. 21604; ANNOT 1473854; ANNOT 1473854; ANNOT 1521997; ANNOT 1521997; ANNOT 1468633; ANNOT 1468633; CLONE ID no. 21863; ANNOT 1464854; ANNOT 1464854; ANNOT 1511378; ANNOT 1511378; ANNOT 1454043; ANNOT 1454043; CLONE ID no. 32791; ANNOT 1540248; ANNOT 1540248; CLONE ID no. 35228; ANNOT 1445433; ANNOT 1445433; ANNOT 1498413; ANNOT 1498413; CLONE ID no. 94688; ANNOT 1498587; ANNOT 1498587; ANNOT 1525287; ANNOT 1525287; ANNOT 1525287; CLONE ID no. 208429; ANNOT 1457538; ANNOT 1457538; ANNOT 1510743; ANNOT 1510743; CLONE ID no. 297374; ANNOT 1510619; ANNOT 1510619; ANNOT 1496506; CLONE ID no. 355209; ANNOT 1498695; ANNOT 1498695; CLONE ID no. 480900; ANNOT 1461433; ANNOT 1461433; ANNOT 1438399; ANNOT 1438399; CLONE ID no. 952275; ANNOT 1515625; ANNOT 1484559; ANNOT 1484559; ANNOT 957981; ANNOT 1515625; ANNOT | 290; 291; 292; 325; 326; 327; 333; 334; 335; 336; 337; 847; 848; 849; 850; 851; 852; 853; 866; 867; 868; 869; 870; 871; 872; 1255; 1256; 1257; 1455; 1456; 1457; 1458; 1459; 2071; 2072; 2073; 2074; 2075; 2644; 2645; 2646; 2647; 2648; 2869; 2870; 2871; 2872; 2873; 2975; 2976; 2977; 3043; 3044; 3045; 3367; 3368; 3369; 3370; 3371; 3377; 3378; 3379; 3380; 3381; 3385; |

TABLE 1-continued

| Tissue | Phenotype Category | Phenotype | Phenotype Description | Applications | Ceres ID | SEQ ID NO |
|---|---|---|---|---|---|---|
| | | | | | 1515625; ANNOT 1489205; CLONE ID no. 965028; ANNOT 1438401; ANNOT 1438401; CDNA ID no. 13579142; ANNOT 1522260; ANNOT 1522260; ANNOT 1527806; ANNOT 1527806; CDNA ID no. 2348190; ANNOT 1522260; ANNOT 1522260; ANNOT 1527806; ANNOT 1527806; CDNA ID no. 2350216; ANNOT 1449874; ANNOT 1449874; ANNOT 1492655; ANNOT 1492655; ANNOT 1439788; ANNOT 1439788; | 3386; 3387; 3546; 3547; 3548; 3549; 3550; 3570; 3571; 3572; 3573; 3574; 3666; 3667; 3668; 3669; 3670; 3671; 3672; |
| WHOLE PLANT | Composition | Activates expression of the gene endogenous to the PsHMCOMT2 (SEQ ID NO 4105) regulatory region | Overexpression of the regulatory protein is able to promote the expression of the gene operably linked to the PsHMCOMT2 (SEQ ID NO 4105) regulatory region | Useful for modulating Alkaloid Biosynthesis | CLONE ID no. 11130; ANNOT 1466979; CLONE ID no. 21868; ANNOT 1446703; ANNOT 1446703; CLONE ID no. 35228; ANNOT 1445433; ANNOT 1445433; ANNOT 1498413; ANNOT 1498413; CLONE ID no. 39922; ANNOT 1485544; ANNOT 1485544; ANNOT 1447051; ANNOT 1447051; CLONE ID no. 40729; ANNOT 1481678; ANNOT 1481678; CLONE ID no. 41104; ANNOT 1489751; ANNOT 1489751; ANNOT 1446209; ANNOT 1446209; CLONE ID no. 325800; ANNOT 1517851; ANNOT 1517851; ANNOT 1464534; ANNOT 1464534; ANNOT 1511678; ANNOT 1511678; ANNOT 1458433; ANNOT 1458433; ANNOT 1529923; ANNOT 1529923; CLONE ID no. 471089; ANNOT 1531777; ANNOT 1531777; ANNOT 1508033; CLONE ID no. 480900; ANNOT 1461433; ANNOT 1461433; CLONE ID no. 965028; ANNOT 1460742; ANNOT 1460742; CDNA ID no. 1438401; CDNA ID no. 23498685; ANNOT 1459700; ANNOT 1459700; CDNA ID no. 23523867; CDNA ID no. 23655935; ANNOT 1457646; ANNOT 1457646; ANNOT 1518640; ANNOT 1518640; | 445; 446; 447; 873; 874; 875; 1455; 1456; 1457; 1458; 1459; 1892; 1893; 1894; 1895; 1896; 1930; 1931; 1932; 1962; 1963; 1964; 1965; 1966; 2905; 2906; 2907; 2908; 2909; 2910; 2911; 2912; 2913; 2914; 2915; 3009; 3010; 3011; 3012; 3013; 3043; 3044; 3045; 3385; 3386; 3387; 3649; 3650; 3651; 3766; 3846; 3847; 3848; 3849; 3850; 3851; 3852; 3853; |
| WHOLE PLANT | Composition | Activates expression of the gene endogenous to the PsROMT (SEQ ID NO 4104) regulatory region | Overexpression of the regulatory protein is able to promote the expression of the gene operably linked to the PsROMT (SEQ ID NO 4104) regulatory region | Useful for modulating Alkaloid Biosynthesis | CLONE ID no. 7805; ANNOT 1518351; ANNOT 1518351; ANNOT 1475331; ANNOT 1475331; CLONE ID no. 8788; ANNOT 1474018; ANNOT 1474018; CLONE ID no. 11130; ANNOT 1466979; CLONE ID no. 21863; ANNOT 1443194; ANNOT 1443194; ANNOT 1464854; ANNOT 1464854; ANNOT 1511378; ANNOT 1511378; ANNOT 1454043; ANNOT 1454043; ANNOT 1454043; CLONE ID no. 21868; ANNOT 1446703; ANNOT 1446703; CLONE ID no. 22350; ANNOT 1471704; ANNOT 1471704; CLONE ID no. 33333; ANNOT 1501772; ANNOT 1501772; ANNOT 1519164; ANNOT 1519164; ANNOT 1480076; ANNOT 1480076; ANNOT 1524008; ANNOT 1524008; ANNOT 1480159; ANNOT 1480159; CLONE ID no. 34944; ANNOT 1485544; ANNOT 1485544; ANNOT 1447051; ANNOT 1447051; CLONE ID no. 39893; ANNOT 1530660; ANNOT 1530660; ANNOT 1455308; ANNOT 1455308; CLONE ID no. 42654; ANNOT 1454375; ANNOT 1454375; ANNOT 1443194; ANNOT 1443194; ANNOT 1505312; ANNOT 1505312; CLONE ID no. 297374; ANNOT 1510619; ANNOT 1510619; ANNOT 1496506; ANNOT 1496506; CLONE ID no. 534311; ANNOT 1440272; ANNOT 1440272; ANNOT 1474707; ANNOT 1474707; CLONE ID no. 597609; ANNOT 1538274; ANNOT 1538274; ANNOT 1528771; ANNOT 1528771; ANNOT 1484866; ANNOT 1484866; CLONE ID no. 597624; ANNOT 1464039; ANNOT 1464039; CDNA ID no. 13610509; CDNA ID no. 23640482; ANNOT 1446359; ANNOT 1446359; ANNOT 1438865; ANNOT 1438865; CDNA ID no. 23653450; ANNOT 1441536; ANNOT 1441536; CDNA ID no. 23660631; ANNOT 1457646; ANNOT 1457646; ANNOT 1518640; ANNOT 1518640; | 333; 334; 335; 336; 337; 380; 381; 382; 445; 446; 447; 866; 867; 868; 869; 870; 871; 872; 873; 874; 875; 881; 882; 883; 1268; 1269; 1270; 1271; 1272; 1273; 1274; 1275; 1276; 1277; 1278; 1430; 1431; 1432; 1433; 1434; 1887; 1888; 1889; 1890; 1891; 2037; 2038; 2039; 2298; 2299; 2300; 2301; 2302; 2869; 2870; 2871; 2872; 2873; 3093; 3094; 3095; 3096; 3097; 3260; 3261; 3262; 3263; 3264; 3265; 3266; 3267; 3268; 3269; 3551; 3835; 3836; 3837; 3838; 3839; 3843; 3844; 3845; 3849; 3850; 3851; 3852; 3853; |
| WHOLE PLANT | Stress tolerance | Cold Growth | The plant grows faster at cold temperatures compared to control. | Useful for making plants with increased tolerance to cold stress | CLONE 2083; ANNOT 1441581; ANNOT 1441581; CLONE 4928; ANNOT 1442935; ANNOT 1442935; CLONE 4524; ANNOT 1442935; ANNOT 1466929; CLONE 7822; ANNOT 1446929; ANNOT 1466929; ANNOT 1447816; ANNOT 1447816; ANNOT 1500283; ANNOT 1500283; ANNOT 1511303; ANNOT 1511303; CLONE 19234; ANNOT 1469459; ANNOT 1469459; ANNOT 1542250; ANNOT 1542250; CLONE 33559; ANNOT 1481146; ANNOT 1481146; ANNOT 1481150; ANNOT 1481150; ANNOT 1481138; ANNOT 1485824; ANNOT 1485824; ANNOT 1534622; ANNOT 1534622; CLONE | 87; 88; 89; 204; 205; 206; 212; 213; 214; 338; 339; 340; 341; 342; 343; 344; 750; 751; 752; 753; 754; 1310; 1311; 1312; 1313; 1314; 1315; 1316; 1317; 1318; 1319; 1320; |

TABLE 1-continued

| Tissue | Phenotype Category | Phenotype | Phenotype Description | Applications | Ceres ID | SEQ ID NO |
|---|---|---|---|---|---|---|
| COTYLEDONS | Composition | Cup-shaped | The cotyledons are curled up at the cotyledon margins such that they form a cup or bowl-like shape | Useful for modifying seed structure and composition | 38277; ANNOT 1512884; ANNOT 1512884; CDNA 3653419; ANNOT 1459723; ANNOT 1459723; ANNOT 1516455; ANNOT 1516455; CLONE 13186; ANNOT 1464566; ANNOT 1464566; ANNOT 1458408; ANNOT 1458408; | 1714; 1715; 1716; 3995; 3996; 3997; 3998; 3999; 531; 532; 533; 534; 535; |
| ROSETTE LEAVES | Composition | Glabrous | The trichomes are totally absent. | Useful for making plants with altered chemical composition | CLONE 332; ANNOT-1474923; ANNOT 1474923; | 12; 13; 14; |
| WHOLE PLANT | Composition | High Anthocyanin | The plant is purple in color | Useful for modulating anthocyanin content | CLONE 1610; ANNOT 1454586; ANNOT 1454586; ANNOT 1475043; ANNOT 1475043; ANNOT 1507756; ANNOT 1507756; ANNOT 1469708; ANNOT 1469708; CLONE 6082; ANNOT 1443416; ANNOT 1443416; ANNOT 1505047; ANNOT 1505047; ANNOT 1496339; ANNOT 1496339; CLONE 8633; ANNOT 1527560; ANNOT 1527560; ANNOT 1522449; ANNOT 1522449; CLONE 13263; ANNOT 1470919; ANNOT 1470919; CLONE 13757; ANNOT 1471425; ANNOT 1471425; CLONE 32348; ANNOT 1470719; ANNOT 1470719; ANNOT 1543728; ANNOT 1543728; ANNOT 1482066; ANNOT 1482066; CLONE 32811; ANNOT 1475744; ANNOT 1475744; ANNOT 1454107; ANNOT 1454107; CLONE 36891; ANNOT 1480518; ANNOT 1480518; ANNOT 1442194; ANNOT 1442194; ANNOT 1454127; ANNOT 1454127; ANNOT 1461716; ANNOT 1461716; ANNOT 1440277; ANNOT 1440277; ANNOT 1461415; ANNOT 1461415; ANNOT 1461414; ANNOT 1461414; ANNOT 1447424; ANNOT 1447424; ANNOT 1528127; ANNOT 1528127; ANNOT 1438717; ANNOT 1438717; ANNOT 1440276; ANNOT 1440276; ANNOT 1471425; ANNOT 1442556; ANNOT 1442556; ANNOT 1452873; ANNOT 1452873; ANNOT 1453483; ANNOT 1453483; ANNOT 1473384; ANNOT 1473384; ANNOT 1475808; ANNOT 1475808; CLONE 42925; ANNOT 1462354; ANNOT 1462354; ANNOT 1474708; ANNOT 1474708; ANNOT 1438698; ANNOT 1438698; CLONE 92670; ANNOT 153191; ANNOT 153191; CLONE 101686; ANNOT 1479756; ANNOT 1479756; ANNOT 1540137; ANNOT 1540137; ANNOT 1486722; ANNOT 1486722; CLONE 107311; ANNOT 1480518; ANNOT 1442194; ANNOT 1442194; ANNOT 1454127; ANNOT 1454127; ANNOT 1461414; ANNOT 1461414; ANNOT 1447424; ANNOT 1447424; ANNOT 1447424; ANNOT 1452556; ANNOT 1452873; ANNOT 1452873; ANNOT 1474708; ANNOT 1474708; ANNOT 1474708; CLONE 110454; CLONE 224062; ANNOT 1541034; ANNOT 1541034; CLONE 254065; ANNOT 1485544; ANNOT 1485544; ANNOT 1447051; ANNOT 1447051; ANNOT 1517016; ANNOT 1517016; CLONE 1001432; ANNOT 1475043; ANNOT 1475043; ANNOT 1454586; ANNOT 1454586; ANNOT 1507756; ANNOT 1507756; ANNOT 1469708; | 67; 68; 69; 70; 71; 72; 73; 74; 75; 268; 269; 270; 271; 272; 273; 274; 375; 376; 377; 378; 379; 536; 537; 538; 564; 565; 566; 1219; 1220; 1221; 1222; 1223; 1224; 1225; 1258; 1259; 1260; 1261; 1262; 1548; 1549; 1550; 1551; 1552; 1553; 1554; 1555; 1556; 1557; 1558; 1559; 1560; 1561; 1562; 1563; 1564; 1565; 1566; 1567; 1568; 1569; 1570; 1571; 1572; 1573; 1574; 1575; 1576; 1577; 1578; 1579; 1580; 1581; 1582; 1583; 1584; 2045; 2046; 2047; 2061; 2062; 2063; 2212; 2213; 2214; 2215; 2216; 2217; 2218; 2263; 2264; 2265; 2266; 2267; 2268; 2269; 2270; 2271; 2272; 2273; 2274; 2275; 2276; 2277; 2313; 2652; 2653; 2654; 2731; 2732; 2733; 2734; 2735; 2736; 2737; 3419; 3420; 3421; 3422; 3423; 3424; 3425; 3426; 3427; |
| SEED | Composition | Light Color | The seed is abnormally light in color. | Useful for modifying fiber content in seed | CLONE 38370; ANNOT 1471869; ANNOT 1471869; ANNOT 1448032; ANNOT 1448032; ANNOT 1448031; ANNOT 1448031; ANNOT 1438060; ANNOT 1438060; ANNOT 1438061; ANNOT 1438061; ANNOT 1448030; ANNOT 1448030; ANNOT 1437831; ANNOT 1437831; | 1732; 1733; 1734; 1735; 1736; 1737; 1738; 1739; 1740; 1741; 1742; 1743; 1744; 1745; 1746; |
| WHOLE PLANT | Composition | Metabolic | The plants have | Useful for | CLONE 2121; ANNOT 1500813; ANNOT 1500813; ANNOT 1491102; ANNOT | 90; 91; 92; 93; 94; 902; |

TABLE 1-continued

| Tissue | Phenotype Category | Phenotype | Phenotype Description | Applications | Ceres ID | SEQ ID NO |
|---|---|---|---|---|---|---|
| | | Profiling | altered metabolic profiles. | making plants with enhanced metabolite accumulation | 1491102; CLONE 23439; ANNOT 1461748; ANNOT 1492747; ANNOT 1492747; CLONE 39378; ANNOT 1527229; ANNOT 1473809; ANNOT 1473809; | 903; 904; 905; 906; 1863; 1864; 1865; 1866; 1867; |
| COTYLEDONS | Composition | Other | The plants have a morphological phenotype in cotyledons. | Useful for modifying seed structure and composition | CLONE 13800; ANNOT 1458335; ANNOT 1464663; ANNOT 1464663; | 572; 573; 574; 575; 576; |
| SEED | Composition | Other | The plants have a morphological phenotype in seeds. | Useful for modifying seed content | CLONE 4058; ANNOT 1468992; ANNOT 1468992; ANNOT 1444098; ANNOT 1444098; ANNOT 1474224; ANNOT 1524351; ANNOT 1524351; | 187; 188; 189; 190; 191; 192; 193; 194; 195; |
| SILIQUES | Composition, Yield | Bent | The silique has a sharp bend to it part of the way down the length of the silique; this bend can be as much as approaching 90 degrees | Useful for modifying fruit shape, composition and seed yield | CLONE 35493; ANNOT 1457751; ANNOT 1518757; ANNOT 1518757; ANNOT 1465420; CLONE 100245; ANNOT 1535451; ANNOT 1535451; ANNOT 1532285; ANNOT 1532285; ANNOT 1480241; ANNOT 1480241; ANNOT 1446025; ANNOT 1446025; CLONE 158333; ANNOT 1466505; ANNOT 1466505; ANNOT 1449026; ANNOT 1449026; | 1460; 1461; 1462; 1463; 1464; 1465; 1466; 2182; 2183; 2184; 2185; 2186; 2187; 2188; 2189; 2190; 2611; 2612; 2613; 2614; 2615; |
| SILIQUES | Composition, Yield | Clubbed | The silique is somewhat bulbous at its terminal end. | Useful for modifying fruit shape, composition and seed yield | CLONE 38743; ANNOT 1448369; CLONE 38743; ANNOT 1448369; ANNOT 1535451; ANNOT 1532285; ANNOT 1480241; ANNOT 1480241; ANNOT 1446025; ANNOT 1446025; ANNOT 1447690; ANNOT 1491278; ANNOT 1500987; ANNOT 1500987; ANNOT 1490915; ANNOT 1490915; | 1788; 1789; 1790; 2182; 2183; 2184; 2185; 2186; 2187; 2188; 2189; 2190; 3687; 3688; 3689; 3690; 3691; 3692; 3693; 3694; 3695; |
| SILIQUES | Composition, Yield | Long | Then silique is abnormally long. | Useful for increasing seed/fruit yield or modifying fruit content | CLONE 23322; ANNOT 1512337; ANNOT 1512337; ANNOT 1517094; ANNOT 1517094; | 897; 898; 899; 900; 901; |
| SILIQUES | Composition, Yield | Other | The plants have a morphological phenotype in siliques. | Useful for increasing seed/fruit yield or modifying fruit content | CLONE 13092; ANNOT 1471785; ANNOT 1471785; CLONE 13186; ANNOT 1464566; ANNOT 1464566; ANNOT 1458408; CLONE 13263; ANNOT 1470919; CLONE 20760; ANNOT 1462351; ANNOT 1462351; ANNOT 1488821; ANNOT 1488821; ANNOT 1469462; ANNOT 1469462; CLONE 32791; ANNOT 1540248; ANNOT 1540248; CLONE 35493; ANNOT 1457751; ANNOT 1457751; ANNOT 1518757; ANNOT 1518757; ANNOT 1465420; ANNOT 1465420; CLONE 40729; ANNOT 1481678; ANNOT 1481678; CLONE 9741S; ANNOT 1481701; ANNOT 1481701; CLONE 101250; CLONE 1506849; ANNOT 1506849; CLONE 13833; ANNOT 1474944; ANNOT 1474944; ANNOT 1492957; ANNOT 1492957; CLONE 158333; ANNOT 1466505; ANNOT 1466505; ANNOT 1449026; ANNOT 1449026; CLONE 283597; ANNOT 1482074; ANNOT 1482074; ANNOT 1482074; CLONE 292789; ANNOT 1442040; ANNOT 1442040; ANNOT 1453923; ANNOT 1453923; CLONE 292789; ANNOT 1482966; ANNOT 1454656; ANNOT 1454656; ANNOT 1458103; ANNOT 1458103; ANNOT 1482966; ANNOT 1464899; ANNOT 1464899; ANNOT 1474837; ANNOT 1474837; ANNOT 1520449; ANNOT 1538169; ANNOT | 528; 529; 530; 531; 532; 533; 534; 535; 536; 537; 538; 808; 809; 810; 811; 812; 813; 814; 1255; 1256; 1257; 1460; 1461; 1462; 1463; 1464; 1465; 1466; 1930; 1931; 1932; 2100; 2101; 2102; 2205; 2206; 2207; 2208; 2209; 2210; 2211; 2611; 2612; 2613; 2614; 2615; 2833; 2834; 2835; 2836; 2837; 2852; 2853; 2854; 2855; 2856; 2857; 2858; 2859; 2860; 2861; 2862; 2863; |

TABLE 1-continued

| Tissue | Phenotype Category | Phenotype | Phenotype Description | Applications | Ceres ID | SEQ ID NO |
|---|---|---|---|---|---|---|
| | | | | | 1538169; CDNA 2349814S; ANNOT 1482362; ANNOT 1489077; ANNOT 1489077; | 2864; 2865; 2866; 2867; 2868; 3641; 3642; 3643; 3644; 3645; |
| SILIQUES | Composition, Yield | Short | The siliques are abnormally short. | Useful for increasing seed/fruit yield or modifying fruit content | CLONE 4581; ANNOT 1489321; ANNOT 1462498; ANNOT 1462498; CLONE 6411; ANNOT 1505322; ANNOT 1496110; ANNOT 1496110; ANNOT 1496111; ANNOT 1496111; CLONE 9897; ANNOT 1445849; ANNOT 1445849; CLONE 13263; ANNOT 1500561; ANNOT 1464458; ANNOT 1464458; CLONE 13263; ANNOT 1470919; ANNOT 1470919; CLONE 13757; ANNOT 1471425; ANNOT 1471425; CLONE 14583; ANNOT 1530256; ANNOT 1530256; CLONE 23322; ANNOT 1476783; ANNOT 1476783; ANNOT 1503166; ANNOT 1503166; CLONE 23322; ANNOT 1512337; ANNOT 1512337; ANNOT 1517094; ANNOT 1517094; CLONE 32791; ANNOT 1540248; ANNOT 1540248; CLONE 34385; ANNOT 1445331; ANNOT 1445331; ANNOT 1498316; ANNOT 1498316; CLONE 34414; ANNOT 1471525; ANNOT 1471525; ANNOT 1497838; ANNOT 1497838; ANNOT 1511908; ANNOT 1511908; ANNOT 1464305; ANNOT 1464305; ANNOT 1451416; ANNOT 1451416; ANNOT 1521524; ANNOT 1514324; ANNOT 1514324; ANNOT 1461050; ANNOT 1461050; CLONE 40729; ANNOT 1481678; ANNOT 1481678; CLONE 99784; ANNOT 1521032; ANNOT 1521032; ANNOT 1472909; ANNOT 1472909; ANNOT 1467665; CLONE 100319; ANNOT 1503141; ANNOT 1503141; ANNOT 1521524; ANNOT 1103581; ANNOT 1486398; ANNOT 1486398; ANNOT 1496840; ANNOT 1496840; CLONE 105554; ANNOT 1451783; ANNOT 1451783; CLONE 10630I; CLONE 110247; ANNOT 1528846; ANNOT 1528846; ANNOT 1538329; CLONE 112955; ANNOT 1447634; ANNOT 1447634; CLONE 117369; ANNOT 1499284; ANNOT 1499284; ANNOT 1481671; ANNOT 1481671; CLONE 124720; ANNOT 1441430; ANNOT 1441430; CLONE 288251; ANNOT 1493218; ANNOT 1493218; ANNOT 1514617; ANNOT 1514617; ANNOT 1461345; ANNOT 1461345; CLONE 572121; ANNOT 1477450; ANNOT 1477450; CDNA 36531424; ANNOT 1474253; ANNOT 1474253; ANNOT 1473720; ANNOT 1473720; | 207; 208; 209; 210; 211; 293; 294; 295; 296; 297; 298; 299; 405; 406; 407; 408; 409; 410; 411; 536; 537; 538; 564; 565; 566; 619; 620; 621; 622; 623; 624; 625; 897; 898; 899; 900; 901; 1255; 1256; 1257; 1364; 1365; 1366; 1367; 1368; 1383; 1384; 1385; 1386; 1387; 1388; 1389; 1390; 1391; 1392; 1393; 1394; 1395; 1396; 1397; 1930; 1931; 1932; 2161; 2162; 2163; 2164; 2165; 2166; 2167; 2191; 2192; 2193; 2194; 2195; 2232; 2233; 2234; 2235; 2236; 2247; 2248; 2249; 2262; 2308; 2309; 2310; 2311; 2312; 2330; 2331; 2332; 2407; 2408; 2409; 2410; 2411; 2501; 2502; 2503; 2845; 2846; 2847; 2848; 2849; 2850; 2851; 3252; 3253; 3254; 3923; 3924; 3925; 3926; 3927; |
| SILIQUES | Composition, Yield | Sickle | The silique is curved. | Useful for modifying fruit shape, composition and seed yield | CLONE 28528; ANNOT 1477416; ANNOT 1477416; CDNA 36560856; ANNOT 1517998; ANNOT 1517998; ANNOT 1458313; ANNOT 1458313; | 1096; 1097; 1098; 4008; 4009; 4010; 4011; 4012; |
| FLOWER | Confinement | Aborted fertility | The ovule is unfertilized and appears as a brown or white speck in the | Useful for sterility, genetic confinement systems | CLONE 38973; ANNOT 1451899; ANNOT 1451899; ANNOT 1496367; ANNOT 1496367; CLONE 39890; ANNOT 1511886; ANNOT 1511886; ANNOT 1517635; ANNOT 1517635; CLONE 101250; ANNOT 1506849; ANNOT 1506849; ANNOT 1474944; ANNOT 1474944; ANNOT 1492957; ANNOT 1492957; | 1818; 1819; 1820; 1821; 1822; 1882; 1883; 1884; 1885; 1886; 2205; 2206; 2207; 2208; 2209; 2210; 2211; |
| FLOWER | Confinement | Male-sterile | mature silique There is a problem with the pollen such that no fertilization is occurring. | Useful for sterility, genetic confinement systems | CLONE 32791; ANNOT 1540248; ANNOT 1540248; | 1255; 1256; 1257; |

TABLE 1-continued

| Tissue | Phenotype Category | Phenotype | Phenotype Description | Applications | Ceres ID | SEQ ID NO |
|---|---|---|---|---|---|---|
| WHOLE SEEDLING | Confinement | Meristem Mutant | The plants have something significantly wrong with how the meristem is producing its leaves. | Useful for making lethal plants for genetic confinement systems | CLONE 907; ANNOT 1502138; ANNOT 1502138; ANNOT 1449135; ANNOT 1449135; | 30; 31; 32; 33; 34; |
| FLOWER | Confinement | Reduced fertility | The plant produces a reduced number of seeds. | Useful for sterility, genetic confinement systems | CLONE 75; ANNOT 1503293; CLONE 314; ANNOT 1503293; CLONE 332; ANNOT 1474923; ANNOT 1474923; CLONE 641; ANNOT 1543129; CLONE 332; ANNOT 1474923; ANNOT 1474923; CLONE 641; ANNOT 1488536; ANNOT 1488536; ANNOT 1460253; ANNOT 1460253; CLONE 907; ANNOT 1502138; ANNOT 1502138; ANNOT 1449135; ANNOT 1449135; CLONE 1496; ANNOT 1490668; ANNOT 1490668; ANNOT 1474027; ANNOT 1474027; ANNOT 1497865; ANNOT 1497865; ANNOT 1471512; ANNOT 1471512; ANNOT 1443061; ANNOT 1443061; ANNOT 1452369; ANNOT 1504203; ANNOT 1504203; ANNOT 1505468; ANNOT 1505468; ANNOT 1452369; CLONE 2036; ANNOT 1526068; CLONE 2561; CLONE 2561; ANNOT 1450958; ANNOT 1450958; ANNOT 1456475; ANNOT 1456475; ANNOT 1446945; ANNOT 1446945; CLONE 3000; ANNOT 1518918; ANNOT 1518918; ANNOT 1535677; ANNOT 1535677; ANNOT 1456840; ANNOT 1456840; CLONE 3363; CLONE 3036; ANNOT 1456840; ANNOT 1456840; CLONE 3363; ANNOT 1445515; ANNOT 1445515; ANNOT 1461861; ANNOT 1461861; ANNOT 1449363; ANNOT 1449363; ANNOT 1465198; ANNOT 1465198; ANNOT 1465198; ANNOT 1518517; ANNOT 1518517; CLONE 3819; ANNOT 1441039; ANNOT 1441039; ANNOT 1482966; ANNOT 1482966; ANNOT 1454656; ANNOT 1454656; ANNOT 1528263; CLONE 10857; ANNOT 1464899; ANNOT 1464899; ANNOT 1458103; ANNOT 1458103; ANNOT 1442040; ANNOT 1442040; ANNOT 1464899; ANNOT 1458103; CLONE 3853; ANNOT 1488920; ANNOT 1488920; ANNOT 1520449; CLONE 3853; ANNOT 1488920; ANNOT 1488920; ANNOT 1469361; ANNOT 1469361; CLONE 4067; ANNOT 1514362; ANNOT 1514362; ANNOT 1494090; ANNOT 1494090; CLONE 5167; ANNOT 1465422; ANNOT 1465422; ANNOT 1457750; ANNOT 1457750; ANNOT 1513544; ANNOT 1513544; CLONE 5597; ANNOT 1507708; ANNOT 1507708; ANNOT 1475094; ANNOT 1475094; CLONE 6387; ANNOT 1509111; ANNOT 1509111; ANNOT 1541620; ANNOT 1541620; CLONE 6397; ANNOT 1486285; ANNOT 1486285; CLONE 6630; CLONE 12914; ANNOT 1529141; ANNOT 1475689; ANNOT 1475689; ANNOT 1476577; ANNOT 1476577; CLONE 8265; ANNOT 1438919; ANNOT 1438919; ANNOT 1499398; ANNOT 1499398; ANNOT 1446419; ANNOT 1446419; CLONE 8916; ANNOT 1462804; ANNOT 1462804; CLONE 9132; ANNOT 1458620; ANNOT 1458620; CLONE 10857; ANNOT 1464446; ANNOT 1464446; CLONE 12250; ANNOT 1497150; ANNOT 1497150; ANNOT 1524446; ANNOT 1524446; CLONE 13092; ANNOT 1471785; ANNOT 1471785; CLONE 13263; ANNOT 1470919; ANNOT 1470919; CLONE 13391; ANNOT 1445555; ANNOT 1445555; CLONE 13745; ANNOT 1502315; ANNOT 1502315; ANNOT 1442612; ANNOT 1442612; ANNOT 1442608; ANNOT 1442604; ANNOT 1442604; ANNOT 1442608; ANNOT 1452827; ANNOT 1452827; CLONE 13757; ANNOT 1442158; ANNOT 1471425; ANNOT 1471425; CLONE 13767; ANNOT 1542158; ANNOT 1542158; ANNOT 1488730; ANNOT 1488730; CLONE 14583; ANNOT 1530256; ANNOT 1530256; ANNOT 1476783; ANNOT 1476783; ANNOT 1503166; ANNOT 1503166; CLONE 15343; ANNOT 1440753; ANNOT 1440753; CLONE 16865; ANNOT 1454311; ANNOT 1454311; ANNOT 1483290; ANNOT 1483290; ANNOT 1533930; ANNOT 1533930; ANNOT 1450556; ANNOT 1450556; ANNOT 1533218; ANNOT 1533218; ANNOT 1512378; ANNOT 1512378; CLONE 18246; ANNOT 1489791; | 6; 7; 8; 9; 10; 11; 12; 13; 14; 25; 26; 27; 28; 29; 30; 31; 32; 33; 34; 50; 51; 52; 53; 54; 55; 56; 57; 58; 59; 60; 61; 62; 63; 64; 65; 66; 84; 85; 86; 104; 105; 106; 107; 108; 109; 110; 111; 112; 113; 114; 115; 116; 117; 121; 122; 123; 129; 130; 131; 132; 133; 134; 135; 136; 137; 138; 139; 153; 154; 155; 156; 157; 158; 159; 160; 161; 162; 163; 164; 165; 166; 167; 168; 169; 170; 171; 172; 173; 174; 196; 197; 198; 199; 200; 223; 224; 225; 226; 227; 228; 229; 233; 234; 235; 236; 237; 285; 286; 287; 288; 289; 290; 291; 292; 305; 306; 307; 308; 309; 310; 311; 362; 363; 364; 365; 366; 367; 368; 388; 389; 390; 391; 392; 393; 434; 435; 436; 510; 511; 512; 513; 514; 528; 529; 530; 536; 537; 538; 539; 540; 541; 542; 543; 555; 556; 557; 558; 559; 560; 561; 562; 563; 564; 565; 566; 567; 568; 569; 570; 571; 619; 620; 621; 622; 623; 624; 625; 641; 642; 643; 650; 651; 652; 653; 654; 655; 656; 657; 658; 659; 660; 661; 662; 715; 716; 717; 718; 719; 762; 763; 764; 765; 766; 808; 809; 810; 811; 812; 813; 814; 876; 877; 878; 879; 880; 928; 929; 930; 931; 932; 933; 934; 935; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1489791; ANNOT 1470953; CLONE 19481; ANNOT 1475146; ANNOT 1475146; ANNOT 1454933; ANNOT 1470953; CLONE 20760; ANNOT 1462351; ANNOT 1462351; ANNOT 1488821; ANNOT 1488821; ANNOT 1469462; ANNOT 1469462; CLONE 22007; ANNOT 1464350; ANNOT 1464350; ANNOT 1458591; ANNOT 1458591; CLONE 23771; ANNOT 144030; ANNOT 1444030; ANNOT 1486813; ANNOT 1485303; ANNOT 1485303; ANNOT 1446796; ANNOT 1446796; CLONE 24266; ANNOT 1463475; ANNOT 1463475; ANNOT 1540920; ANNOT 1540920; ANNOT 1487528; ANNOT 1487528; CLONE 24644; ANNOT 1463301; ANNOT 1463301; ANNOT 1459811; ANNOT 1459811; CLONE 25172; ANNOT 1457346; ANNOT 1457346; ANNOT 1541170; ANNOT 1541170; CLONE 25607; ANNOT 1450220; ANNOT 1450220; CLONE 25886; ANNOT 1446650; ANNOT 1446650; ANNOT 1439514; ANNOT 1439514; ANNOT 1477202; ANNOT 1477202; ANNOT 1455325; ANNOT 1455325; CLONE 26560; ANNOT 1536088; ANNOT 1536088; ANNOT 1482610; ANNOT 1482610; ANNOT 26825; ANNOT 1513438; ANNOT 1513438; ANNOT 1460167; ANNOT 1460167; ANNOT 1460167; CLONE 27197; ANNOT 1448819; ANNOT 1448819; ANNOT 1465787; ANNOT 1465787; CLONE 28326; ANNOT 1468461; ANNOT 1468461; CLONE 28643; ANNOT 1469464; ANNOT 1469464; ANNOT 1463508; ANNOT 1463508; ANNOT 1459366; ANNOT 1459366; ANNOT 1542246; ANNOT 1542246; CLONE 32548; ANNOT 1450324; ANNOT 1450324; ANNOT 1460836; ANNOT 1460836; CLONE 32753; ANNOT 1480607; ANNOT 1480607; ANNOT 1472242; ANNOT 1472242; CLONE 32791; ANNOT 1540248; ANNOT 1540248; CLONE 33232; 33559; ANNOT 1504045; ANNOT 1504045; ANNOT 1450983; ANNOT 1450983; CLONE 1481138; ANNOT 1481146; ANNOT 1481146; ANNOT 1481150; ANNOT 1481150; ANNOT 1534622; ANNOT 1481138; ANNOT 1485824; ANNOT 1485824; ANNOT 1452709; ANNOT 1534622; CLONE 33802; ANNOT 1495637; ANNOT 1495637; ANNOT 34151; ANNOT 1452709; ANNOT 1442724; ANNOT 1442724; CLONE 34210; ANNOT 1473827; ANNOT 1473827; ANNOT 1468614; ANNOT 1468614; CLONE 1495936; CLONE 34385; ANNOT 1445331; ANNOT 1445331; ANNOT 1498316; ANNOT 1495936; CLONE 36891; ANNOT 1503622; ANNOT 1503622; ANNOT 1450565; ANNOT 1450565; ANNOT 1498316; CLONE 34414; ANNOT 1471525; ANNOT 1471525; ANNOT 1497838; ANNOT 1497838; ANNOT 1511908; ANNOT 1511908; ANNOT 1464305; ANNOT 1464305; ANNOT 1451416; ANNOT 1451416; ANNOT 1514324; ANNOT 1514324; ANNOT 1461050; ANNOT 1461050; CLONE 36701; ANNOT 1487885; ANNOT 1487885; ANNOT 1457156; ANNOT 1457156; ANNOT 1449371; ANNOT 1449371; ANNOT 1445504; ANNOT 1445504; CLONE 36709; ANNOT 1495936; ANNOT 1495936; ANNOT 1480518; ANNOT 1480518; ANNOT 1442194; ANNOT 1442194; ANNOT 1454127; ANNOT 1454127; ANNOT 1461716; ANNOT 1461716; ANNOT 1440277; ANNOT 1440277; ANNOT 1461415; ANNOT 1461415; ANNOT 1461414; ANNOT 1461414; ANNOT 1447424; ANNOT 1447424; ANNOT 1528127; ANNOT 1528127; ANNOT 1438717; ANNOT 1438717; ANNOT 1452873; ANNOT 1440276; ANNOT 1440276; ANNOT 1442556; ANNOT 1442556; ANNOT 1452873; ANNOT 1473384; ANNOT 1452873; ANNOT 1453483; ANNOT 1453483; ANNOT 1473384; ANNOT 1473384; ANNOT 1475808; ANNOT 1475808; ANNOT 1474708; ANNOT 1474708; ANNOT 1438698; ANNOT 1438698; CLONE 37288; ANNOT 1453650; ANNOT 1453650; CLONE 37398; ANNOT 1531721; ANNOT 1531721; ANNOT 1478221; ANNOT 1478221; ANNOT 1482547; ANNOT 1482547; CLONE 37493; ANNOT 1494370; ANNOT 1494370; ANNOT 1441478; ANNOT 1441478; CLONE 38370; ANNOT 1471869; ANNOT 1471869; ANNOT 1448032; ANNOT 1448032; ANNOT 1448031; ANNOT 1448031; ANNOT 1438060; ANNOT 1438060; ANNOT 1438061; | 936; 937; 938; 939; 940; 941; 942; 943; 944; 945; 946; 947; 948; 952; 953; 954; 955; 956; 970; 971; 972; 986; 987; 988; 989; 990; 991; 992; 993; 994; 1015; 1016; 1017; 1018; 1019; 1030; 1031; 1032; 1033; 1034; 1050; 1051; 1052; 1053; 1054; 1088; 1089; 1090; 1122; 1123; 1124; 1125; 1126; 1127; 1128; 1129; 1130; 1231; 1232; 1233; 1234; 1235; 1250; 1251; 1252; 1253; 1254; 1255; 1256; 1257; 1263; 1264; 1265; 1266; 1267; 1310; 1311; 1312; 1313; 1314; 1315; 1316; 1317; 1318; 1319; 1320; 1321; 1322; 1323; 1324; 1325; 1326; 1327; 1338; 1339; 1340; 1341; 1342; 1350; 1351; 1352; 1353; 1354; 1364; 1365; 1366; 1367; 1368; 1383; 1384; 1385; 1386; 1387; 1388; 1389; 1390; 1391; 1392; 1393; 1394; 1395; 1396; 1397; 1536; 1537; 1538; 1539; 1540; 1541; 1542; 1543; 1544; 1545; 1546; 1547; 1548; 1549; 1550; 1551; 1552; 1553; 1554; 1555; 1556; 1557; 1558; 1559; 1560; 1561; 1562; 1563; 1564; 1565; 1566; 1567; 1568; 1569; 1570; 1571; 1572; 1573; 1574; 1575; 1576; 1577; 1578; 1579; 1580; 1581; 1582; 1583; 1584; 1622; 1623; 1624; 1630; 1631; 1632; 1633; 1634; 1635; 1636; 1637; 1638; 1639; 1640; 1641; 1732; 1733; 1734; 1735; 1736; 1737; 1738; 1739; 1740; 1741; 1742; 1743; 1744; 1745; 1746; 1791; 1792; 1793; 1794; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1438061; ANNOT 1448030; ANNOT 1437831; ANNOT 1437831; CLONE 38757; ANNOT 1528846; ANNOT 1538329; ANNOT 1538329; CLONE 38785; ANNOT 1461193; ANNOT 1514466; ANNOT 1514466; CLONE 38843; ANNOT 1447896; ANNOT 1438197; ANNOT 1438197; CLONE 39127; ANNOT 1463852; ANNOT 1463852; CLONE 39286; ANNOT 1447961; ANNOT 1490936; ANNOT 1490936; CLONE 39351; ANNOT 1503551; ANNOT 1460689; ANNOT 1460689; ANNOT 1513952; ANNOT 1450495; ANNOT 1450495; CLONE 39740; ANNOT 1483180; ANNOT 1480950; ANNOT 1480950; CLONE 39890; ANNOT 1511886; ANNOT 1517635; ANNOT 1517635; CLONE 40153; ANNOT 1453549; ANNOT 1453549; ANNOT 1528184; ANNOT 1474758; CLONE 40729; ANNOT 1481678; CLONE 41320; ANNOT 1541929; ANNOT 1460282; ANNOT 1488507; ANNOT 1488507; CLONE 93867; ANNOT 1474944; ANNOT 1506849; ANNOT 1492957; CLONE 95453; ANNOT 1460836; ANNOT 1460836; ANNOT 1450324; ANNOT 1450324; CLONE 96020; ANNOT 1450365; ANNOT 1460794; ANNOT 1460794; CLONE 97415; ANNOT 1481701; CLONE 98855; ANNOT 1460836; ANNOT 1460836; ANNOT 1450324; CLONE 99784; ANNOT 1521032; ANNOT 1521032; ANNOT 1472909; ANNOT 1467665; ANNOT 1467665; CLONE 100245; ANNOT 1535451; ANNOT 1532285; ANNOT 1532285; ANNOT 1480241; ANNOT 1480241; ANNOT 1446025; ANNOT 1446025; CLONE 100319; ANNOT 1503141; ANNOT 1521524; ANNOT 1521524; CLONE 101798; ANNOT 1449432; ANNOT 1449432; ANNOT 1449431; ANNOT 1502439; ANNOT 1502439; CLONE 103581; ANNOT 1486398; ANNOT 1486398; ANNOT 1496840; ANNOT 1496840; CLONE 107988; ANNOT 1459927; ANNOT 1459927; CLONE 110247; ANNOT 1528846; ANNOT 1528846; ANNOT 1538329; ANNOT 1538329; CLONE 112955; ANNOT 1447634; ANNOT 1447634; CLONE 115975; ANNOT 1507138; ANNOT 1507138; CLONE 116257; ANNOT 1520806; ANNOT 1520806; ANNOT 1473089; ANNOT 1473089; ANNOT 1500150; CLONE 117369; ANNOT 1499284; ANNOT 1499284; ANNOT 1480439; ANNOT 1481671; CLONE 119256; ANNOT 1469636; ANNOT 1469636; ANNOT 1479002; ANNOT 1479002; CLONE 122353; ANNOT 1472265; ANNOT 1472265; CLONE 123279; ANNOT 1508945; ANNOT 1508945; ANNOT 1531332; ANNOT 1482544; ANNOT 1482544; ANNOT 1478226; CLONE 124720; ANNOT 1441430; ANNOT 1441430; CLONE 141830; ANNOT 1488335; ANNOT 1475653; ANNOT 1475653; ANNOT 1458131; ANNOT 1458131; ANNOT 1461780; ANNOT 1461780; CLONE 150912; ANNOT 1533910; ANNOT 1533910; ANNOT 1480439; ANNOT 1480439; CLONE 154718; ANNOT 1457453; ANNOT 1457453; CLONE 156655; ANNOT 1441740; ANNOT 1441740; CLONE 157730; ANNOT 1532681; ANNOT 1532681; ANNOT 1469739; ANNOT 1469739; CLONE 158333; ANNOT 1466505; ANNOT 1466505; ANNOT 1449026; ANNOT 1449026; ANNOT 1501773; ANNOT 1501773; CLONE 158702; ANNOT 158734; ANNOT 1477956; ANNOT 1477956; CLONE 226818; ANNOT 1503617; ANNOT 1503617; ANNOT 1450560; ANNOT 1450560; ANNOT 1460622; ANNOT 1460622; CLONE 267564; ANNOT 1473933; ANNOT 1473933; ANNOT 1468704; ANNOT 1468704; CLONE 267657; ANNOT 1471473; ANNOT 1471473; ANNOT 1457048; 1444931; ANNOT 1444931; CLONE 270875; ANNOT 1457048; | 1795; 1796; 1797; 1798; 1799; 1800; 1801; 1802; 1803; 1804; 1805; 1823; 1824; 1825; 1838; 1839; 1840; 1841; 1842; 1854; 1855; 1856; 1857; 1858; 1859; 1860; 1861; 1862; 1877; 1878; 1879; 1880; 1881; 1882; 1883; 1884; 1885; 1886; 1897; 1898; 1899; 1900; 1901; 1902; 1903; 1930; 1931; 1932; 1981; 1982; 1983; 1984; 1985; 1986; 1987; 2064; 2065; 2066; 2067; 2068; 2069; 2070; 2085; 2086; 2087; 2088; 2089; 2095; 2096; 2097; 2098; 2099; 2100; 2101; 2102; 2118; 2119; 2120; 2121; 2122; 2161; 2162; 2163; 2164; 2165; 2166; 2167; 2182; 2183; 2184; 2185; 2186; 2187; 2188; 2189; 2190; 2191; 2192; 2193; 2194; 2195; 2219; 2220; 2221; 2222; 2223; 2224; 2225; 2232; 2233; 2234; 2235; 2236; 2278; 2279; 2280; 2308; 2309; 2310; 2311; 2312; 2330; 2331; 2332; 2373; 2374; 2375; 2394; 2395; 2396; 2397; 2398; 2399; 2400; 2407; 2408; 2409; 2410; 2411; 2451; 2452; 2453; 2454; 2455; 2481; 2482; 2483; 2492; 2493; 2494; 2495; 2496; 2497; 2498; 2499; 2500; 2501; 2502; 2503; 2520; 2521; 2522; 2533; 2534; 2535; 2536; 2537; 2538; 2539; 2555; 2556; 2557; 2558; 2559; 2577; 2578; 2579; 2580; 2581; 2582; 2601; 2602; 2603; 2604; 2605; 2611; 2612; 2613; 2614; 2615; 2616; 2617; 2618; 2619; 2620; 2621; 2676; 2677; 2678; 2679; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1510252; ANNOT 1510252; CLONE 292789; ANNOT 1442040; ANNOT 1442040; ANNOT 1482966; ANNOT 1454656; ANNOT 1454656; ANNOT 1458103; ANNOT 1458103; ANNOT 1464899; ANNOT 1464899; ANNOT 1474837; ANNOT 1474837; ANNOT 1520449; ANNOT 1520449; ANNOT 1538169; ANNOT 1538169; CLONE 482122; ANNOT 1438776; ANNOT 1438776; CLONE 536726; ANNOT 1498226; ANNOT 1498226; ANNOT 1445243; ANNOT 1445243; ANNOT 1525386; ANNOT 1525386; ANNOT 1448522; ANNOT 1448522; ANNOT 1465506; ANNOT 1465506; ANNOT 1497017; ANNOT 1497017; ANNOT 1447240; ANNOT 1447240; ANNOT 1539566; ANNOT 1539566; ANNOT 1444070; ANNOT 1444070; CLONE 545208; ANNOT 1459998; ANNOT 1513263; ANNOT 1513263; ANNOT 1467410; ANNOT 1467410; CLONE 563522; ANNOT 1460321; ANNOT 1508144; ANNOT 1541886; ANNOT 1541886; ANNOT 1475178; ANNOT 1475178; CLONE 566317; ANNOT 1489585; ANNOT 1489585; ANNOT 1467905; ANNOT 1467905; ANNOT 1517371; ANNOT 1517371; ANNOT 1517371; ANNOT 1512104; ANNOT 1512104; ANNOT 1458837; ANNOT 1458837; CLONE 572121; ANNOT 1477450; CLONE 627596; ANNOT 1500987; ANNOT 1500987; ANNOT 1490915; ANNOT 1490915; CLONE 708342; ANNOT 1538185; ANNOT 1538185; CLONE 1002819; ANNOT 1474290; ANNOT 1474290; ANNOT 1522314; ANNOT 1522314; ANNOT 1497147; ANNOT 1497147; ANNOT 1471045; ANNOT 1471045; CLONE 1011386; ANNOT 1531134; ANNOT 1531134; ANNOT 1508758; ANNOT 1508758; CDNA 2349348l; ANNOT 1460973; ANNOT 1460973; CDNA 2349814S; ANNOT 1482362; ANNOT 1482362; ANNOT 1489077; ANNOT 1489077; CDNA 23501O3; CDNA 2350182; ANNOT 1525474; ANNOT 1525474; CDNA 2351657B; CDNA 3651294O; ANNOT 1471370; ANNOT 1471370; ANNOT 1444471; ANNOT 1444471; ANNOT 1491278; ANNOT 1491278; ANNOT 1447690; ANNOT 1447690; CDNA 3635149l; ANNOT 1524972; ANNOT 1524972; CDNA 3654285S; ANNOT 1524883; ANNOT 1524883; ANNOT 1497918; ANNOT 1497918; CDNA 3645500O; ANNOT 1449045; ANNOT 1449045; ANNOT 1470714; ANNOT 1470714; CDNA 3654796A; ANNOT 1491278; ANNOT 1503630; ANNOT 1503630; CDNA 3656085G; ANNOT 1517998; ANNOT 1517998; ANNOT 1458313; ANNOT 1458313; CDNA 3657269S; ANNOT 1455805; ANNOT 1455805; ANNOT 1455663; ANNOT 1455663; ANNOT 1529744; ANNOT 1529744; CDNA 3657942A; ANNOT 1448068; ANNOT 1448068; ANNOT 1438024; ANNOT 1438024; CDNA 3654796A; ANNOT 1491278; ANNOT 1491278; ANNOT 1447690; ANNOT 1447690; ANNOT 1500987; ANNOT 1500987; ANNOT 1490915; ANNOT 1490915; | 2680; 2681; 2682; 2789; 2790; 2791; 2792; 2793; 2801; 2802; 2803; 2804; 2805; 2811; 2812; 2813; 2814; 2815; 2852; 2853; 2854; 2855; 2856; 2857; 2858; 2859; 2860; 2861; 2862; 2863; 2864; 2865; 2866; 2867; 2868; 3049; 3050; 3051; 3135; 3136; 3137; 3138; 3139; 3140; 3141; 3142; 3143; 3144; 3145; 3146; 3147; 3148; 3149; 3150; 3151; 3152; 3153; 3189; 3190; 3191; 3192; 3193; 3194; 3195; 3227; 3228; 3229; 3230; 3231; 3232; 3233; 3234; 3235; 3241; 3242; 3243; 3244; 3245; 3246; 3247; 3248; 3249; 3250; 3251; 3252; 3253; 3254; 3299; 3300; 3301; 3302; 3303; 3361; 3362; 3363; 3428; 3429; 3430; 3431; 3432; 3433; 3434; 3435; 3436; 3462; 3463; 3464; 3465; 3466; 3613; 3614; 3615; 3641; 3642; 3643; 3644; 3645; 3687; 3696; 3697; 3698; 3737; 3896; 3897; 3898; 3899; 3900; 3901; 3902; 3903; 3904; 3948; 3949; 3950; 3974; 3975; 3976; 3977; 3978; 3979; 3980; 3981; 3982; 3983; 3987; 3988; 3989; 4008; 4009; 4010; 4011; 4012; 4048; 4049; 4050; 4051; 4052; 4063; 4064; 4065; 4066; 4067; 4068; 4069; 3688; 3689; 3690; 3691; 3692; 3693; 3694; 3695; |
| FLOWER | Confinement | Sterile | No seed is being produced by the plant | Useful for sterility, genetic confinement systems | CLONE 1496; ANNOT 1490668; ANNOT 1474027; ANNOT 1474027; ANNOT 1490668; ANNOT 1490668; ANNOT 1471512; ANNOT 1497865; ANNOT 1497865; ANNOT 1443061; ANNOT 1443061; ANNOT 1504203; ANNOT 1505468; ANNOT 1505468; ANNOT 1452369; ANNOT 1452369; CLONE 3000; ANNOT 1518918; ANNOT 1518918; ANNOT 1535677; ANNOT 1535677; ANNOT 1482181; ANNOT 1482181; CLONE 3363; ANNOT 1445515; ANNOT 1445515; ANNOT 1461861; ANNOT 1461861; ANNOT 1449363; ANNOT 1449363; ANNOT | 50; 51; 52; 53; 54; 55; 56; 57; 58; 59; 60; 61; 62; 63; 64; 65; 66; 111; 112; 113; 114; 115; 116; 117; 129; 130; 131; 132; 133; 134; 135; 136; 137; 138; 139; 153; 154; 155; |

TABLE 1-continued

| Tissue | Phenotype Category | Phenotype | Phenotype Description | Applications | Ceres ID | SEQ ID NO |
|---|---|---|---|---|---|---|
| | | | | | 1465198; ANNOT 1465198; ANNOT 1518517; CLONE 3819; ANNOT 1441039; ANNOT 1441039; ANNOT 1482966; ANNOT 1454656; ANNOT 1454656; ANNOT 1528263; ANNOT 1464899; ANNOT 1464899; ANNOT 1458103; ANNOT 1458103; ANNOT 1442040; ANNOT 1442040; ANNOT 1520449; ANNOT 1520449; CLONE 5597; ANNOT 1507708; ANNOT 1507708; ANNOT 1475094; ANNOT 1475094; CLONE 9132; ANNOT 1458620; ANNOT 1458620; CLONE 9683; ANNOT 1471514; ANNOT 1471514; CLONE 9897; ANNOT 1445849; ANNOT 1445849; ANNOT 150561; ANNOT 1500561; ANNOT 1464458; CLONE 13263; ANNOT 1470919; ANNOT 1470919; CLONE 13767; ANNOT 1542158; ANNOT 1542158; ANNOT 1488730; ANNOT 1488730; CLONE 15343; ANNOT 1440753; ANNOT 1440753; CLONE 18612; ANNOT 1522299; ANNOT 1527718; ANNOT 1527718; CLONE 23771; ANNOT 1444030; ANNOT 1444030; ANNOT 1486813; ANNOT 1486813; ANNOT 1485303; ANNOT 1446796; ANNOT 1446796; CLONE 28003; ANNOT 1527756; ANNOT 1527756; ANNOT 1468882; ANNOT 1468882; CLONE 32548; ANNOT 1450324; ANNOT 1450324; ANNOT 1460836; ANNOT 1460836; CLONE 32615; ANNOT 1471372; ANNOT 1471372; CLONE 32791; ANNOT 1540248; ANNOT 1540248; CLONE 33559; ANNOT 1481146; ANNOT 1481146; ANNOT 1481150; ANNOT 1481138; ANNOT 1481138; ANNOT 1485824; ANNOT 1485824; ANNOT 1534622; ANNOT 1534622; CLONE 33802; ANNOT 1495637; ANNOT 1495637; ANNOT 1452709; ANNOT 1452709; ANNOT 1442724; ANNOT 1442724; CLONE 36709; ANNOT 1495936; ANNOT 1495936; CLONE 37398; ANNOT 1531721; ANNOT 1531721; ANNOT 1478221; ANNOT 1478221; ANNOT 1482547; ANNOT 1482547; CLONE 38214; ANNOT 1466779; ANNOT 1466779; ANNOT 1465769; ANNOT 1465769; ANNOT 1538318; ANNOT 1538318; CLONE 99784; ANNOT 1521032; ANNOT 1521032; ANNOT 1472909; ANNOT 1472909; ANNOT 1467665; ANNOT 1467665; CLONE 100245; ANNOT 1533451; ANNOT 1533451; ANNOT 1532285; ANNOT 1532285; ANNOT 1448241; ANNOT 1448241; ANNOT 1446025; ANNOT 1446025; CLONE 100319; ANNOT 1503141; ANNOT 1503141; ANNOT 1521524; ANNOT 1521524; CLONE 101798; ANNOT 1449432; ANNOT 1449432; ANNOT 1449431; ANNOT 1449431; ANNOT 1502439; ANNOT 1502439; CLONE 106011; ANNOT 1533498; ANNOT 1533498; ANNOT 1524067; ANNOT 1524067; CLONE 149380; ANNOT 1461440; ANNOT 1461440; ANNOT 1461430; ANNOT 1461430; ANNOT 1461427; ANNOT 1461427; ANNOT 1440253; ANNOT 1440253; CLONE 150912; ANNOT 1533910; ANNOT 1533910; ANNOT 1480439; ANNOT 1480439; CLONE 157547; ANNOT 1473898; ANNOT 1473898; CLONE 627596; ANNOT 1500987; ANNOT 1500987; ANNOT 1490915; ANNOT 1490915; CLONE 1007549; ANNOT 1458198; ANNOT 1458198; ANNOT 1439989; ANNOT 1439989; ANNOT 1464789; ANNOT 1464789; ANNOT 1461728; ANNOT 1461728; ANNOT 1479711; ANNOT 1479711; ANNOT 1440649; ANNOT 1440649; ANNOT 1464547; ANNOT 1464547; ANNOT 1454104; ANNOT 1454104; CLONE 1011537; ANNOT 1473879; ANNOT 1473879; ANNOT 1468666; ANNOT 1468666; ANNOT 1438163; ANNOT 1438163 | 156; 157; 158; 159; 160; 161; 162; 163; 164; 165; 166; 167; 168; 169; 233; 234; 235; 236; 237; 391; 392; 393; 402; 403; 404; 405; 406; 407; 408; 409; 410; 411; 536; 537; 538; 567; 568; 569; 570; 571; 641; 642; 643; 720; 721; 722; 723; 724; 928; 929; 930; 931; 932; 933; 934; 935; 936; 1080; 1081; 1082; 1083; 1084; 1231; 1232; 1233; 1234; 1235; 1239; 1240; 1241; 1255; 1256; 1257; 1310; 1311; 1312; 1313; 1314; 1315; 1316; 1317; 1318; 1319; 1320; 1321; 1322; 1323; 1324; 1325; 1326; 1327; 1545; 1546; 1547; 1630; 1631; 1632; 1633; 1634; 1635; 1636; 1707; 1708; 1709; 1710; 1711; 1712; 1713; 2161; 2162; 2163; 2164; 2165; 2166; 2167; 2182; 2183; 2184; 2185; 2186; 2187; 2188; 2189; 2190; 2191; 2192; 2193; 2194; 2195; 2219; 2220; 2221; 2222; 2223; 2224; 2225; 2250; 2251; 2252; 2253; 2254; 2546; 2547; 2548; 2549; 2550; 2551; 2552; 2553; 2554; 2555; 2556; 2557; 2558; 2559; 2593; 2594; 2595; 3299; 3300; 3301; 3302; 3303; 3440; 3441; 3442; 3443; 3444; 3445; 3446; 3447; 3448; 3449; 3450; 3451; 3452; 3453; 3454; 3455; 3456; 3467; 3468; 3469; 3470; 3471; 3472; 3473; |
| WHOLE PLANT | | Yellow-Green Viable 1 | The leaves and cotyledons are yellow-green in color. | | CLONE 907; ANNOT 1502138; ANNOT 1502138; ANNOT 1449135; ANNOT 1449135; CLONE 1610; ANNOT 1454586; ANNOT 1454586; ANNOT 1475043; ANNOT 1475043; ANNOT 1475043; ANNOT 1507756; ANNOT 1507756; ANNOT 1469708; ANNOT 1469708; CLONE 3699; ANNOT 1527319; ANNOT 1527319; ANNOT 1473907; ANNOT 1473907; ANNOT 1473907; CLONE 5198; ANNOT 1472153; ANNOT 1472153; CLONE 6630; ANNOT 1529141; ANNOT 1529141; ANNOT 1475689; ANNOT 1475689; ANNOT | 30; 31; 32; 33; 34; 67; 68; 69; 70; 71; 72; 73; 74; 75; 148; 149; 150; 151; 152; 230; 231; 232; 305; 306; 307; 308; 309; 310; 311; 567; 568; 569; |
| | Confinement | | | Useful for making lethal plants for genetic confinement systems | | |

TABLE 1-continued

| Tissue | Phenotype Category | Phenotype | Phenotype Description | Applications | Ceres ID | SEQ ID NO |
|---|---|---|---|---|---|---|
| | | | | | 1476577; ANNOT 1476577; CLONE 13767; ANNOT 1542158; ANNOT 1542158; ANNOT 1488730; ANNOT 1488730; CLONE 17482; ANNOT 1501311; ANNOT 1501311; CLONE 25538; ANNOT 1480776; ANNOT 1480776; CLONE 29150; ANNOT 1485362; ANNOT 1485362; CLONE 34167; ANNOT 1538733; ANNOT 1538733; ANNOT 1499810; ANNOT 1499810; ANNOT 1485323; ANNOT 1485323; CLONE 34480; CLONE 34783; ANNOT 1502362; ANNOT 1502362; ANNOT 1449358; ANNOT 1449358; CLONE 38625; ANNOT 1466952; ANNOT 1466952; ANNOT 1523551; ANNOT 1523551; ANNOT 1470164; ANNOT 1470164; CLONE 39351; ANNOT 1503551; ANNOT 1503551; ANNOT 1461141; ANNOT 1461141; CLONE 39351; ANNOT 1460689; ANNOT 1460689; ANNOT 1513952; ANNOT 1513952; ANNOT 1450495; ANNOT 1450495; CLONE 92670; ANNOT 1531919; ANNOT 1531919; CLONE 95677; ANNOT 1459723; ANNOT 1459723; ANNOT 1516455; ANNOT 1516455; CLONE 113719; ANNOT 1513206; ANNOT 1513206; ANNOT 1516003; ANNOT 1516003; CLONE 120988; CLONE 147358; ANNOT 1493111; ANNOT 1493111; ANNOT 1462703; ANNOT 1462703; ANNOT 1461452; ANNOT 1461452; CLONE 152141; ANNOT 1439403; ANNOT 1439403; ANNOT 1485362; ANNOT 1485362; CLONE 159318; ANNOT 1485362; ANNOT 1485362; CLONE 241379; ANNOT 1526950; ANNOT 1526950; ANNOT 1508362; ANNOT 1508362; ANNOT 1477361; ANNOT 1477361; CLONE 1011386; ANNOT 1531134; ANNOT 1531134; ANNOT 1508758; ANNOT 1508758; ANNOT 2307479; ANNOT 1510416; ANNOT 1510416; ANNOT 1541253; ANNOT 1541253; | 570; 571; 692; 693; 694; 967; 968; 969; 1131; 1132; 1133; 1343; 1344; 1345; 1346; 1347; 1348; 1349; 1398; 1399; 1400; 1401; 1402; 1423; 1424; 1425; 1426; 1427; 1428; 1429; 1766; 1767; 1768; 1854; 1855; 1856; 1857; 1858; 1859; 1860; 1861; 1862; 2061; 2062; 2063; 2090; 2091; 2092; 2093; 2094; 2333; 2334; 2335; 2336; 2337; 2338; 2339; 2480; 2528; 2529; 2530; 2531; 2532; 2568; 2569; 2570; 2574; 2575; 2576; 2622; 2623; 2624; 2718; 2719; 2720; 2721; 2722; 2723; 2724; 3462; 3463; 3464; 3465; 3466; 3704; 3705; 3706; 3707; 3708; |
| WHOLE PLANT | Confinement | Yellow-Green Viable 2 | The leaves are yellow-green in color but the cotyledons are a wild-type green in color. | Useful for making lethal plants for genetic confinement systems | CLONE 6220; ANNOT 1488463; ANNOT 1488463; ANNOT 1541879; ANNOT 1541879; ANNOT 19143; ANNOT 1442860; ANNOT 1442860; ANNOT 1459442; ANNOT 1459442; ANNOT 1452580; ANNOT 1452580; CLONE 42925; ANNOT 1462354; ANNOT 1462354; CLONE 267626; ANNOT 1484074; ANNOT 1484074; ANNOT 1518242; ANNOT 1518242; ANNOT 1464923; ANNOT 1464923; | 275; 276; 277; 278; 279; 740; 741; 742; 743; 744; 745; 746; 2045; 2046; 2047; 2794; 2795; 2796; 2797; 2798; 2799; 2800; |
| WHOLE PLANT | Confinement | Yellow-Green Viable 3 | The leaves start out wild-type green and gradually turn yellow-green in color, while the cotyledons stay wild-type green. | Useful for making lethal plants for genetic confinement systems | CLONE 25380; ANNOT 1512618; ANNOT 1512618; ANNOT 1459357; ANNOT 1459357; ANNOT 1463526; ANNOT 1463526; CLONE 33232; ANNOT 1504045; ANNOT 1504045; ANNOT 1450983; ANNOT 1450983; CLONE 267626; ANNOT 1484074; ANNOT 1484074; ANNOT 1518242; ANNOT 1464923; ANNOT 1464923; CDNA 23522373; ANNOT 1538994; ANNOT 1538994; ANNOT 1447080; ANNOT 1447080; CDNA 36521975; ANNOT 1455981; ANNOT 1455981; ANNOT 1541512; ANNOT 1541512; | 960; 961; 962; 963; 964; 965; 966; 1263; 1264; 1265; 1266; 1267; 2794; 2795; 2796; 2797; 2798; 2799; 2800; 3761; 3762; 3763; 3764; 3765; 3911; 3912; 3913; 3914; 3915; |
| INFLORESCENCE | Development | Early Flowering | The plant flowers significantly earlier than wild-type. | Useful for modulating flowering time | CLONE 32791; ANNOT 1540248; ANNOT 1540248; CLONE 39319; ANNOT 1456036; ANNOT 1456036; ANNOT 1470131; ANNOT 1470131; ANNOT 1466936; ANNOT 1466936; ANNOT 1541455; ANNOT 1541455; ANNOT 1456037; ANNOT 1456037; CLONE 41337; ANNOT 1516613; ANNOT 1516613; ANNOT 1513097; ANNOT 1513097; ANNOT 1463324; ANNOT 1463324; CLONE 536726; ANNOT 1498226; ANNOT 1498226; ANNOT 1445243; ANNOT 1445243; ANNOT 1525386; ANNOT 1525386; ANNOT 1448522; ANNOT 1448522; ANNOT 1465506; ANNOT 1465506; ANNOT 1497017; ANNOT 1497017; ANNOT 1447240; ANNOT 1447240; ANNOT 1539566; ANNOT 1539566; ANNOT 1444070; ANNOT 1444070; | 1255; 1256; 1257; 1843; 1844; 1845; 1846; 1847; 1848; 1849; 1850; 1851; 1852; 1853; 1988; 1989; 1990; 1991; 1992; 1993; 1994; 3135; 3136; 3137; 3138; 3139; 3140; 3141; 3142; 3143; 3144; 3145; 3146; 3147; 3148; 3149; 3150; 3151; 3152; 3153; |
| WHOLE PLANT | Development | Early Senescence | The plant senesces | Useful for modulating | CLONE 75; ANNOT 1503293; ANNOT 1503293; CLONE 34412; ANNOT 1449739; ANNOT 1449739; ANNOT 1449738; ANNOT 1449738; ANNOT 1458830; ANNOT | 6; 7; 8; 1376; 1377; 1378; 1379; 1380; 1381; |

TABLE 1-continued

| Tissue | Phenotype Category | Phenotype | Phenotype Description | Applications | Ceres ID | SEQ ID NO |
|---|---|---|---|---|---|---|
| | | | significantly earlier than wild-type. | crop development and harvest | 1458830; CDNA 23493481; ANNOT 1460973; ANNOT 1460973; CDNA 23505182; ANNOT 1525474; ANNOT 1525474; | 1382; 3613; 3614; 3615; 3696; 3697; 3698; |
| INFLORESCENCE | Development | Late Flowering | The plant flowers significantly late compared to wild-type. | Useful for modulating flowering time | CLONE 314; ANNOT 1543129; ANNOT 1543129; CLONE 332; ANNOT 1474923; ANNOT 1474923; CLONE 907; ANNOT 1502138; ANNOT 1502138; ANNOT 1449135; ANNOT 1449135; CLONE 1241; ANNOT 1453081; ANNOT 1453081; ANNOT 1442349; ANNOT 1442349; CLONE 1610; ANNOT 1454586; ANNOT 1454586; ANNOT 1475043; ANNOT 1475043; ANNOT 1507756; ANNOT 1507756; ANNOT 1469708; ANNOT 1469708; CLONE 2403; ANNOT 1509972; ANNOT 1509972; ANNOT 1504203; ANNOT 1504203; ANNOT 1443061; ANNOT 1443061; ANNOT 1452369; ANNOT 1452369; CLONE 3000; ANNOT 1518918; ANNOT 1518918; ANNOT 1535677; ANNOT 1535677; ANNOT 1482181; ANNOT 1482181; CLONE 3036; ANNOT 1456840; ANNOT 1456840; CLONE 3363; ANNOT 1445515; ANNOT 1445515; ANNOT 1461861; ANNOT 1461861; ANNOT 1449363; ANNOT 1449363; ANNOT 1465198; ANNOT 1465198; ANNOT 1518517; ANNOT 1518517; CLONE 3457; ANNOT 1458875; ANNOT 1458875; ANNOT 1449635; ANNOT 1449635; CLONE 3542; ANNOT 1471301; ANNOT 1471301; CLONE 3699; ANNOT 1527319; ANNOT 1527319; ANNOT 1473907; ANNOT 1473907; CLONE 3858; ANNOT 1459068; ANNOT 1459068; CLONE 3997; ANNOT 1455209; ANNOT 1455209; ANNOT 1446198; ANNOT 1446198; ANNOT 1490273; ANNOT 1490273; ANNOT 1530603; ANNOT 1530603; CLONE 5597; ANNOT 1507708; ANNOT 1507708; ANNOT 1475094; ANNOT 1475094; CLONE 5605; ANNOT 1437939; ANNOT 1437939; CLONE 6387; ANNOT 1509111; ANNOT 1509111; ANNOT 1541620; ANNOT 1541620; CLONE 8265; ANNOT 1438919; ANNOT 1438919; ANNOT 1499398; ANNOT 1499398; ANNOT 1446419; ANNOT 1446419; CLONE 9132; ANNOT 1458620; ANNOT 1458620; CLONE 9683; ANNOT 1471514; ANNOT 1471514; CLONE 9897; ANNOT 1445849; ANNOT 1445849; ANNOT 1500561; ANNOT 1500561; ANNOT 1464458; ANNOT 1464458; CLONE 11494; ANNOT 1438708; ANNOT 1438708; CLONE 11854; ANNOT 1506763; ANNOT 1506763; ANNOT 1453614; ANNOT 1453614; CLONE 12272; ANNOT 1506387; ANNOT 1506387; ANNOT 1474522; ANNOT 1474522; CLONE 13092; ANNOT 1471785; ANNOT 1471785; ANNOT 1470919; ANNOT 1470919; CLONE 13741; ANNOT 1462963; ANNOT 1462963; ANNOT 1459563; ANNOT 1459563; CLONE 13757; ANNOT 1471425; ANNOT 1471425; CLONE 13800; ANNOT 1458335; ANNOT 1458335; ANNOT 1464663; ANNOT 1464663; CLONE 14583; ANNOT 1530256; ANNOT 1530256; ANNOT 1476783; ANNOT 1476783; CLONE 14663; ANNOT 1503166; ANNOT 1503166; CLONE 14909; ANNOT 1497838; ANNOT 1497838; ANNOT 1522523; ANNOT 1522523; ANNOT 1471525; ANNOT 1471525; ANNOT 1511908; ANNOT 1511908; ANNOT 1464305; ANNOT 1464305; ANNOT 1451416; ANNOT 1451416; ANNOT 1461050; ANNOT 1461050; CLONE 16461; ANNOT 1479013; ANNOT 1479013; CLONE 17409; ANNOT 1457617; ANNOT 1457617; ANNOT 1478647; ANNOT 1478647; ANNOT 1453865; ANNOT 1453865; CLONE 17482; ANNOT 1501311; ANNOT 1501311; CLONE 17632; ANNOT 1474847; ANNOT 1474847; ANNOT 1507835; ANNOT 1507835; CLONE 17761; ANNOT 1481206; ANNOT 1481206; ANNOT 1534689; ANNOT 1534689; CLONE 17912; ANNOT 1514378; ANNOT 1514378; ANNOT 1494118; ANNOT 1494118; CLONE 18612; ANNOT 1522299; ANNOT 1522299; ANNOT 1527718; CLONE 19188; ANNOT 1445089; ANNOT 1445089; CLONE 20257; ANNOT 1442444; ANNOT 1442444; ANNOT 1452966; ANNOT 1452966; CLONE 20945; ANNOT 1519797; ANNOT 1519797; CLONE | 9; 10; 11; 12; 13; 14; 30; 31; 32; 33; 34; 38; 39; 40; 41; 42; 67; 68; 69; 70; 71; 72; 73; 74; 75; 95; 96; 97; 98; 99; 100; 101; 102; 103; 111; 112; 113; 114; 115; 116; 117; 121; 122; 123; 129; 130; 131; 132; 133; 134; 135; 136; 137; 138; 139; 140; 141; 142; 143; 144; 145; 146; 147; 148; 149; 150; 151; 152; 175; 176; 177; 178; 179; 180; 181; 182; 183; 184; 185; 186; 233; 234; 235; 236; 237; 238; 239; 240; 285; 286; 287; 288; 289; 362; 363; 364; 365; 366; 367; 368; 391; 392; 393; 402; 403; 404; 405; 406; 407; 408; 409; 410; 411; 457; 458; 459; 475; 476; 477; 478; 479; 515; 516; 517; 518; 519; 528; 529; 530; 536; 537; 538; 550; 551; 552; 553; 554; 564; 565; 566; 572; 573; 574; 575; 576; 619; 620; 621; 622; 623; 624; 625; 626; 627; 628; 629; 630; 631; 632; 633; 634; 635; 636; 637; 638; 639; 640; 647; 648; 649; 678; 679; 680; 681; 682; 683; 684; 685; 686; 692; 693; 694; 695; 696; 697; 698; 699; 700; 701; 702; 703; 704; 705; 706; 707; 708; 709; 720; 721; 722; 723; 724; 747; 748; 749; 796; 797; 798; 799; 800; 818; 819; 820; 821; 822; 823; 824; 825; 826; 827; 828; 829; 830; 831; 907; 908; 909; 910; 911; 912; 913; 914; 915; 916; 952; 953; 954; 955; 956; 1010; |

TABLE 1-continued

| Tissue | Phenotype Category | Phenotype | Phenotype Description | Applications | Ceres ID | SEQ ID NO |
|---|---|---|---|---|---|---|
| | | | | | 21068; ANNOT 1463333; ANNOT 1505772; ANNOT 1495675; ANNOT 1469576; ANNOT 1505772; ANNOT 1442758; ANNOT 1442758; CLONE 23518; ANNOT 1475658; ANNOT 1449267; ANNOT 1449267; ANNOT 1507191; ANNOT 1475658; CLONE 23523; ANNOT 1453919; ANNOT 1453919; CLONE 25172; ANNOT 1457346; ANNOT 1457346; ANNOT 1541170; CLONE 26542; ANNOT 1475323; ANNOT 1475323; ANNOT 1538272; CLONE 26825; ANNOT 1513438; ANNOT 1513438; ANNOT 1460167; ANNOT 1460167; CLONE 26907; ANNOT 1484074; ANNOT 1484074; ANNOT 1440016; ANNOT 1474847; ANNOT 1518242; CLONE 27460; ANNOT 1474847; ANNOT 1474847; ANNOT 1507835; ANNOT 1507835; CLONE 31014; ANNOT 1527449; ANNOT 1527449; ANNOT 1484207; CLONE 32348; ANNOT 1470719; ANNOT 1470719; ANNOT 1543728; ANNOT 1482066; ANNOT 1482066; CLONE 32361; ANNOT 1471776; ANNOT 1471776; ANNOT 1445033; ANNOT 1445033; CLONE 32548; ANNOT 1450324; ANNOT 1450324; ANNOT 1460836; CLONE 32615; ANNOT 1471372; ANNOT 1471372; CLONE 32737; ANNOT 1536373; ANNOT 1482905; ANNOT 1482905; CLONE 32751; ANNOT 1451171; CLONE 32753; ANNOT 1480607; ANNOT 1480607; ANNOT 1472242; ANNOT 1472242; CLONE 32791; ANNOT 1540248; ANNOT 1540248; CLONE 33482; ANNOT 1497019; ANNOT 1497019; CLONE 33554; ANNOT 1445599; ANNOT 1445599; ANNOT 1471882; ANNOT 1471882; ANNOT 1452398; ANNOT 1452398; ANNOT 1443041; ANNOT 1443041; ANNOT 1452397; ANNOT 1505498; ANNOT 1505498; ANNOT 1505497; ANNOT 1505497; ANNOT 1443040; ANNOT 1443040; ANNOT 1495964; ANNOT 1495964; ANNOT 1498580; ANNOT 1498580; ANNOT 1466060; ANNOT 1466060; CLONE 34151; ANNOT 1473827; ANNOT 1473827; ANNOT 1473827; ANNOT 1468614; ANNOT 1468614; CLONE 34167; ANNOT 1538733; ANNOT 1538733; ANNOT 1499810; ANNOT 1499810; ANNOT 1485323; ANNOT 1485323; ANNOT 1485323; CLONE 34385; ANNOT 1445331; ANNOT 1445331; ANNOT 1498316; ANNOT 1498316; CLONE 34552; ANNOT 1516449; ANNOT 1516449; ANNOT 1512976; ANNOT 1512976; CLONE 34635; ANNOT 1487773; ANNOT 1487773; ANNOT 1457333; ANNOT 1457333; ANNOT 1442634; ANNOT 1442634; CLONE 36818; ANNOT 1471507; ANNOT 1471507; ANNOT 1444893; ANNOT 1444893; ANNOT 1458642; ANNOT 1458642; ANNOT 1522497; ANNOT 1522497; ANNOT 1469105; ANNOT 1469105; ANNOT 1484993; ANNOT 1484993; CLONE 36891; ANNOT 1480518; ANNOT 1480518; ANNOT 1442194; ANNOT 1442194; ANNOT 1454127; ANNOT 1454127; ANNOT 1461716; ANNOT 1461716; ANNOT 1440277; ANNOT 1440277; ANNOT 1461415; ANNOT 1461415; ANNOT 1461414; ANNOT 1461414; ANNOT 1447424; ANNOT 1447424; ANNOT 1528127; ANNOT 1528127; ANNOT 1438717; ANNOT 1438717; ANNOT 1440276; ANNOT 1440276; ANNOT 1442556; ANNOT 1442556; ANNOT 1452873; ANNOT 1452873; ANNOT 1453483; ANNOT 1453483; ANNOT 1473384; ANNOT 1473384; ANNOT 1473708; ANNOT 1438698; ANNOT 1475808; ANNOT 1474708; ANNOT 1474708; ANNOT 1438698; ANNOT 1526083; ANNOT 1526083; ANNOT 1498856; ANNOT 1498856; CLONE 36904; ANNOT 1445872; ANNOT 1445872; ANNOT 1472663; ANNOT 1472663; CLONE 37217; ANNOT 1465580; ANNOT 1465580; ANNOT 1472014; ANNOT 1472014; ANNOT 1445195; ANNOT 1445195; CLONE 37298; ANNOT 1453650; ANNOT 1453650; CLONE 37298; ANNOT 1476538; ANNOT 1476538; ANNOT 1493576; ANNOT 1493576; CLONE 37589; ANNOT 1440727; ANNOT 1440727; CLONE 37658; ANNOT 1497485; ANNOT 1497485; CLONE 37663; ANNOT 37658; ANNOT | 1011; 1012; 1013; 1014; 1030; 1031; 1032; 1033; 1034; 1043; 1044; 1045; 1046; 1047; 1048; 1049; 1055; 1056; 1057; 1058; 1059; 1185; 1186; 1187; 1188; 1189; 1219; 1220; 1221; 1222; 1223; 1224; 1225; 1226; 1227; 1228; 1229; 1230; 1231; 1232; 1233; 1234; 1235; 1239; 1240; 1241; 1242; 1243; 1244; 1245; 1246; 1247; 1248; 1249; 1250; 1251; 1252; 1253; 1254; 1255; 1256; 1257; 1279; 1280; 1281; 1287; 1288; 1289; 1290; 1291; 1292; 1293; 1294; 1295; 1296; 1297; 1298; 1299; 1300; 1301; 1302; 1303; 1304; 1305; 1306; 1307; 1308; 1309; 1338; 1339; 1340; 1341; 1342; 1343; 1344; 1345; 1346; 1347; 1348; 1349; 1364; 1365; 1366; 1367; 1368; 1406; 1407; 1408; 1409; 1410; 1416; 1417; 1418; 1419; 1420; 1421; 1422; 1505; 1506; 1507; 1508; 1509; 1510; 1511; 1512; 1513; 1514; 1515; 1516; 1517; 1548; 1549; 1550; 1551; 1552; 1553; 1554; 1555; 1556; 1557; 1558; 1559; 1560; 1561; 1562; 1563; 1564; 1565; 1566; 1567; 1568; 1569; 1570; 1571; 1572; 1573; 1574; 1575; 1576; 1577; 1578; 1579; 1580; 1581; 1582; 1583; 1584; 1585; 1586; 1587; 1588; 1589; 1590; 1591; 1592; 1593; 1610; 1611; 1612; 1613; 1614; 1615; 1616; 1622; 1623; 1624; 1625; 1626; 1627; 1628; 1629; 1651; 1652; 1653; 1654; 1655; 1656; 1657; 1658; 1659; |

TABLE 1-continued

| Tissue | Phenotype Category | Phenotype | Phenotype Description | Applications | Ceres ID | SEQ ID NO |
|---|---|---|---|---|---|---|
| | | | | | 1447659; ANNOT 1447659; ANNOT 1438478; CLONE 38101; ANNOT 1454656; ANNOT 1454656; ANNOT 1528263; ANNOT 1458103; ANNOT 1458103; ANNOT 1464899; ANNOT 1482966; ANNOT 1482966; ANNOT 1441039; ANNOT 1520449; ANNOT 1520449; CLONE 38419; ANNOT 1542971; ANNOT 1521332; ANNOT 1521332; ANNOT 1467961; ANNOT 1467961; CLONE 38690; ANNOT 1525183; ANNOT 1525183; CLONE 38785; ANNOT 1461193; ANNOT 1461193; ANNOT 1514466; ANNOT 1514466; CLONE 39286; ANNOT 1447961; ANNOT 1447961; ANNOT 1490936; ANNOT 1499936; CLONE 40508; ANNOT 1453626; ANNOT 1453626; CLONE 40729; ANNOT 1481678; ANNOT 1481678; CLONE 40766; ANNOT 1450499; ANNOT 1450499; CLONE 41306; ANNOT 1475806; ANNOT 1475806; ANNOT 1454125; ANNOT 1454125; CLONE 41439; CLONE 4214l; ANNOT 1473839; ANNOT 1473839; CLONE 92670; ANNOT 1531919; ANNOT 1531919; CLONE 95135; ANNOT 1527449; ANNOT 1527449; ANNOT 1537653; ANNOT 1537653; ANNOT 1473733; ANNOT 1468537; ANNOT 1468537; CLONE 97434; ANNOT 1488311; ANNOT 1518776; ANNOT 1518776; CLONE 97480; ANNOT 1493111; ANNOT 1493111; CLONE 98855; ANNOT 1460836; ANNOT 1460836; ANNOT 1450324; ANNOT 1450324; CLONE 99657; ANNOT 1461858; ANNOT 1461858; ANNOT 1461858; ANNOT 1440018; ANNOT 1440018; ANNOT 1440018; ANNOT 1440019; ANNOT 1511305; ANNOT 1511305; ANNOT 1511305; ANNOT 1464927; ANNOT 1527449; ANNOT 1464927; ANNOT 1464927; CLONE 100465; ANNOT 1466439; ANNOT 1466439; ANNOT 1448977; ANNOT 1448977; ANNOT 1519767; ANNOT 1519767; ANNOT 1501982; ANNOT 1501982; CLONE 107731; ANNOT 1480518; ANNOT 1480518; ANNOT 1442194; ANNOT 1442194; ANNOT 1454127; ANNOT 1454127; ANNOT 1461414; ANNOT 1461414; ANNOT 1447424; ANNOT 1447424; ANNOT 1452873; ANNOT 1452873; ANNOT 1474708; ANNOT 1474708; CLONE 108056; ANNOT 1464935; ANNOT 1464935; ANNOT 1458064; ANNOT 1458064; ANNOT 1511298; ANNOT 1511298; ANNOT 1511298; ANNOT 1458065; ANNOT 1458065; ANNOT 1511299; ANNOT 1511299; CLONE 110454; CLONE 111209; ANNOT 1494507; ANNOT 1494507; CLONE 112288; ANNOT 1517215; ANNOT 1517215; CLONE 114466; ANNOT 1479643; ANNOT 1479643; ANNOT 1486882; ANNOT 1486882; CLONE 116257; ANNOT 1520806; ANNOT 1520806; ANNOT 1473089; ANNOT 1473089; ANNOT 1500150; CLONE 117895; ANNOT 1448592; ANNOT 1448592; ANNOT 148943; ANNOT 1448594; CLONE 1448594; CLONE 119256; ANNOT 1469636; ANNOT 1469636; ANNOT 1479002; CLONE 119598; ANNOT 1497424; ANNOT 1497424; ANNOT 1497424; ANNOT 1471357; ANNOT 1471357; CLONE 122353; ANNOT 1472265; ANNOT 1472265; CLONE 141805; ANNOT 1497485; ANNOT 1497485; CLONE 141890; ANNOT 1494533; ANNOT 1494533; ANNOT 1493111; ANNOT 1466313; ANNOT 1466313; CLONE 147358; ANNOT 1493111; ANNOT 1461452; ANNOT 1461452; CLONE 148680; ANNOT 1522509; ANNOT 1522509; CLONE 148943; ANNOT 1472949; ANNOT 1472949; CLONE 149380; ANNOT 1461440; ANNOT 1461440; ANNOT 1461430; ANNOT 1461430; ANNOT 1461427; ANNOT 1461427; ANNOT 1440253; ANNOT 1440253; CLONE 151087; ANNOT 1504145; ANNOT 1504145; ANNOT 1451079; ANNOT 1451079; ANNOT 1451079; CLONE 157058; ANNOT 1528285; ANNOT 1528285; ANNOT 1454671; ANNOT 1454671; CLONE 157547; ANNOT 1473898; ANNOT 1473898; CLONE 158333; ANNOT 1466505; ANNOT 1466505; ANNOT 1449026; CLONE 205648; ANNOT 1456842; ANNOT 1456842; ANNOT 1456842; ANNOT 1504224; ANNOT 1504224; CLONE 227651; ANNOT | 1660; 1661; 1682; 1683;<br>1684; 1685; 1686; 1687;<br>1688; 1689; 1690; 1691;<br>1692; 1693; 1694; 1695;<br>1696; 1747; 1748; 1749;<br>1750; 1751; 1752; 1753;<br>1774; 1775; 1776; 1796;<br>1797; 1798; 1799; 1800;<br>1838; 1839; 1840; 1841;<br>1842; 1912; 1913; 1914;<br>1930; 1931; 1932; 1933;<br>1934; 1935; 1976; 1977;<br>1978; 1979; 1980; 1998;<br>2015; 2016; 2017; 2061;<br>2062; 2063; 2076; 2077;<br>2078; 2079; 2080; 2081;<br>2082; 2083; 2084; 2103;<br>2104; 2105; 2106; 2107;<br>2108; 2109; 2110; 2118;<br>2119; 2120; 2121; 2122;<br>2142; 2143; 2144; 2145;<br>2146; 2147; 2148; 2149;<br>2150; 2151; 2152; 2153;<br>2154; 2155; 2156; 2157;<br>2158; 2159; 2160; 2196;<br>2197; 2198; 2199; 2200;<br>2201; 2202; 2203; 2204;<br>2263; 2264; 2265; 2266;<br>2267; 2268; 2269; 2270;<br>2271; 2272; 2273; 2274;<br>2275; 2276; 2277; 2281;<br>2282; 2283; 2284; 2285;<br>2286; 2287; 2288; 2289;<br>2290; 2291; 2313; 2314;<br>2315; 2316; 2327; 2328;<br>2329; 2345; 2346; 2347;<br>2348; 2349; 2394; 2395;<br>2396; 2397; 2398; 2399;<br>2400; 2412; 2413; 2414;<br>2415; 2416; 2451; 2452;<br>2453; 2454; 2455; 2456;<br>2457; 2458; 2459; 2460;<br>2481; 2482; 2483; 2517;<br>2518; 2519; 2523; 2524;<br>2525; 2526; 2527; 2528;<br>2529; 2530; 2531; 2532;<br>2540; 2541; 2542; 2543;<br>2544; 2545; 2546; 2547;<br>2548; 2549; 2550; 2551;<br>2552; 2553; 2554; 2560; |

TABLE 1-continued

| Tissue | Phenotype Category | Phenotype | Phenotype Description | Applications | Ceres ID | SEQ ID NO |
|---|---|---|---|---|---|---|
| | | | | | 1474222; ANNOT 1474222; ANNOT 1468994; ANNOT 1468994; ANNOT 1497043; ANNOT 1497043; CLONE 262460; ANNOT 1530053; ANNOT 1530053; ANNOT 1493414; ANNOT 1493414; CLONE 463203; ANNOT 1511505; ANNOT 1511505; CLONE 482122; ANNOT 1438776; ANNOT 1438776; CLONE 534397; ANNOT 1453458; ANNOT 1453458; ANNOT 1489056; ANNOT 1489056; ANNOT 1442794; ANNOT 1442794; ANNOT 1495713; ANNOT 1495713; ANNOT 1442797; ANNOT 1442797; ANNOT 1468612; ANNOT 1468612; ANNOT 1460503; ANNOT 1460503; ANNOT 1488307; ANNOT 1488307; ANNOT 1440343; ANNOT 1440343; ANNOT 1493212; ANNOT 1493212; CLONE 536457; ANNOT 1490030; ANNOT 1490030; ANNOT 1493787; ANNOT 1493787; CLONE 536796; ANNOT 1484779; ANNOT 1484779; ANNOT 1538185; ANNOT 1538185; ANNOT 1455109; ANNOT 1455109; ANNOT 1477384; ANNOT 1477384; CLONE 572121; ANNOT 1477450; ANNOT 1477450; CLONE 641355; ANNOT 1463335; ANNOT 1463334; ANNOT 1463334; ANNOT 1452665; ANNOT 1452665; CLONE 660003; ANNOT 1508184; ANNOT 1508184; ANNOT 1528645; ANNOT 1528645; CLONE 664365; ANNOT 1463333; ANNOT 1463333; ANNOT 1505772; ANNOT 1505772; ANNOT 1478872; ANNOT 1478872; ANNOT 1442758; ANNOT 1442758; ANNOT 1495675; ANNOT 1495675; ANNOT 1469576; ANNOT 1469576; ANNOT 1452666; ANNOT 1452666; ANNOT 1452668; ANNOT 1452668; ANNOT 1442757; ANNOT 1442757; CLONE 708342; ANNOT 1538185; ANNOT 1538185; CLONE 965175; ANNOT 1479013; ANNOT 1479013; CLONE 1001432; ANNOT 1475043; ANNOT 1475043; ANNOT 1454586; ANNOT 1454586; ANNOT 1507756; ANNOT 1507756; ANNOT 1469708; ANNOT 1469708; CLONE 1002819; ANNOT 1474290; ANNOT 1474290; ANNOT 1522314; ANNOT 1522314; ANNOT 1497147; ANNOT 1497147; ANNOT 1471045; ANNOT 1471045; CLONE 1006934; ANNOT 1532963; ANNOT 1532963; CLONE 1007549; ANNOT 1458198; ANNOT 1458198; ANNOT 1439989; ANNOT 1439989; ANNOT 1464789; ANNOT 1464789; ANNOT 1461728; ANNOT 1461728; ANNOT 1479711; ANNOT 1479711; ANNOT 1440649; ANNOT 1440649; ANNOT 1464547; ANNOT 1464547; ANNOT 1454104; ANNOT 1454104; CLONE 1043081; ANNOT 1478584; ANNOT 1478584; ANNOT 1455564; ANNOT 1455564; ANNOT 1508764; ANNOT 1508764; ANNOT 1477651; ANNOT 1477651; ANNOT 1487130; ANNOT 1487130; CDNA 23495481; ANNOT 1485271; ANNOT 1485271; ANNOT 1447245; ANNOT 1447245; CDNA 23498145; ANNOT 1482362; ANNOT 1482362; ANNOT 1489077; ANNOT 1489077; CDNA 23507479; ANNOT 1510416; ANNOT 1510416; ANNOT 1541253; ANNOT 1541253; CDNA 23518705; ANNOT 1463957; ANNOT 1463957; ANNOT 1458961; ANNOT 1458961; CDNA 23530811; ANNOT 1453922; ANNOT 1453922; CDNA 23545147; ANNOT 1443044; ANNOT 1443044; CDNA 3607011; ANNOT 1442604; ANNOT 1442604; ANNOT 1442612; ANNOT 1442612; ANNOT 1442608; ANNOT 1442608; ANNOT 1452827; ANNOT 1452827; CDNA 3650272; CDNA 3650177; CDNA 3650475; ANNOT 1497025; ANNOT 1497025; CDNA 3651022; ANNOT 1473760; CDNA 3651290; ANNOT 1471370; ANNOT 1471370; ANNOT 1473760; ANNOT 1444471; ANNOT 1444471; ANNOT 1491278; ANNOT 1491278; ANNOT 1447690; ANNOT 1447690; CDNA 36529808; ANNOT 1440346; ANNOT 1440346; ANNOT 1457794; ANNOT 1457794; CDNA 36534269; ANNOT 1524172; ANNOT 1524172; CDNA 36534713; ANNOT 1514007; ANNOT 1514007; ANNOT 1460742; ANNOT 1460742; CDNA 36535718; ANNOT 1451133; ANNOT 1451133; ANNOT 1456774; ANNOT 1456774; CDNA 36560639; ANNOT 1437702; ANNOT 1437702; ANNOT 1444156; ANNOT 1444156; CDNA 36571789; CDNA 36575796; ANNOT 1486224; ANNOT 1486224; ANNOT 1497097; ANNOT 1497097; ANNOT 1444021; ANNOT 1444021; CDNA 36579424; ANNOT 1455663; ANNOT | 2561; 2562; 2563; 2564; 2588; 2589; 2590; 2591; 2592; 2593; 2594; 2595; 2611; 2612; 2613; 2614; 2615; 2625; 2626; 2627; 2628; 2629; 2683; 2684; 2685; 2686; 2687; 2688; 2689; 2774; 2775; 2776; 2777; 2778; 3003; 3004; 3005; 3049; 3050; 3051; 3109; 3110; 3111; 3112; 3113; 3114; 3115; 3116; 3117; 3118; 3119; 3120; 3121; 3122; 3123; 3124; 3125; 3126; 3127; 3128; 3129; 3130; 3131; 3132; 3133; 3134; 3154; 3155; 3156; 3157; 3158; 3159; 3160; 3161; 3162; 3252; 3253; 3254; 3304; 3305; 3306; 3307; 3308; 3309; 3310; 3314; 3315; 3316; 3317; 3318; 3319; 3320; 3321; 3322; 3323; 3324; 3325; 3326; 3327; 3328; 3329; 3330; 3331; 3332; 3333; 3334; 3335; 3336; 3337; 3361; 3362; 3363; 3388; 3389; 3390; 3419; 3420; 3421; 3422; 3423; 3424; 3425; 3426; 3427; 3428; 3429; 3430; 3431; 3432; 3433; 3434; 3435; 3436; 3437; 3438; 3439; 3440; 3441; 3442; 3443; 3444; 3445; 3446; 3447; 3448; 3449; 3450; 3451; 3452; 3453; 3454; 3455; 3456; 3481; 3482; 3483; 3484; 3485; 3486; 3487; 3488; 3489; 3490; 3491; 3622; 3623; 3624; 3625; 3626; 3641; 3642; 3643; 3644; 3645; 3704; 3705; 3706; 3707; 3708; 3748; 3749; 3750; 3751; 3752; 3787; 3788; 3789; 3813; 3814; 3815; 3875; 3876; 3877; 3878; 3879; 3880; 3881; 3882; 3883; 3889; |

TABLE 1-continued

| Tissue | Phenotype Category | Phenotype | Phenotype Description | Applications | Ceres ID | SEQ ID NO |
|---|---|---|---|---|---|---|
| | | | | | 1455663; ANNOT 1438024; ANNOT 1438024; ANNOT 1448068; ANNOT 1448068; CDNA 3695523; ANNOT 1451434; ANNOT 1451434; CDNA 3697835; ANNOT 1461440; ANNOT 1461440; ANNOT 1461427; ANNOT 1461427; ANNOT 1461430; ANNOT 1461430; ANNOT 1440253; ANNOT 1440253; CDNA 3679029; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; ANNOT 1461475; | 3890; 3891; 3892; 3893; 3894; 3895; 3896; 3897; 3898; 3899; 3900; 3901; 3902; 3903; 3904; 3920; 3921; 3922; 3938; 3939; 3940; 3941; 3942; 3943; 3944; 3945; 3946; 3947; 3956; 3957; 3958; 3959; 3960; 4005; 4006; 4007; 4043; 4044; 4045; 4046; 4047; 4053; 4054; 4055; 4056; 4057; 4063; 4064; 4065; 4066; 4067; 4068; 4069; 4070; 4071; 4072; 4073; 4074; 4075; 4076; 4077; 4078; 4079; 4080; 4081; 4082; 4083; 4084; 4085; 4086; 4087; 4088; 4089; 4090; 4091; 4092; 4093; 4094; 4095; 4096; 4097; 4098; 4099; 4100; 4101; 4102; 4103; 4104; 4105; 4106; 4107; 4108; 4109; 4110; 4111; 4112; 4113; 4114; 4115; 4116; 4117; 4118; 4119; 4120; 4121; 4122; 4123; 4124; 4125; 4126; 4127; 4128; 4129; 4130; 4131; 4132; 4133; 4134; 4135; 4136; 4137; 4138; 4139; 4140; 4141; 4142; 4143; 4144; 4145; 4146; 4147; 4148; 4149; 4150; 4151; 4152; 4153; 4154; 4155; 4156; 4157; 4158; 4159; 4160; 4161; 4162; 4163; 4164; 4165; 4166; 4167; 4168; 4169; 4170; 4171; 4172; 4173; 4174; 4175; 4176; 4177; 4178; 4179; 4180; 4181; 4182; 4183; 4184; 4185; 4186. |
| WHOLE PLANT | Development | Late Senescence | The plant senesces significantly late copared to wild-type. | Useful for delaying senescence | CLONE 13263; ANNOT 1470919; ANNOT 1470919; CLONE 13757; ANNOT 1471425; ANNOT 1471425; CLONE 32152; ANNOT 1450535; ANNOT 1450535; ANNOT 1513913; ANNOT 1513913; ANNOT 1460651; ANNOT 1460651; ANNOT 1442535; ANNOT 1442535; ANNOT 1452888; ANNOT 1452888; ANNOT 1487705; ANNOT 1487705; CLONE 33559; ANNOT 1481146; ANNOT 1481146; ANNOT 1481150; ANNOT 1481150; ANNOT 1481138; ANNOT 1481138; ANNOT 1485824; ANNOT 1485824; ANNOT 1534622; ANNOT 1534622; CLONE 40729; ANNOT | 536; 537; 538; 564; 565; 566; 1206; 1207; 1208; 1209; 1210; 1211; 1212; 1213; 1214; 1215; 1216; 1217; 1218; 1310; 1311; 1312; 1313; 1314; 1315; 1316; 1317; 1318; 1319; |

| Tissue | Phenotype Category | Phenotype | Phenotype Description | Applications | Ceres ID | SEQ ID NO |
|---|---|---|---|---|---|---|
| | | | | | 1481678; ANNOT 1481678; CLONE 97480; ANNOT 1493111; ANNOT 1493111; CLONE 99298; ANNOT 1473029; ANNOT 1467502; ANNOT 1467502; CLONE 99657; ANNOT 1461858; ANNOT 1461858; ANNOT 1461858; ANNOT 1440018; ANNOT 1440018; ANNOT 1440018; ANNOT 1440019; ANNOT 1440019; ANNOT 1511305; ANNOT 1511305; ANNOT 1511305; ANNOT 1464927; ANNOT 1464927; CLONE 100245; ANNOT 1535451; ANNOT 1535451; ANNOT 1152285; ANNOT 1532285; ANNOT 148024I; ANNOT 148024I; ANNOT 1446025; CLONE 101798; ANNOT 1449432; ANNOT 1449432; CLONE 106301; CDNA 2350510З; ANNOT 1449431; ANNOT 1502439; ANNOT 1502439; ANNOT 1491278; ANNOT 1491278; ANNOT 1447690; ANNOT 1447690; ANNOT 1490915; ANNOT 1490915; ANNOT 1500987; ANNOT 1500987; | 1320; 1930; 1931; 1932; 2108; 2109; 2110; 2130; 2131; 2132; 2133; 2134; 2142; 2143; 2144; 2145; 2146; 2147; 2148; 2149; 2150; 2151; 2152; 2153; 2154; 2155; 2156; 2157; 2158; 2159; 2160; 2182; 2183; 2184; 2185; 2186; 2187; 2188; 2189; 2190; 2219; 2220; 2221; 2222; 2223; 2224; 2225; 2262; 3687; 3688; 3689; 3690; 3691; 3692; 3693; 3694; 3695; |
| WHOLE PLANT | Nitrogen use | Low Nitrate | The plants are tolerant to low nitrogen/nitrate conditions compared to control. | Useful for making plants tolerant to low nitrogen | CLONE 18152; ANNOT 1448104; ANNOT 1448104; ANNOT 1483641; CLONE 599633; ANNOT 1449885; CDNA 23522373; ANNOT 1538994; ANNOT 1538994; ANNOT 1447080; ANNOT 1447080; CDNA 36529494; | 710; 711; 712; 713; 714; 3270; 3271; 3272; 3761; 3762; 3763; 3764; 3765; 3919; |
| WHOLE PLANT | Nitrogen use | No Nitrogen | The plants have increased vigor under no nitrogen conditions compared to control. | Useful for making plants tolerant to low nitrogen | CLONE 116356; ANNOT 1467190; CLONE 123228; ANNOT 1533417; ANNOT 1533417; ANNOT 1470723; | 2401; 2402; 2403; 2487; 2488; 2489; 2490; 2491; |
| WHOLE PLANT | Nitrogen use, Phosphate use | No N, No PO4 | The plants are tolerant to no nitrogen and no phosphate growth media. | Useful for making plants tolerant to low nitrogen/low phosphate | CLONE 585; ANNOT 1447138; ANNOT 1469376; ANNOT 1469376; ANNOT 1475299; ANNOT 1475299; | 18; 19; 20; 21; 22; 23; 24; |
| WHOLE PLANT | Nitrogen use, Stress tolerance | LNABA | The plants are tolerant to low nitrogen conditions and high ABA concentrations. | Useful for making plants tolerant to low nitrogen and drought conditions | CLONE 38286; ANNOT 1459467; ANNOT 1459467; ANNOT 1516688; ANNOT 1516688; ANNOT 1488767; ANNOT 1488767; ANNOT 1463396; ANNOT 1463396; ANNOT 1495750; ANNOT 1495750; ANNOT 1452612; ANNOT 1452612; ANNOT 1442831; ANNOT 1442831; | 1717; 1718; 1719; 1720; 1721; 1722; 1723; 1724; 1725; 1726; 1727; 1728; 1729; 1730; 1731; |
| WHOLE PLANT | Nutrient uptake | MSX | The plants are tolerant to nitrogen assimilation inhibitor, low nitrogen conditions and have seed nitrogen accumulation. | Useful for making plants tolerant to low nitrogen | CLONE 6288; ANNOT 1442129; ANNOT 1442129; ANNOT 1467192; ANNOT 1467192; CLONE 8184; ANNOT 1485684; ANNOT 1485684; ANNOT 1447192; ANNOT 1447192; CLONE 13625; ANNOT 1455211; ANNOT 1455211; CLONE 15650; ANNOT 1513435; ANNOT 1513435; CLONE 20676; ANNOT 1444531; ANNOT 1444531; ANNOT 1467580; ANNOT 1467580; ANNOT 1450490; ANNOT 1450490; ANNOT 1472925; CLONE 21759; ANNOT 1472925; ANNOT 1460694; ANNOT 1460694; ANNOT 1452864; ANNOT 1452864; CLONE 26838; ANNOT 1452938; ANNOT 1452938; ANNOT 1442477; ANNOT 1442477; CLONE 29992; ANNOT 1494652; ANNOT 1494652; ANNOT 1459467; ANNOT 1459467; ANNOT 1488767; ANNOT 1488767; ANNOT 1463396; ANNOT 1463396; ANNOT 1516688; ANNOT 1516688; ANNOT 1495750; ANNOT 1495750; ANNOT | 280; 281; 282; 283; 284; 352; 353; 354; 355; 356; 544; 545; 546; 644; 645; 646; 801; 802; 803; 804; 805; 806; 807; 859; 860; 861; 862; 863; 864; 865; 1035; 1036; 1037; 1038; 1039; 1161; 1162; 1163; 1717; 1718; 1719; 1720; 1721; 1722; 1723; 1724; 1725; 1726; 1727; 1728; |

TABLE 1-continued

| Tissue | Phenotype Category | Phenotype | Phenotype Description | Applications | Ceres ID | SEQ ID NO |
|---|---|---|---|---|---|---|
| | | | | | 1452612; ANNOT 1452612; ANNOT 1442831; CLONE 38584; ANNOT 1485549; ANNOT 1485549; ANNOT 1447057; CLONE 38891; ANNOT 1440360; ANNOT 1514613; ANNOT CLONE 41359; ANNOT 1520442; CLONE 41471; ANNOT 1515268; ANNOT 1515268; ANNOT 1461975; ANNOT 1449897; ANNOT 1449897; ANNOT 1439694; ANNOT 1519353; ANNOT 1519353; ANNOT 1466018; CLONE 118640; ANNOT 1479513; ANNOT 1479513; ANNOT 1471879; ANNOT 1471879; CLONE 545780; CLONE 561791; ANNOT 1486447; ANNOT 2702830; ANNOT 1516968; ANNOT 1516968; ANNOT 1520085; CDNA 4811190; ANNOT 1482936; ANNOT 1482936; | 1729; 1730; 1731; 1761; 1762; 1763; 1764; 1765; 1806; 1807; 1808; 1809; 1810; 1995; 1996; 1997; 2002; 2003; 2004; 2005; 2006; 2007; 2008; 2009; 2010; 2011; 2012; 2013; 2014; 2426; 2427; 2428; 2638; 2639; 2640; 3196; 3224; 3225; 3226; 3492; 3493; 3494; 3495; 3496; 3511; 3512; 3513; |
| WHOLE SEEDLING | Photosynthetic capacity | Dark Green | The plant is visibly darker green. | Useful for increasing chlorophyll and photosynthetic capacity | CLONE 38370; ANNOT 1471869; ANNOT 1471869; ANNOT 1448032; ANNOT 1448031; ANNOT 1448031; ANNOT 1438060; ANNOT 1438061; ANNOT 1438061; ANNOT 1448030; ANNOT 1437831; ANNOT 1437831; | 1732; 1733; 1734; 1735; 1736; 1737; 1738; 1739; 1740; 1741; 1742; 1743; 1744; 1745; 1746; |
| WHOLE PLANT | Photosynthetic capacity | Dark Green | The plant is abnormally dark green. | Useful for increasing chlorophyll and photosynthetic capacity | CLONE 907; ANNOT 1502138; ANNOT 1449135; ANNOT 1449135; ANNOT 1502138; ANNOT 1453081; ANNOT 1442349; CLONE 1241; ANNOT 1453081; ANNOT 1442349; ANNOT 1442349; CLONE 1496; ANNOT 1490668; ANNOT 1474027; ANNOT 1474027; ANNOT 1497865; ANNOT 1471512; ANNOT 1471512; ANNOT 1443061; ANNOT 1443061; ANNOT 1504203; ANNOT 1505468; ANNOT 1452369; ANNOT 1452369; CLONE 1610; ANNOT 1454586; ANNOT 1454586; ANNOT 1475043; ANNOT 1475043; ANNOT 1507756; ANNOT 1469708; ANNOT 1469708; CLONE 2403; ANNOT 1509972; ANNOT 1509972; ANNOT 1504203; ANNOT 1504203; ANNOT 1443061; ANNOT 1452369; ANNOT 1452369; ANNOT CLONE 2561; ANNOT 1450958; ANNOT 1450958; ANNOT 1456475; ANNOT 1456475; ANNOT 1446945; ANNOT 1446945; CLONE 3000; ANNOT 1518918; ANNOT 1518918; ANNOT 1535677; ANNOT 1535677; ANNOT 1482181; ANNOT 1482181; CLONE 3006; ANNOT 1472173; ANNOT 1472173; CLONE 3036; ANNOT 1456840; ANNOT 1456840; CLONE 3363; ANNOT 1445515; ANNOT 1445515; ANNOT 1461861; ANNOT 1461861; ANNOT 1449363; ANNOT 1449363; ANNOT 1465198; ANNOT 1465198; ANNOT 1518517; ANNOT 1518517; CLONE 3542; ANNOT 1471301; ANNOT 1471301; CLONE 3858; ANNOT 1459068; ANNOT 1459068; CLONE 5597; ANNOT 1507708; ANNOT 1507708; ANNOT 1475094; ANNOT 1475094; CLONE 6387; ANNOT 1509111; ANNOT 1509111; ANNOT 1541620; ANNOT 1541620; CLONE 6411; ANNOT 1505322; ANNOT 1505322; ANNOT 1496110; ANNOT 1496110; ANNOT 1496111; CLONE 7191; ANNOT 1493787; ANNOT 1493787; CLONE 8254; ANNOT 1543042; ANNOT 1543042; ANNOT 1489655; ANNOT 1489655; CLONE 8265; ANNOT 1438919; ANNOT 1438919; ANNOT 1499398; ANNOT 1499398; ANNOT 1446419; ANNOT 1446419; CLONE 8877; ANNOT 1507340; ANNOT 1507340; ANNOT 1529361; ANNOT 1529361; CLONE 8916; ANNOT 1462804; ANNOT 1462804; CLONE 9683; ANNOT 1471514; ANNOT 1471514; CLONE 9897; ANNOT 1445849; ANNOT 1445849; ANNOT 1500561; ANNOT 1500561; ANNOT 1464458; ANNOT 1464458; ANNOT 1467184; ANNOT 1467184; CLONE 11854; ANNOT CLONE 10879; ANNOT 1506763; ANNOT 1506763; ANNOT 1453614; ANNOT 1453614; CLONE 12250; ANNOT 1497150; ANNOT 1497150; ANNOT 1524446; ANNOT 1524446; CLONE | 30; 31; 32; 33; 34; 38; 39; 40; 41; 42; 50; 51; 52; 53; 54; 55; 56; 57; 58; 59; 60; 61; 62; 63; 64; 65; 66; 67; 68; 69; 70; 71; 72; 73; 74; 75; 95; 96; 97; 98; 99; 100; 101; 102; 103; 104; 105; 106; 107; 108; 109; 110; 111; 112; 113; 114; 115; 116; 117; 118; 119; 120; 121; 122; 123; 129; 130; 131; 132; 133; 134; 135; 136; 137; 138; 139; 145; 146; 147; 175; 176; 177; 233; 234; 235; 236; 237; 285; 286; 287; 288; 289; 293; 294; 295; 296; 297; 298; 299; 317; 318; 319; 357; 358; 359; 360; 361; 362; 363; 364; 365; 366; 367; 368; 383; 384; 385; 386; 387; 388; 389; 390; 402; 403; 404; 405; 406; 407; 408; 409; 410; 411; 437; 438; 439; 475; 476; 477; 478; 479; 510; 511; 512; 513; 514; 536; 537; 538; 555; 556; 557; 558; 559; 560; 561; 562; 563; 564; 565; 566; 572; 573; 574; 575; 576; 619; 620; |

TABLE 1-continued

| Tissue | Phenotype Category | Phenotype | Phenotype Description | Applications | Ceres ID | SEQ ID NO |
|---|---|---|---|---|---|---|
| | | | | | 13263; ANNOT 1470919; ANNOT 1442604; CLONE 13745; ANNOT 1442604; ANNOT 1442608; ANNOT 1442612; ANNOT 1442608; ANNOT 1452827; ANNOT 1452827; CLONE 13757; ANNOT 1471425; ANNOT 1471425; CLONE 13800; ANNOT 1458335; ANNOT 1458335; ANNOT 1464663; ANNOT 1464663; CLONE 14583; ANNOT 1530256; ANNOT 1530256; ANNOT 1476783; ANNOT 1476783; ANNOT 1503166; ANNOT 1503166; CLONE 16461; ANNOT 1479013; ANNOT 1479013; CLONE 17632; ANNOT 1474847; ANNOT 1474847; ANNOT 1474847; ANNOT 1507835; CLONE 1776l; ANNOT 1481206; ANNOT 1481206; ANNOT 1534689; ANNOT 1534689; CLONE 17912; ANNOT 1514378; ANNOT 1514378; ANNOT 1494118; ANNOT 1494118; CLONE 19116; ANNOT 1467522; ANNOT 1467522; ANNOT 1526421; ANNOT 1526421; CLONE 19188; CLONE 19188; ANNOT 1445089; ANNOT 1445089; CLONE 19486; ANNOT 1452204; ANNOT 1452204; ANNOT 1443204; ANNOT 1443204; CLONE 19510; ANNOT 1501412; ANNOT 1501412; ANNOT 1490383; ANNOT 1490383; ANNOT 1448419; ANNOT 1448419; CLONE 19657; ANNOT 1456256; ANNOT 1456256; ANNOT 1503828; ANNOT 1503828; ANNOT 1450752; ANNOT 1450752; CLONE 20045; ANNOT 1519797; ANNOT 1519797; CLONE 21068; ANNOT 1463333; ANNOT 1463333; ANNOT 1505772; ANNOT 1505772; ANNOT 1495675; ANNOT 1495675; ANNOT 1469576; ANNOT 1469576; ANNOT 1442758; ANNOT 1442758; CLONE 23322; ANNOT 1512337; ANNOT 1512337; ANNOT 1517094; ANNOT 1517094; CLONE 23518; ANNOT 1475658; ANNOT 1475658; ANNOT 1449267; ANNOT 1449267; ANNOT 1507191; ANNOT 1507191; CLONE 23523; ANNOT 1453919; ANNOT 1453919; CLONE 25538; ANNOT 1480776; ANNOT 1480776; CLONE 2607; CLONE 25607; ANNOT 1450220; ANNOT 1450220; CLONE 25758; ANNOT 1473748; ANNOT 1473748; CLONE 25886; ANNOT 1446650; ANNOT 1446650; ANNOT 1439514; ANNOT 1439514; ANNOT 1477202; ANNOT 1477202; ANNOT 1455325; ANNOT 1455325; CLONE 26560; ANNOT 1536088; ANNOT 1536088; ANNOT 1482610; ANNOT 1482610; CLONE 26637; ANNOT 1451045; ANNOT 1451045; ANNOT 1451045; CLONE 26655; ANNOT 1477170; ANNOT 1477170; ANNOT 1508498; ANNOT 1508498; ANNOT 1530647; ANNOT 1530647; CLONE 26825; ANNOT 1513438; ANNOT 1513438; ANNOT 1460167; ANNOT 1460167; CLONE 27460; ANNOT 1474847; ANNOT 1474847; ANNOT 1507835; ANNOT 1507835; CLONE 27464; ANNOT 1453044; ANNOT 1453044; ANNOT 1451171; ANNOT 1451171; CLONE 28033; ANNOT 1459086; ANNOT 1459086; CLONE 28602; ANNOT 1461728; ANNOT 1461728; ANNOT 1488330; ANNOT 1488330; ANNOT 1460480; ANNOT 1460480; ANNOT 1461614; ANNOT 1461614; ANNOT 1479711; ANNOT 1479711; ANNOT 1479712; ANNOT 1479712; ANNOT 1488329; ANNOT 1488329; ANNOT 1460481; ANNOT 1460481; ANNOT 1461613; ANNOT 1461613; ANNOT 1458198; ANNOT 1458198; ANNOT 1483327; ANNOT 1483327; CLONE 30759; ANNOT 1520359; ANNOT 1520359; ANNOT 1494753; ANNOT 1494753; ANNOT 1441875; ANNOT 1441875; ANNOT 1467006; ANNOT 1467006; ANNOT 1441867; ANNOT 1441867; ANNOT 1441871; ANNOT 1441871; ANNOT 1441864; ANNOT 1441864; ANNOT 1441868; ANNOT 1441868; ANNOT 1441859; ANNOT 1441859; ANNOT 1467009; ANNOT 1467009; CLONE 31014; ANNOT 1527449; ANNOT 1527449; ANNOT 1527449; ANNOT 1484207; ANNOT 1484207; CLONE 32348; ANNOT 1470719; ANNOT 1470719; ANNOT 1470719; ANNOT 1543728; ANNOT 1543728; ANNOT 1482066; ANNOT 1482066; CLONE 32361; ANNOT 1471776; ANNOT 1471776; ANNOT 1445033; ANNOT 1445033; CLONE 32548; ANNOT 1450324; ANNOT 1450324; ANNOT 1460836; ANNOT 1460836; ANNOT 32615; ANNOT 1471372; ANNOT 1471372; ANNOT 32737; ANNOT 1536373; ANNOT 1536373; ANNOT 1482905; ANNOT | 621; 622; 623; 624; 625; 647; 648; 649; 695; 696; 697; 698; 699; 700; 701; 702; 703; 704; 705; 706; 707; 708; 709; 735; 736; 737; 738; 739; 747; 748; 749; 767; 768; 769; 770; 771; 772; 773; 774; 775; 776; 777; 778; 789; 790; 791; 792; 793; 794; 795; 818; 819; 820; 821; 822; 823; 824; 825; 826; 827; 828; 829; 830; 831; 897; 898; 899; 900; 901; 907; 908; 909; 910; 911; 912; 913; 914; 915; 916; 967; 968; 969; 970; 971; 972; 973; 974; 975; 986; 987; 988; 989; 990; 991; 992; 993; 994; 1015; 1016; 1017; 1018; 1019; 1020; 1021; 1022; 1023; 1024; 1025; 1026; 1027; 1028; 1029; 1030; 1031; 1032; 1033; 1034; 1055; 1056; 1057; 1058; 1059; 1060; 1061; 1062; 1063; 1064; 1085; 1086; 1087; 1099; 1100; 1101; 1102; 1103; 1104; 1105; 1106; 1107; 1108; 1109; 1110; 1111; 1112; 1113; 1114; 1115; 1116; 1117; 1118; 1119; 1120; 1121; 1164; 1165; 1166; 1167; 1168; 1169; 1170; 1171; 1172; 1173; 1174; 1175; 1176; 1177; 1178; 1179; 1180; 1181; 1182; 1183; 1184; 1185; 1186; 1187; 1188; 1189; 1219; 1220; 1221; 1222; 1223; 1224; 1225; 1226; 1227; 1228; 1229; 1230; 1231; 1232; 1233; 1234; 1235; 1239; 1240; 1241; 1242; 1243; 1244; 1245; 1246; 1247; 1248; 1249; 1250; 1251; 1252; 1253; 1254; 1279; 1280; 1281; 1287; 1288; 1289; 1290; |

TABLE 1-continued

| Tissue | Phenotype Category | Phenotype | Phenotype Description | Applications | Ceres ID | SEQ ID NO |
|---|---|---|---|---|---|---|
| | | | | | 1482905; CLONE 32751; ANNOT 1451143; ANNOT 1451171; CLONE 32753; ANNOT 1480607; ANNOT 1472242; CLONE 33482; ANNOT 1499019; ANNOT 1499019; CLONE 33554; ANNOT 1445599; ANNOT 1445599; ANNOT 1471882; ANNOT 1471882; ANNOT 1452398; ANNOT 1452398; ANNOT 1443041; ANNOT 1443041; ANNOT 1452397; ANNOT 1452397; ANNOT 1505498; ANNOT 1505498; ANNOT 1505497; ANNOT 1505497; ANNOT 1443040; ANNOT 1443040; ANNOT 1495964; ANNOT 1498580; ANNOT 1498580; ANNOT 1466060; CLONE 34167; ANNOT 1538733; ANNOT 1538733; ANNOT 1499810; ANNOT 1485323; ANNOT 1485323; CLONE 34385; ANNOT 1445331; ANNOT 1445331; ANNOT 1498316; ANNOT 1498316; CLONE 34412; ANNOT 1449739; ANNOT 1449739; ANNOT 1449738; ANNOT 1449738; ANNOT 1458830; CLONE 34549; ANNOT 1442496; ANNOT 1442496; CLONE 34635; ANNOT 1487773; ANNOT 1487773; ANNOT 1457333; ANNOT 1457333; ANNOT 1442634; ANNOT 1442634; CLONE 35015; ANNOT 1438730; ANNOT 1438730; CLONE 35493; ANNOT 1457751; ANNOT 1457751; ANNOT 1518757; ANNOT 1518757; CLONE 1465420; ANNOT 1465420; CLONE 35999; ANNOT 1515818; ANNOT 1515818; CLONE 36904; ANNOT 1526083; ANNOT 1526083; ANNOT 1498856; ANNOT 1498856; ANNOT 1445872; ANNOT 1445872; ANNOT 1472663; ANNOT 1472663; CLONE 37217; ANNOT 1465580; ANNOT 1465580; ANNOT 1472014; ANNOT 1472014; ANNOT 1445195; ANNOT 1445195; CLONE 37229; ANNOT 1485157; ANNOT 1485157; ANNOT 1476218; ANNOT 1476218; CLONE 37288; ANNOT 1453650; ANNOT 1453650; CLONE 37298; ANNOT 1476538; ANNOT 1476538; ANNOT 1493576; ANNOT 1493576; CLONE 37493; ANNOT 1494370; ANNOT 1494370; ANNOT 1441478; ANNOT 1441478; CLONE 37543; ANNOT 1539972; ANNOT 1539972; ANNOT 1486562; ANNOT 1486562; ANNOT 1496735; ANNOT 1496735; ANNOT 1443794; ANNOT 1443794; CLONE 37658; ANNOT 1497485; ANNOT 1497485; CLONE 37663; ANNOT 1447659; ANNOT 1447659; ANNOT 1438478; ANNOT 1438478; CLONE 38101; ANNOT 1454656; ANNOT 1454656; ANNOT 1528263; ANNOT 1528263; ANNOT 1458103; ANNOT 1458103; ANNOT 1464899; ANNOT 1464899; ANNOT 1482966; ANNOT 1482966; ANNOT 1441039; ANNOT 1441039; ANNOT 1520449; ANNOT 1520449; CLONE 38105; ANNOT 1473032; ANNOT 1473032; ANNOT 1467499; ANNOT 1467499; ANNOT 1526442; ANNOT 1526442; CLONE 38214; ANNOT 1466779; ANNOT 1466779; ANNOT 1465769; ANNOT 1465769; ANNOT 1538318; ANNOT 1538318; CLONE 38277; ANNOT 1512884; ANNOT 1512884; ANNOT 1538419; ANNOT 1538419; ANNOT 1542971; ANNOT 1542971; ANNOT 1521332; ANNOT 1521332; ANNOT 1467961; ANNOT 1467961; CLONE 38690; ANNOT 1525183; ANNOT 1525183; CLONE 39286; ANNOT 1447961; ANNOT 1447961; ANNOT 1490936; ANNOT 1490936; CLONE 39740; ANNOT 1483180; ANNOT 1483180; ANNOT 1480950; ANNOT 1480950; CLONE 40508; ANNOT 1453626; ANNOT 1453626; CLONE 40538; ANNOT 1452757; ANNOT 1452757; CLONE 40729; ANNOT 1481678; ANNOT 1481678; CLONE 41320; ANNOT 1488507; ANNOT 1488507; ANNOT 1554929; ANNOT 1554929; ANNOT 1460282; ANNOT 1460282; CLONE 1516613; ANNOT 1516613; ANNOT 1513097; ANNOT 1513097; ANNOT 1463324; ANNOT 1463324; CLONE 41439; CLONE 41446; ANNOT 1469832; ANNOT 1469832; CLONE 42336; ANNOT 1455510; ANNOT 1455510; ANNOT 1538733; CLONE 42533; ANNOT 1499810; ANNOT 1499810; ANNOT 1485323; ANNOT 1485323; ANNOT 1462354; ANNOT 1462354; CLONE 42955; ANNOT CLONE 42925; ANNOT 1505155; ANNOT 1505155; CLONE 93867; ANNOT 1474944; ANNOT 1474944; | 1291; 1292; 1293; 1294; 1295; 1296; 1297; 1298; 1299; 1300; 1301; 1302; 1303; 1304; 1305; 1306; 1307; 1308; 1309; 1343; 1344; 1345; 1346; 1347; 1348; 1349; 1364; 1365; 1366; 1367; 1368; 1376; 1377; 1378; 1379; 1380; 1381; 1382; 1403; 1404; 1405; 1416; 1417; 1418; 1419; 1420; 1421; 1422; 1438; 1439; 1440; 1460; 1461; 1462; 1463; 1464; 1465; 1466; 1487; 1488; 1489; 1585; 1586; 1587; 1588; 1589; 1590; 1591; 1592; 1593; 1610; 1611; 1612; 1613; 1614; 1615; 1616; 1617; 1618; 1619; 1620; 1621; 1622; 1623; 1624; 1625; 1626; 1627; 1628; 1629; 1637; 1638; 1639; 1640; 1641; 1642; 1643; 1644; 1645; 1646; 1647; 1648; 1649; 1650; 1654; 1655; 1656; 1657; 1658; 1659; 1660; 1661; 1682; 1683; 1684; 1685; 1686; 1687; 1688; 1689; 1690; 1691; 1692; 1693; 1694; 1695; 1696; 1697; 1698; 1699; 1700; 1701; 1702; 1703; 1707; 1708; 1709; 1710; 1711; 1712; 1713; 1714; 1715; 1716; 1747; 1748; 1749; 1750; 1751; 1752; 1753; 1774; 1775; 1776; 1838; 1839; 1840; 1841; 1842; 1877; 1878; 1879; 1880; 1881; 1912; 1913; 1914; 1915; 1916; 1917; 1930; 1931; 1932; 1981; 1982; 1983; 1984; 1985; 1986; 1987; 1988; 1989; 1990; 1991; 1992; 1993; 1994; 1998; 1999; 2000; 2001; 2018; 2019; 2020; 2030; 2031; 2032; 2033; 2034; 2035; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1506849; ANNOT 1506849; ANNOT 1492957; ANNOT 1492957; CLONE 95135; ANNOT 1527449; ANNOT 1527449; ANNOT 1537653; ANNOT 1537653; ANNOT 1473733; ANNOT 1473733; ANNOT 1468537; ANNOT 1468537; CLONE 95453; ANNOT 1460836; ANNOT 1460836; ANNOT 1450324; ANNOT 1450324; CLONE 95677; ANNOT 1459723; ANNOT 1459723; ANNOT 1516455; ANNOT 1516455; ANNOT 1516455; CLONE 96020; ANNOT 1450365; ANNOT 1450365; ANNOT 1460794; ANNOT 1460794; CLONE 97415; ANNOT 1481701; ANNOT 1481701; CLONE 98855; ANNOT 1460836; ANNOT 1460836; ANNOT 1450324; ANNOT 1450324; ANNOT CLONE 100465; ANNOT 1466439; ANNOT 1466439; ANNOT 1448977; ANNOT 1448977; ANNOT 1519767; ANNOT 1519767; ANNOT 1501982; ANNOT 1501982; ANNOT CLONE 103581; ANNOT 1486398; ANNOT 1486398; ANNOT 1496840; ANNOT 1496840; CLONE 104929; ANNOT 1449020; ANNOT 1449020; CLONE 105554; ANNOT 1451783; ANNOT 1451783; CLONE 107731; ANNOT 1480518; ANNOT 1480518; ANNOT 1442194; ANNOT 1442194; ANNOT 1454127; ANNOT 1454127; ANNOT 1461414; ANNOT 1461414; ANNOT 1447424; ANNOT 1447424; ANNOT 1452873; ANNOT 1452873; ANNOT 1474708; ANNOT 1474708; CLONE 110454; CLONE 111209; ANNOT 1494507; ANNOT 1494507; CLONE 113990; ANNOT 1438327; ANNOT 1438327; ANNOT 1447769; ANNOT 1447769; CLONE 114602; ANNOT 1450785; ANNOT 1450785; ANNOT 1456283; ANNOT 1456283; ANNOT 1460638; ANNOT 1460638; ANNOT 1513900; ANNOT 1513900; ANNOT 1540271; ANNOT 1540271; CLONE 115946; ANNOT 1458342; ANNOT 1458342; CLONE 115975; ANNOT 1507138; ANNOT 1507138; CLONE 116257; ANNOT 1520806; ANNOT 1520806; ANNOT 1473089; ANNOT 1473089; ANNOT 1500150; ANNOT 1500150; CLONE 117369; ANNOT 1499284; ANNOT 1499284; ANNOT 1481671; ANNOT 1481671; CLONE 117895; ANNOT 1448592; ANNOT 1448592; ANNOT 1448594; ANNOT 1448594; CLONE 118337; ANNOT 1454773; ANNOT 1454773; ANNOT 1511811; ANNOT 1511811; ANNOT 1478364; ANNOT 1478364; ANNOT 1464394; ANNOT 1464394; CLONE 119256; ANNOT 1469636; ANNOT 1469636; ANNOT 1479002; ANNOT 1479002; CLONE 141890; ANNOT 1494533; ANNOT 1494533; ANNOT 1494533; ANNOT 1466313; ANNOT 1466313; CLONE 147358; ANNOT 1493111; ANNOT 1493111; ANNOT 1493111; ANNOT 1461452; ANNOT 1461452; CLONE 150912; ANNOT 1533910; ANNOT 1533910; ANNOT 1480439; ANNOT 1480439; CLONE 152141; ANNOT 1439403; ANNOT 1439403; CLONE 157547; ANNOT 1513900; ANNOT 1540271; ANNOT 1473898; CLONE 157730; ANNOT 1532681; ANNOT 1532681; ANNOT 1469739; ANNOT 1469739; CLONE 158333; ANNOT 1466505; ANNOT 1466505; ANNOT 1449026; ANNOT 1449026; CLONE 205648; ANNOT 1456842; ANNOT 1456842; ANNOT 1504224; ANNOT 1504224; CLONE 226818; ANNOT 1503617; ANNOT 1503617; ANNOT 1450560; ANNOT 1450560; ANNOT 1460622; ANNOT 1460622; CLONE 264705; ANNOT 1485750; ANNOT 1485750; ANNOT 1440730; ANNOT 1440730; ANNOT 1440730; CLONE 382267; ANNOT 1456223; ANNOT 1456223; ANNOT 1467304; ANNOT 1467304; ANNOT 1467304; CLONE 463203; ANNOT 1511505; ANNOT 1511505; CLONE 464504; ANNOT 1438401; ANNOT 1438401; CLONE 482122; ANNOT 1438776; ANNOT 1438776; CLONE 534397; ANNOT 1453458; ANNOT 1453458; ANNOT 1489056; ANNOT 1489056; ANNOT 1442794; ANNOT 1442794; ANNOT 1495713; ANNOT 1495713; ANNOT 1495713; ANNOT 1442797; ANNOT 1442797; ANNOT 1468612; ANNOT 1468612; ANNOT 1468612; ANNOT 1460503; ANNOT 1460503; ANNOT 1488307; ANNOT 1488307; CLONE 627596; ANNOT 1440343; ANNOT 1440343; ANNOT 1493212; ANNOT 1493212; CLONE 641355; ANNOT 1500987; ANNOT 1500987; ANNOT 1490915; ANNOT 1490915; CLONE 641355; ANNOT 1463335; ANNOT 1463335; ANNOT 1463334; ANNOT 1463334; ANNOT 1452665; ANNOT 1452665; CLONE 660003; ANNOT 1508184; | 2036; 2045; 2046; 2047; 2048; 2049; 2050; 2064; 2065; 2066; 2067; 2068; 2069; 2070; 2076; 2077; 2078; 2079; 2080; 2081; 2082; 2083; 2084; 2085; 2086; 2087; 2088; 2089; 2090; 2091; 2092; 2093; 2094; 2095; 2096; 2097; 2098; 2099; 2100; 2101; 2102; 2118; 2119; 2120; 2121; 2122; 2196; 2197; 2198; 2199; 2200; 2201; 2202; 2203; 2204; 2232; 2233; 2234; 2235; 2236; 2237; 2238; 2239; 2247; 2248; 2249; 2263; 2264; 2265; 2266; 2267; 2268; 2269; 2270; 2271; 2272; 2273; 2274; 2275; 2276; 2277; 2313; 2314; 2315; 2316; 2340; 2341; 2342; 2343; 2344; 2350; 2351; 2352; 2353; 2354; 2355; 2356; 2357; 2358; 2359; 2360; 2370; 2371; 2372; 2373; 2374; 2375; 2394; 2395; 2396; 2397; 2398; 2399; 2400; 2407; 2408; 2409; 2410; 2411; 2412; 2413; 2414; 2415; 2416; 2417; 2418; 2419; 2420; 2421; 2422; 2423; 2424; 2425; 2451; 2452; 2453; 2454; 2455; 2523; 2524; 2525; 2526; 2527; 2528; 2529; 2530; 2531; 2532; 2555; 2556; 2557; 2558; 2559; 2568; 2569; 2570; 2593; 2594; 2595; 2601; 2602; 2603; 2604; 2605; 2611; 2612; 2613; 2614; 2615; 2625; 2626; 2627; 2628; 2629; 2676; 2677; 2678; 2679; 2680; 2681; 2682; 2779; 2780; 2781; 2782; 2783; 2986; 2987; 2988; 2989; 2990; 3003; 3004; 3005; 3006; 3007; 3008; 3049; 3050; 3051; |

TABLE 1-continued

| Tissue | Phenotype Category | Phenotype | Phenotype Description | Applications | Ceres ID | SEQ ID NO |
|---|---|---|---|---|---|---|
| | | | | | ANNOT 1508184; ANNOT 1528645; CLONE 664365; ANNOT 1463333; ANNOT 1478872; ANNOT 1505772; ANNOT 1478872; ANNOT 1478872; ANNOT 1442758; ANNOT 1442758; ANNOT 1495675; ANNOT 1495675; ANNOT 1469576; ANNOT 1452666; ANNOT 1452666; ANNOT 1452668; ANNOT 1442757; ANNOT 1442757; CLONE 965175; ANNOT 1479013; CLONE 1001432; ANNOT 1475043; ANNOT 1475043; ANNOT 1454586; ANNOT 1507756; ANNOT 1507756; ANNOT 1469708; CLONE 1006934; ANNOT 1532963; ANNOT 1532963; CLONE 1007549; ANNOT 1458198; ANNOT 1458198; ANNOT 1439989; ANNOT 1439989; ANNOT 1464789; ANNOT 1461728; ANNOT 1461728; ANNOT 1479711; ANNOT 1440649; ANNOT 1440649; ANNOT 1464547; ANNOT 1454104; ANNOT 1454104; CLONE 1011386; ANNOT 1531134; ANNOT 1508758; ANNOT 1508758; CLONE 1011537; ANNOT 1473879; ANNOT 1468666; ANNOT 1468666; ANNOT 1438163; CLONE 1043081; ANNOT 1478584; ANNOT 1455564; ANNOT 1508764; ANNOT 1508764; ANNOT 1508764; ANNOT 1477651; ANNOT 1487130; ANNOT 1487130; CDNA 12672729; ANNOT 1500350; CDNA 23494432; CDNA 23495481; ANNOT 1485271; ANNOT 1447245; ANNOT 1447245; CDNA 23498145; ANNOT 1482362; ANNOT 1489077; ANNOT 1489077; ANNOT 1510416; ANNOT 1510416; ANNOT 1541253; CDNA 23518705; ANNOT 1463957; ANNOT 1463957; ANNOT 1458961; CDNA 23530811; ANNOT 1453922; CDNA 23507011; ANNOT 1442604; ANNOT 1442612; ANNOT 1442608; ANNOT 1442612; ANNOT 1452827; CDNA 36512904; ANNOT 1471370; ANNOT 1444471; ANNOT 1491278; ANNOT 1491278; ANNOT 1447690; CDNA 36514446; ANNOT 1475322; ANNOT 1447690; ANNOT 1457794; ANNOT 1449892; CDNA 36695523; CDNA 36534269; CDNA 36545977; ANNOT 1449892; ANNOT . 1447690; ANNOT 1451434; ANNOT . 1491278; ANNOT . 1447690; ANNOT . 1500987; ANNOT . 1500987; ANNOT . 1490915; ANNOT . 1490915; | 3109; 3110; 3111; 3112; 3113; 3114; 3115; 3116; 3117; 3118; 3119; 3120; 3121; 3122; 3123; 3124; 3125; 3126; 3127; 3128; 3129; 3299; 3300; 3301; 3302; 3303; 3304; 3305; 3306; 3307; 3308; 3309; 3310; 3314; 3315; 3316; 3317; 3318; 3319; 3320; 3321; 3322; 3323; 3324; 3325; 3326; 3327; 3328; 3329; 3330; 3331; 3332; 3333; 3334; 3335; 3336; 3337; 3388; 3389; 3390; 3419; 3420; 3421; 3422; 3423; 3424; 3425; 3426; 3427; 3437; 3438; 3439; 3440; 3441; 3442; 3443; 3444; 3445; 3446; 3447; 3448; 3449; 3450; 3451; 3452; 3453; 3454; 3455; 3456; 3462; 3463; 3464; 3465; 3466; 3467; 3468; 3469; 3470; 3471; 3472; 3473; 3481; 3482; 3483; 3484; 3485; 3486; 3487; 3488; 3489; 3490; 3491; 3517; 3518; 3519; 3621; 3622; 3623; 3624; 3625; 3626; 3641; 3642; 3643; 3644; 3645; 3687; 3704; 3705; 3706; 3707; 3708; 3748; 3749; 3750; 3751; 3752; 3787; 3788; 3789; 3875; 3876; 3877; 3878; 3879; 3880; 3881; 3882; 3883; 3896; 3897; 3898; 3899; 3900; 3901; 3902; 3903; 3904; 3905; 3906; 3907; 3938; 3939; 3940; 3941; 3942; 3984; 3985; 3986; 4070; 4071; 4072; 3688; 3689; 3690; 3691; 3692; 3693; 3694; 3695; |
| ROSETTE LEAVES | Shade | Long Petioles | The leaf petioles are abnormally long. | Useful for making plants that grow better in shade | CLONE 11854; ANNOT 1506763; ANNOT 1453614; ANNOT 1453614; CLONE 13757; ANNOT 1471425; ANNOT 1471425; CLONE 27460; ANNOT 1474847; ANNOT 1474847; ANNOT 1507835; ANNOT 1507835; CLONE 35999; ANNOT 1515818; ANNOT 1515818; CLONE 38690; ANNOT 1525183; ANNOT 1525183; CLONE 151087; ANNOT 1504145; ANNOT 1504145; ANNOT | 475; 476; 477; 478; 479; 564; 565; 566; 1055; 1056; 1057; 1058; 1059; 1487; 1488; 1489; 1774; 1775; 1776; 2560; 2561; |

TABLE 1-continued

| Tissue | Phenotype Category | Phenotype | Phenotype Description | Applications | Ceres ID | SEQ ID NO |
|---|---|---|---|---|---|---|
| | | | | | 1451079; ANNOT 1451079; CLONE 158833; ANNOT 1466505; ANNOT 1449026; ANNOT 1449026; CLONE 225200; ANNOT 1471976; ANNOT 1471976; ANNOT 1465507; ANNOT 1465507; CLONE 641355; ANNOT 1463335; ANNOT 1463335; ANNOT 1463334; ANNOT 1463334; ANNOT 1452665; ANNOT 1452665; CDNA 23507479; ANNOT 1510416; ANNOT 1541253; ANNOT 1541253; CDNA 3651789; ANNOT 1444156; ANNOT 1497097; ANNOT 1497097; | 2562; 2563; 2564; 2611; 2612; 2613; 2614; 2615; 2655; 2656; 2657; 2658; 2659; 3304; 3305; 3306; 3307; 3308; 3309; 3310; 3704; 3705; 3706; 3707; 3708; 3893; 3894; 3895; 4043; 4044; 4045; 4046; 4047; |
| ROSETTE LEAVES | Shade | Varying Petiole Lengths | the leaf petioles vary in length throughout the rosette | Useful for making plants that grow better in shade | CLONE 20945; ANNOT 1519797; ANNOT 1519797; CLONE 38419; ANNOT 1542971; ANNOT 1542971; ANNOT 1521332; ANNOT 1521332; ANNOT 1467961; ANNOT 1467961; | 818; 819; 820; 1747; 1748; 1749; 1750; 1751; 1752; 1753; |
| WHOLE PLANT | Stress tolerance | ABA | The plants are tolerant to ABA/drought and/or other stresses | Useful for making plants with enhanced tolerance to drought | CLONE 2083; ANNOT 1441581; ANNOT 1441581; CLONE 5132; ANNOT 1465660; ANNOT 1465660; CLONE 6637; ANNOT 1456291; ANNOT 1456291; ANNOT 1450794; ANNOT 1450794; CLONE 7713; ANNOT 1470658; ANNOT 1470658; ANNOT 1480027; ANNOT 1480027; CLONE 10044; ANNOT 1510467; ANNOT 1510467; ANNOT 1457266; ANNOT 1457266; ANNOT 1457267; ANNOT 1457267; CLONE 10987; ANNOT 1454090; ANNOT 1454090; ANNOT 1475712; ANNOT 1475712; CLONE 11496; ANNOT 1520074; ANNOT 1520074; CLONE 11830; ANNOT 1472114; ANNOT 1472114; ANNOT 1525524; ANNOT 1525524; ANNOT 1453309; ANNOT 1453309; CLONE 13704; ANNOT 1481636; ANNOT 1481636; ANNOT 1461019; ANNOT 1461019; ANNOT 1496766; ANNOT 1496766; CLONE 22551; ANNOT 1443824; ANNOT 1443824; ANNOT 1486521; ANNOT 1486521; ANNOT 1465987; ANNOT 1465987; ANNOT 1451283; ANNOT 1451283; CLONE 29678; ANNOT 1487885; ANNOT 1487885; ANNOT 1457156; ANNOT 1457156; ANNOT 1441125; ANNOT 1441125; ANNOT 1494024; ANNOT 1494024; CLONE 25200; ANNOT 1511048; ANNOT 1511048; CLONE 26006; ANNOT 1457048; ANNOT 1457048; ANNOT 1510252; ANNOT 1510252; ANNOT 1451281; ANNOT 1451281; ANNOT 1451282; ANNOT 1451282; ANNOT 1504349; ANNOT 1504349; CLONE 34358; ANNOT 1452837; ANNOT 1452837; ANNOT 1442590; ANNOT 1442590; ANNOT 1450457; ANNOT 1450457; ANNOT 1460721; ANNOT 1460721; CLONE 37952; ANNOT 1438071; ANNOT 1438071; ANNOT 1448019; ANNOT 1448019; ANNOT 1498609; ANNOT 1498609; ANNOT 1472308; ANNOT 1472308; CLONE 38206; ANNOT 1525715; ANNOT 1525715; ANNOT 1543295; ANNOT 1543295; ANNOT 1445629; ANNOT 1445629; CLONE 99920; ANNOT 1446695; ANNOT 1446695; ANNOT 1481700; ANNOT 1481700; CLONE 111694; ANNOT 1468539; ANNOT 1468539; ANNOT 1492884; ANNOT 1492884; ANNOT 1527153; ANNOT 1527153; CLONE 120982; ANNOT 1515144; ANNOT 1515144; ANNOT 1487614; ANNOT 1487614; CLONE 529835; ANNOT 1541881; ANNOT 1541881; ANNOT 1488468; ANNOT 1488468; ANNOT 1475186; ANNOT 1475186; ANNOT 1437875; ANNOT 1437875; ANNOT 1476056; ANNOT 1476056; ANNOT 1454958; ANNOT 1454958; ANNOT 1454260; ANNOT 1454260; CDNA 23510894; ANNOT 1467221; ANNOT 1467221; ANNOT 1442171; ANNOT 1442171; CDNA 23519977; ANNOT 1459840; ANNOT 1459840; | 87; 88; 89; 220; 221; 222; 312; 313; 314; 315; 316; 328; 329; 330; 331; 332; 412; 413; 414; 415; 416; 417; 418; 440; 441; 442; 443; 444; 460; 461; 462; 463; 464; 465; 466; 467; 468; 469; 547; 548; 549; 884; 885; 886; 887; 888; 889; 890; 891; 892; 893; 894; 895; 896; 957; 958; 959; 995; 996; 997; 998; 999; 1000; 1001; 1002; 1003; 1004; 1005; 1006; 1007; 1008; 1009; 1156; 1157; 1158; 1159; 1160; 1355; 1356; 1357; 1358; 1359; 1360; 1361; 1362; 1363; 1669; 1670; 1671; 1672; 1673; 1674; 1675; 1676; 1677; 1678; 1679; 1680; 1681; 1704; 1705; 1706; 2168; 2169; 2170; 2171; 2172; 2322; 2323; 2324; 2325; 2326; 2475; 2476; 2477; 2478; 2479; 3052; 3053; 3054; 3055; 3056; 3057; 3058; 3059; 3060; 3061; 3062; 3063; 3064; 3065; 3066; 3067; 3068; 3712; 3713; 3714; 3715; 3716; 3753; 3754; 3755; |
| WHOLE PLANT | Stress tolerance | Cold Germination | The plant germinate better at cold temperatures | Useful for making plants with increased tolerance to | CLONE 2403; ANNOT 1509972; ANNOT 1504203; ANNOT 1504203; ANNOT 1443061; ANNOT 1443061; ANNOT 1452369; ANNOT 1452369; CLONE 4524; ANNOT 1442935; ANNOT 1442935; CLONE 10072; ANNOT 1458457; ANNOT 1458457; ANNOT 1464514; ANNOT 1464514; ANNOT 1493574; | 95; 96; 97; 98; 99; 100; 101; 102; 103; 204; 205; 206; 419; 420; 421; 422; 423; 424; 425; 426; 427; |

TABLE 1-continued

| Tissue | Phenotype Category | Phenotype | Phenotype Description | Applications | Ceres ID | SEQ ID NO |
|---|---|---|---|---|---|---|
| | | | compared to control. | cold stress | ANNOT 1493574; ANNOT 1527203; CLONE 17081; ANNOT 1481199; ANNOT 1481199; ANNOT 1543087; ANNOT 1489696; ANNOT 1489696; CLONE 33559; ANNOT 1481146; ANNOT 1481146; ANNOT 1481150; ANNOT 1481150; ANNOT 1481138; ANNOT 1485824; ANNOT 1485824; ANNOT 1534622; CLONE 271922; ANNOT 1485385; ANNOT 1485385; ANNOT 1486234; CDNA 36553419; ANNOT 1459723; ANNOT 1459723; ANNOT 1516455; ANNOT 1516455; | 663; 664; 665; 666; 667; 668; 669; 1310; 1311; 1312; 1313; 1314; 1315; 1316; 1317; 1318; 1319; 1320; 2816; 2817; 2818; 2819; 2820; 3995; 3996; 3997; 3998; 3999; |
| ROSETTE LEAVES | Stress tolerance | Glossy | The leaves are shiny/glossy in appearance | Useful for making plants with enhanced abiotic stress tolerance | CLONE 12272; CLONE 12993; ANNOT 1506387; ANNOT 1474522; ANNOT 1474522; CLONE 12993; ANNOT 1479464; ANNOT 1479464; CLONE 14583; ANNOT 1530256; ANNOT 1530256; ANNOT 1476783; ANNOT 1476783; ANNOT 1503166; ANNOT 1503166; CLONE 35742; ANNOT 1478035; ANNOT 1478035; CLONE 38277; ANNOT 1512884; ANNOT 1512884; ANNOT 41446; ANNOT 1469832; ANNOT 1469832; CLONE 205648; ANNOT 1456842; ANNOT 1456842; ANNOT 1504224; ANNOT 1504224; CLONE 641355; ANNOT 1463355; ANNOT 1463335; ANNOT 1463334; ANNOT 1463334; ANNOT 1452665; ANNOT 1452665; CLONE 664365; ANNOT 1463333; ANNOT 1463333; ANNOT 1505772; ANNOT 1505772; ANNOT 1478872; ANNOT 1478872; ANNOT 1442758; ANNOT 1442758; ANNOT 1495675; ANNOT 1495675; ANNOT 1452666; ANNOT 1452666; ANNOT 1469576; ANNOT 1469576; ANNOT 1442757; ANNOT 1442757; ANNOT 1452668; ANNOT 1452668; ANNOT 1478584; ANNOT 1478584; ANNOT 1455564; ANNOT 1455564; ANNOT 1508764; ANNOT 1508764; ANNOT 1477651; ANNOT 1477651; ANNOT 1487130; CDNA 36512904; ANNOT 1471370; ANNOT 1471370; ANNOT 1444471; ANNOT 1491278; ANNOT 1491278; ANNOT 1447690; ANNOT 1447690; | 515; 516; 517; 518; 519; 520; 521; 522; 619; 620; 621; 622; 623; 624; 625; 1481; 1482; 1483; 1714; 1715; 1716; 1999; 2000; 2001; 2625; 2626; 2627; 2628; 2629; 3304; 3305; 3306; 3307; 3308; 3309; 3310; 3319; 3320; 3321; 3322; 3323; 3324; 3325; 3326; 3327; 3328; 3329; 3330; 3331; 3332; 3333; 3334; 3335; 3336; 3337; 3481; 3482; 3483; 3484; 3485; 3486; 3487; 3488; 3489; 3490; 3491; 3896; 3897; 3898; 3899; 3900; 3901; 3902; 3903; 3904; |
| CAULINE LEAVES | Stress tolerance | Glossy | The leaves are shiny/glossy in appearance. | Useful for making plants with enhanced abiotic stress tolerance | CLONE 12993; ANNOT 1479464; ANNOT 1479464 | 520; 521; 522; |
| WHOLE PLANT | Stress tolerance | Heat | The plants have enhanced thermotolerance. | Useful for making plants with enhanced tolerance to heat | CLONE 125039; ANNOT 1514426; ANNOT 1514426; | 2504; 2505; 2506; |
| WHOLE PLANT | Stress tolerance | High Sucrose | Plants are tolerant to high sucrose conditions | Useful for making plants with enhanced tolerance to drought | CLONE 19512; ANNOT 1515042; ANNOT 1515042; ANNOT 1492757; CLONE 256433; ANNOT 1529361; ANNOT 1492757; ANNOT 1507347; ANNOT 1475918; ANNOT 1507347; ANNOT 1507347; ANNOT 1454201; ANNOT 1454201; CDNA 2702830; ANNOT 1516968; ANNOT 1516968; ANNOT 1520085; ANNOT 1520085; | 779; 780; 781; 782; 783; 2738; 2739; 2740; 2741; 2742; 2743; 2744; 3492; 3493; 3494; 3495; 3496; |
| WHOLE PLANT | Stress tolerance | Mannitol | The plants are tolerant to mannitol, and possibly drought stress. | Useful for making plants with enhanced tolerance to drought | CLONE 1994; ANNOT 1506401; CLONE 8877; ANNOT 1507340; ANNOT 1507340; ANNOT 1529361; CLONE 10987; ANNOT 1454090; ANNOT 1454090; ANNOT 1475712; CLONE 11830; ANNOT 1472114; ANNOT 1472114; ANNOT 1525524; ANNOT 1525524; ANNOT 1453309; CLONE 26006; ANNOT 1457048; ANNOT 1457048; ANNOT 1510252; ANNOT 1510252; ANNOT 1451281; ANNOT 1451281; ANNOT 1451282; ANNOT 1451282; ANNOT 1504349; ANNOT 1465987; ANNOT 1465987; ANNOT 1451283; CLONE 29675; ANNOT 1461449; ANNOT 1461449; ANNOT 1440240; ANNOT 1440240; ANNOT 1519418; ANNOT 1519418; ANNOT 1448924; CLONE | 81; 82; 83; 383; 384; 385; 386; 387; 440; 441; 442; 443; 444; 463; 464; 465; 466; 467; 468; 469; 995; 996; 997; 998; 999; 1000; 1001; 1002; 1003; 1004; 1005; 1006; 1007; 1008; 1009; 1151; 1152; 1153; 1154; 1155; 1518; 1519; 1520; 1521; 1522; |

TABLE 1-continued

| Tissue | Phenotype Category | Phenotype | Phenotype Description | Applications | Ceres ID | SEQ ID NO |
|---|---|---|---|---|---|---|
| | | | | | 36681; ANNOT 1527156; ANNOT 1512959; ANNOT 1463128; ANNOT 1468540; ANNOT 1440644; ANNOT 1440644; ANNOT 1493523; CLONE 99920; ANNOT 1446695; ANNOT 1446695; ANNOT 1481700; ANNOT 1467221; ANNOT 1442171; ANNOT 23510894; ANNOT 1467221; ANNOT 1459840; CDNA 23519977; ANNOT 1459840; CDNA 23555942; ANNOT 1473401; ANNOT 1473401; | 1523; 1524; 1525; 1526; 1527; 1528; 1529; 1530; 1531; 1532; 1533; 1534; 1535; 2168; 2169; 2170; 2171; 2172; 3712; 3713; 3714; 3715; 3716; 3753; 3754; 3755; 3829; 3830; 3831; |
| WHOLE PLANT | Stress tolerance | PEG | The plants are tolerant to PEG/drought stress. | Useful for making plants with increased tolerance to drought | CLONE 10044; ANNOT 1510467; ANNOT 1457266; ANNOT 1457267; ANNOT 1457267; CLONE 10987; ANNOT 1454090; ANNOT 1454090; ANNOT 1475712; ANNOT 1475712; ANNOT 11830; ANNOT 1472114; ANNOT 1525524; ANNOT 1525524; ANNOT 1453309; ANNOT 1453309; CLONE 26006; ANNOT 1457048; ANNOT 1457048; ANNOT 1510252; ANNOT 1510252; ANNOT 1451281; ANNOT 1451281; ANNOT 1451282; ANNOT 1451282; ANNOT 1504349; ANNOT 1504349; ANNOT 1465987; ANNOT 1465987; ANNOT 1451283; ANNOT 1451283; CLONE 35220; ANNOT 1444404; ANNOT 1444404; ANNOT 1471304; ANNOT 1471304; ANNOT 1497357; ANNOT 1497357; CLONE 256804; ANNOT 1461811; ANNOT 1461811; ANNOT 1439959; ANNOT 1439959; ANNOT 1535293; ANNOT 1535293; ANNOT 1481806; ANNOT 1481806; ANNOT 1503112; ANNOT 1503112; ANNOT 1516877; ANNOT 1516877; ANNOT 1506920; ANNOT 1506920; ANNOT 1453775; ANNOT 1453775; ANNOT 1478539; ANNOT 1478539; ANNOT 1515247; ANNOT 1515247; ANNOT 1536456; ANNOT 1536456; ANNOT 1451195; ANNOT 1451195; ANNOT 1482990; ANNOT 1482990; ANNOT 1461956; ANNOT 1461956; ANNOT 1451956; CLONE 280039; ANNOT 1494544; ANNOT 1494544; ANNOT 1437855; ANNOT 1437855; ANNOT 1448245; ANNOT 1448245; CLONE 299144; ANNOT 1443651; ANNOT 1443651; CLONE 543549; ANNOT 1529916; ANNOT 1529916; ANNOT 1440973; ANNOT 1440973; ANNOT 1520978; ANNOT 1520978; ANNOT 1472957; ANNOT 1472957; ANNOT 1476456; ANNOT 1476456; CDNA 23510894; ANNOT 1467221; ANNOT 1467221; ANNOT 1442171; ANNOT 1442171; ANNOT 1459840; ANNOT 1459840; CDNA 23555942; ANNOT 1473401; ANNOT 1473401; | 412; 413; 414; 415; 416; 417; 418; 440; 441; 442; 443; 444; 463; 464; 465; 466; 467; 468; 469; 995; 996; 997; 998; 999; 1000; 1001; 1002; 1003; 1004; 1005; 1006; 1007; 1008; 1009; 1448; 1449; 1450; 1451; 1452; 1453; 1454; 2745; 2746; 2747; 2748; 2749; 2750; 2751; 2752; 2753; 2754; 2755; 2756; 2757; 2758; 2759; 2760; 2761; 2762; 2763; 2764; 2765; 2766; 2767; 2768; 2769; 2770; 2771; 2772; 2773; 2826; 2827; 2828; 2829; 2830; 2831; 2832; 2874; 2875; 2876; 3178; 3179; 3180; 3181; 3182; 3183; 3184; 3185; 3186; 3187; 3188; 3712; 3713; 3714; 3715; 3716; 3753; 3754; 3755; 3829; 3830; 3831; |
| WHOLE PLANT | Stress tolerance | Soil Drought | The plants have increased tolerance to soil drought | Useful for making plants with increased tolerance to drought | CLONE 8381; ANNOT 1462544; ANNOT 1462544; CLONE 26006; ANNOT 1457048; ANNOT 1457048; ANNOT 1510252; ANNOT 1510252; ANNOT 1451281; ANNOT 1451281; ANNOT 1451282; ANNOT 1451282; ANNOT 1504349; ANNOT 1504349; ANNOT 1465987; ANNOT 1465987; ANNOT 1451283; ANNOT 1451283; ANNOT 1446695; ANNOT 1481700; ANNOT 1481700; CLONE 99920; ANNOT 1446695; ANNOT 1481700; | 369; 370; 371; 995; 996; 997; 998; 999; 1000; 1001; 1002; 1003; 1004; 1005; 1006; 1007; 1008; 1009; 2168; 2169; 2170; 2171; 2172; |
| WHOLE PLANT | Stress tolerance, Phosphate use | pH (high) | The plants are tolerant to high pH, and low phosphate conditions. | Useful for making plants tolerant to high pH or low phosphate | CLONE 11830; ANNOT 1472114; ANNOT 1472114; ANNOT 1525524; ANNOT 1525524; ANNOT 1453309; ANNOT 1453309; CLONE 17250; ANNOT 1450185; ANNOT 1450185; CLONE 26006; ANNOT 1457048; ANNOT 1457048; ANNOT 1510252; ANNOT 1510252; ANNOT 1451281; ANNOT 1451281; ANNOT 1451282; ANNOT 1451282; ANNOT 1504349; ANNOT 1504349; ANNOT 1465987; ANNOT 1465987; ANNOT 1451283; ANNOT 1451283; CLONE 34035; ANNOT 1525523; ANNOT 1525523; ANNOT 1525524; ANNOT 1472113; ANNOT 1472113; CLONE 38286; ANNOT 1459467; ANNOT 1459467; ANNOT 1516688; ANNOT 1516688; ANNOT 1488767; ANNOT 1488767; ANNOT 1463396; ANNOT 1463396; ANNOT 1495750; ANNOT 1495750; ANNOT 1452612; ANNOT 1452612; ANNOT 1442831; ANNOT 1442831; CLONE 39890; ANNOT 1511886; ANNOT 1511886; ANNOT 1517635; ANNOT 1517635; ANNOT | 463; 464; 465; 466; 467; 468; 469; 670; 671; 672; 995; 996; 997; 998; 999; 1000; 1001; 1002; 1003; 1004; 1005; 1006; 1007; 1008; 1009; 1328; 1329; 1330; 1331; 1332; 1717; 1718; 1719; 1720; 1721; 1722; 1723; 1724; 1725; 1726; 1727; 1728; 1729; 1730; 1731; 1882; 1883; |

TABLE 1-continued

| Tissue | Phenotype Category | Phenotype | Phenotype Description | Applications | Ceres ID | SEQ ID NO |
|---|---|---|---|---|---|---|
| | | | | | 1517635; CLONE 40781; ANNOT 1440480; ANNOT 1440480; CLONE 116356; ANNOT 1467190; CLONE 126592; ANNOT 1474017; ANNOT 1474017; ANNOT 1468796; ANNOT 1468796; | 1884; 1885; 1886; 1936; 1937; 1938; 2401; 2402; 2403; 2512; 2513; 2514; 2515; 2516; |
| INFLORESCENCE | Vigor | Strong | The primary inflorescence appears significantly stronger, whether by thickness or rigidity | Useful for making stronger plants | CLONE 314; ANNOT 1543129; ANNOT 1543129; CLONE 4067; ANNOT 1514362; ANNOT 1514362; ANNOT 1494090; ANNOT 1494090; CLONE 5597; ANNOT 1507708; ANNOT 1507708; ANNOT 1475094; ANNOT 1475094; CLONE 8265; ANNOT 1438919; ANNOT 1438919; ANNOT 1499398; ANNOT 1499398; ANNOT 1446419; ANNOT 1446419; CLONE 8458; ANNOT 1454042; ANNOT 1454042; CLONE 10879; ANNOT 1467184; ANNOT 1467184; CLONE 12993; ANNOT 1479464; ANNOT 1479464; CLONE 17356; ANNOT 1478584; ANNOT 1478584; ANNOT 1487130; CLONE 19116; ANNOT 1467522; ANNOT 1467522; ANNOT 1526421; ANNOT 1526421; CLONE 23322; ANNOT 1512337; ANNOT 1512337; ANNOT 1517094; ANNOT 1517094; CLONE 25886; ANNOT 1446650; ANNOT 1446650; ANNOT 1439514; ANNOT 1439514; ANNOT 1477202; ANNOT 1477202; ANNOT 1455325; ANNOT 1455325; CLONE 37288; ANNOT 1453650; ANNOT 1453650; CLONE 38697; ANNOT 1470862; ANNOT 1470862; ANNOT 1443740; ANNOT 1443740; ANNOT 1461162; ANNOT 1461162; ANNOT 1526959; ANNOT 1526959; ANNOT 1468331; ANNOT 1468331; CLONE 40538; ANNOT 1452757; ANNOT 1452757; ANNOT 1475806; ANNOT 1475806; ANNOT 1475806; ANNOT 1454125; ANNOT 1454125; CLONE 98855; ANNOT 1460836; ANNOT 1460836; ANNOT 1450324; ANNOT 1450324; CLONE 116257; ANNOT 1520806; ANNOT 1520806; ANNOT 1473089; ANNOT 1473089; ANNOT 1500150; ANNOT 1500150; CLONE 118648; ANNOT 1510664; ANNOT 1510664; ANNOT 1457458; ANNOT 1457458; ANNOT 1443693; ANNOT 1443693; ANNOT 1496628; ANNOT 1496628; ANNOT 1451509; ANNOT 1451509; ANNOT 1540402; ANNOT 1540402; ANNOT 1487005; ANNOT 1487005; CLONE 119925; ANNOT 1473490; ANNOT 1473490; ANNOT 1526901; ANNOT 1526901; CLONE 148680; ANNOT 1522509; ANNOT 1522509; CLONE 150912; ANNOT 1533910; ANNOT 1480439; ANNOT 1480439; CLONE 156655; ANNOT 1441740; ANNOT 1441740; CLONE 158702; ANNOT 1501773; ANNOT 1501773; CLONE 566317; ANNOT 1489585; ANNOT 1489585; ANNOT 1467905; ANNOT 1467905; ANNOT 1517371; ANNOT 1517371; ANNOT 1512104; ANNOT 1512104; ANNOT 1458837; ANNOT 1458837; CLONE 627596; ANNOT 1500987; ANNOT 1500987; ANNOT 1490915; ANNOT 1490915; CLONE 1001432; ANNOT 1475043; ANNOT 1475043; ANNOT 1454586; ANNOT 1454586; ANNOT 1507756; ANNOT 1507756; ANNOT 1469708; CLONE 1002819; ANNOT 1474290; ANNOT 1474290; ANNOT 1522314; ANNOT 1522314; ANNOT 1497147; ANNOT 1497147; ANNOT 1471045; ANNOT 1471045; CLONE 1007549; ANNOT 1458198; ANNOT 1458198; ANNOT 1439989; ANNOT 1439989; ANNOT 1464789; ANNOT 1464789; ANNOT 1461728; ANNOT 1461728; ANNOT 1479711; ANNOT 1479711; ANNOT 1440649; ANNOT 1440649; ANNOT 1464547; ANNOT 1464547; ANNOT 1471370; ANNOT 1471370; ANNOT 1454104; CDNA 23505103; CDNA 36512904; ANNOT 1491278; ANNOT 1491278; ANNOT 1444471; ANNOT 1444471; ANNOT 1447690; ANNOT 1447690; ANNOT 1447690; ANNOT . 1491278; ANNOT . 1500987; ANNOT . 1500987; ANNOT . 1491278; ANNOT . 1490915; ANNOT . 1490915; | 9; 10; 11; 196; 197; 198; 199; 200; 233; 234; 235; 236; 237; 362; 363; 364; 365; 366; 367; 368; 372; 373; 374; 437; 438; 439; 520; 521; 522; 673; 674; 675; 676; 677; 735; 736; 737; 738; 739; 897; 898; 899; 900; 901; 986; 987; 988; 989; 990; 991; 992; 993; 994; 1622; 1623; 1624; 1777; 1778; 1779; 1780; 1781; 1782; 1783; 1784; 1785; 1786; 1787; 1915; 1916; 1917; 1976; 1977; 1978; 1979; 1980; 2118; 2119; 2120; 2121; 2122; 2394; 2395; 2396; 2397; 2398; 2399; 2400; 2429; 2430; 2431; 2432; 2433; 2434; 2435; 2436; 2437; 2438; 2439; 2440; 2441; 2442; 2443; 2461; 2462; 2463; 2464; 2465; 2540; 2541; 2542; 2555; 2556; 2557; 2558; 2559; 2580; 2581; 2582; 2616; 2617; 2618; 3241; 3242; 3243; 3244; 3245; 3246; 3247; 3248; 3249; 3250; 3251; 3299; 3300; 3301; 3302; 3303; 3419; 3420; 3421; 3422; 3423; 3424; 3425; 3426; 3427; 3428; 3429; 3430; 3431; 3432; 3433; 3434; 3435; 3436; 3440; 3441; 3442; 3443; 3444; 3445; 3446; 3447; 3448; 3449; 3450; 3451; 3452; 3453; 3454; 3455; 3456; 3687; 3896; 3897; 3898; 3899; 3900; 3901; 3902; 3903; 3904; 3688; 3689; 3690; 3691; 3692; 3693; 3694; 3695; |

TABLE 1-continued

| Tissue | Phenotype Category | Phenotype | Phenotype Description | Applications | Ceres ID | SEQ ID NO |
|---|---|---|---|---|---|---|
| INFLORESCENCE | Vigor | Weak | The primary inflorescence appears significantly weaker, whether by thickness or rigidity. | Useful for making stronger plants | CLONE 5055; ANNOT 1438157; ANNOT 1500936; ANNOT 1500936; CLONE 8254; ANNOT 1543042; ANNOT 1489655; | 215; 216; 217; 218; 219; 357; 358; 359; 360; 361; |
| | | | | | ANNOT 1489655; CLONE 10879; ANNOT 1467184; CLONE 1489655; | 437; 438; 439; 507; 508; |
| | | | | | 12071; ANNOT 1466704; ANNOT 1466704; CLONE 13625; ANNOT 1455211; | 509; 544; 545; 546; 917; |
| | | | | | ANNOT 1455211; CLONE 23556; ANNOT 1519418; ANNOT 1448924; | 918; 919; 920; 921; 922; |
| | | | | | 1448924; ANNOT 1448924; ANNOT 1482978; ANNOT 1448490; | 923; 924; 925; 926; 927; |
| | | | | | ANNOT 1448490; ANNOT 1477878; ANNOT 1477878; CLONE 26907; ANNOT | 1043; 1044; 1045; 1046; |
| | | | | | 1484074; ANNOT 1484074; ANNOT 1440016; ANNOT 1518242; | 1047; 1048; 1049; 1255; |
| | | | | | ANNOT 1518242; CLONE 32791; ANNOT 1540248; ANNOT 1540248; CLONE | 1256; 1257; 1476; 1477; |
| | | | | | 35733; ANNOT 1486258; ANNOT 1486258; ANNOT 1443988; ANNOT 1443988; | 1478; 1479; 1480; 1732; |
| | | | | | CLONE 38370; ANNOT 1471869; ANNOT 1471869; ANNOT 1448032; ANNOT | 1733; 1734; 1735; 1736; |
| | | | | | 1448032; ANNOT 1448031; ANNOT 1448031; ANNOT 1438060; ANNOT 1438060; | 1737; 1738; 1739; 1740; |
| | | | | | ANNOT 1438061; ANNOT 1438061; ANNOT 1448030; ANNOT 1448030; ANNOT | 1741; 1742; 1743; 1744; |
| | | | | | 1437831; CLONE 40436; ANNOT 1441645; ANNOT 1441645; | 1745; 1746; 1904; 1905; |
| | | | | | CLONE 40729; ANNOT 1481678; ANNOT 1481678; CLONE 92670; ANNOT | 1906; 1930; 1931; 1932; |
| | | | | | 1531919; ANNOT 1531919; CLONE 95453; ANNOT 1460836; ANNOT 1460836; | 2061; 2062; 2063; 2085; |
| | | | | | ANNOT 1459723; ANNOT 1450324; ANNOT 1450324; CLONE 95677; ANNOT 1459723; ANNOT | 2086; 2087; 2088; 2089; |
| | | | | | 1459723; ANNOT 1516455; ANNOT 1516455; CLONE 100465; ANNOT 1466439; | 2090; 2091; 2092; 2093; |
| | | | | | ANNOT 1466439; ANNOT 1466439; ANNOT 1448977; ANNOT 1519767; ANNOT | 2094; 2196; 2197; 2198; |
| | | | | | 1519767; ANNOT 1501982; ANNOT 1501982; CLONE 147358; ANNOT 1493111; ANNOT 1493111; ANNOT 1461452; ANNOT 1461452; CLONE 149380; ANNOT 1461440; ANNOT 1461440; ANNOT 1461430; ANNOT 1461430; ANNOT 1461427; ANNOT 1461427; ANNOT 1440253; ANNOT 1440253; CLONE 267657; ANNOT 1471473; ANNOT 1471473; ANNOT 1444931; ANNOT 1444931; CLONE 480332; ANNOT 1511016; ANNOT 1511016; ANNOT 1518556; ANNOT 1518556; ANNOT 1457793; ANNOT 1457793; ANNOT 1465233; ANNOT 1465233; CLONE 563522; ANNOT 1460321; ANNOT 1460321; ANNOT 1508144; ANNOT 1508144; ANNOT 1541886; ANNOT 1541886; ANNOT 1475178; ANNOT 1475178; CDNA 23505182; ANNOT 1525474; ANNOT 1525474; CDNA 2350747; ANNOT 1510416; ANNOT 1510416; ANNOT 1541253; ANNOT 1541253; CDNA 36554381; ANNOT 1523115; ANNOT 1523115; ANNOT 1479243; ANNOT 1479243; | 2199; 2200; 2201; 2202; 2203; 2204; 2528; 2529; 2530; 2531; 2532; 2546; 2547; 2548; 2549; 2550; 2551; 2552; 2553; 2554; 2801; 2802; 2803; 2804; 2805; 3034; 3035; 3036; 3037; 3038; 3039; 3040; 3041; 3042; 3227; 3228; 3229; 3230; 3231; 3232; 3233; 3234; 3235; 3696; 3697; 3698; 3704; 3705; 3706; 3707; 3708; 4000; 4001; 4002; 4003; 4004; |

From the disclosure of Table 1 and the Sequence Listing, it can be seen that the nucleotides and polypeptides of the inventions are useful, depending upon the respective individual sequence, to make plants with one or more altered characteristics in traits such as appearance, architecture, biomass, composition, confinement, development, nitrogen use, nutrient uptake, phosphate use, photosynthetic capacity, shade avoidance, stress tolerance, vigor, flowering time and yield.

Nucleotides and polypeptides that are useful for modulating plant characteristics in traits such as appearance include those that have been given the designation Appearance in the Category column of Table 1. Nucleotides and polypeptides that have been given the Appearance designation include those that are able to confer one or more of the following phenotypes, relative to wild-type control, when mis-expressed in plants: altered leaf shape; altered leaf structure; altered leaf color; increased or decreased leaf size; altered flower shape; altered flower structure; increased or decreased flower size. Altering plant appearance through genetic technologies is valuable for making ornamental plants, increasing plant biomass produced per acre of arable land, increasing crop yield per acre of arable land, and for other agricultural and/or horticultural purposes.

Nucleotides and polypeptides that are useful for modulating plant characteristics in traits such as plant architecture include those that have been given the designation Architecture in the Category column of Table 1. Nucleotides and polypeptides that have been given the Architecture designation include those that are able to confer one or more of the following phenotypes, relative to wild-type control, when mis-expressed in plants: altered branching angle; increased or decreased number of branches; increased or decreased number of leaves per branch; altered leaf angle (relative to the horizontal plane); increased or decreased internode length. Altering plant architecture through genetic technologies is valuable for increasing plant biomass produced per acre of arable land, increasing crop yield per acre of arable land, improving harvesting efficiency, making ornamental plants, and for other agricultural and/or horticultural purposes.

Nucleotides and polypeptides that are useful for modulating plant characteristics in traits such as plant biomass include those that have been given the designation Biomass in the Category column of Table 1. Nucleotides and polypeptides that have been given the Biomass designation include those that are able to confer one or more of the following phenotypes, relative to wild-type control, when mis-expressed in plants: increased or decreased plant size; increased or decreased plant height; increased or decreased leaf size; altered leaf shape; altered leaf structure; increased or decreased number of leaves; increased or decreased organ size; altered organ shape; increased or decreased organ number; increased or decreased branching length; increased or decreased branch number; increased or decreased apical dominance; and increased or decreased hypocotyls length. Altering plant biomass is valuable for increasing plant biomass produced per acre of arable land, increasing crop yield per acre of arable land, utilizing plants as chemical factories to produce valuable pharmaceutical compounds, developing a genetic confinement system designed to reduce or prevent gene flow from transgenic pants to commercial crops and wild-type counterparts, making ornamental plants, and for other agricultural and/or horticultural purposes.

Nucleotides and polypeptides that are useful for modulating plant characteristics in traits such as the composition of a plant, plant material, plant tissue, plant cell and seed from a plant include those that have been given the designation Composition in the Category column of Table 1. Nucleotides and polypeptides that have been given the Composition designation include those that are able to confer one or more of the following phenotypes, relative to wild-type control, when mis-expressed in plants: increased or decreased carbon content; increased or decreased plant nitrogen content; altered color (indicative of change(s) to the chemical composition); altered metabolic profile, increased or decreased starch content, increased or decreased fiber content; increased or decreased amount of a valuable compound (e.g. increased alkaloids and/or terpenoids); increased or decreased number of trichomes; increased or decreased cotyledon size; increased or decreased cotyledon number; altered cotyledon shape; increased or decreased fruit size; increased or decreased fruit length; altered fruit shape; increased or decreased seed size; and altered seed shape; altered seed color (indicative of altered chemical composition); and having activated expression of a gene operably linked to an alkaloid or terpenoid related regulatory region or promoter. Altering characteristics such as the composition of a plant, plant organ, plant tissue and plant cell is valuable for improving the nutritional value of crops, improving the composition of plants to be used as bio-fuels, utilizing plants as chemical factories by increasing the content of valuable pharmaceutical compounds, producing plants with increased tolerance to abiotic or biotic stress, developing a genetic confinement system designed to reduce or prevent gene flow from transgenic pants to commercial crops and wild-type counterparts, making ornamental plants, and for other agricultural and/or horticultural purposes.

Nucleotides and polypeptides that are useful for modulating plant characteristics in traits such as sterility, lethality and viability have been given the designation Confinement in the Category column of Table 1. Nucleotides and polypeptides that have been given the Confinement designation include those that are able to confer one or more of the following phenotypes, relative to wild-type control, when mis-expressed in plants: increased or decreased number of floral organs; alter floral organ type; reduced fertility; sterility, including female-sterility and/or male-sterility; alter how leaves emerge from the meristem; low/no seed germination; and reduced plant viability (e.g. albino plants and plants with vitrified leaves). The ability to modulate sterility, lethality, and/or viability is important in developing a genetic confinement system designed to reduce or prevent gene flow from transgenic pants to commercial crops and wild-type counterparts, making ornamental plants; and for other agricultural and/or horticultural purposes. Nucleotides and polynucleotides useful for developing a genetic confinement system can be utilized by procedures known to those skilled in the art, such as in US2005/0257293 A1, hereby incorporated by reference.

Nucleotides and polypeptides that are useful for modulating plant characteristics in traits such as plant development include those that have been given the designation Development in the Category column of Table 1. Nucleotides and polypeptides that have been given the Development designation include those that are able to confer one or more of the following phenotypes, relative to wild-type control, when mis-expressed in plants: increased or decreased time to bolting; increased or decreased time to harvesting; increased or decreased time to senesces; and increased or decreased time to flowering. Altering plant development through genetic technologies is valuable for increasing yearly plant biomass production per year per acre of arable land; increasing yearly crop yield per acre of arable land, developing a genetic confinement system designed to reduce or prevent gene flow from transgenic pants to commercial crops and wild-type counterparts, making ornamental plants, and for other agricultural and/or horticultural purposes.

Nucleotides and polypeptides that are useful for modulating plant characteristics in traits such as phosphate use include those that have been given the designation Phosphate use in the Category column of Table 1. Nucleotides and polypeptides that have been given the Phosphate use designation include those that are able to confer one or more of the following phenotypes, relative to wild-type control, when mis-expressed in plants: increased or decreased tolerance to low phosphate conditions; increased or decreased tolerance to no phosphate conditions, and increased or decreased tolerance to high pH conditions. Altering characteristics such as phosphate use through genetic technologies is valuable for producing crop plants with increased tolerance to phosphate limiting conditions, using traditionally un-arable land to grow crop plants with increased tolerance to phosphate limiting conditions, developing a genetic confinement system designed to reduce or prevent gene flow from transgenic pants to commercial crops and wild-type counterparts, and for other agricultural and/or horticultural purposes.

Nucleotides and polypeptides that are useful for modulating plant characteristics in traits such as shade avoidance and shade tolerance include those that have been given the designation Shade in the Category column of Table 1. Nucleotides and polypeptides that have been given the Shade designation include those that are able to confer one or more of the following phenotypes, relative to wild-type control, when mis-expressed in plants: increased or decreased vigor in the dark; increased or decreased seedling vigor under low light conditions; increased or decreased plant vigor under low light conditions; increased or decreased leaf length; altered leaf shape; altered leaf structure, and increased or decreased cotyledon length. Altering characteristics such as shade avoidance and shade tolerance through genetic technologies is valuable for producing plants with tolerance to light limiting conditions, increasing plant biomass produced per acre of arable land, increasing crop production per acre of arable land, developing a genetic confinement system designed to reduce or prevent gene flow from transgenic pants to commercial crops and wild-type counterparts, making ornamental plants, and for other agricultural and/or horticultural purposes.

Nucleotides and polypeptides that are useful for modulating plant characteristics in traits such as nitrogen use include those that have been given the designation Nitrogen use in the Category column of Table 1. Nucleotides and polypeptides that have been given the Nitrogen use designation include those that are able to confer one or more of the following phenotypes, relative to wild-type control, when mis-expressed in plants: increased or decreased tolerance to low nitrogen conditions and surrogate low nitrogen conditions (e.g. exposure to an effective amount of MSX); increased or decreased tolerance to no nitrogen conditions; increased tolerance to high nitrogen conditions. Altering nitrogen use through genetic technologies is valuable for producing plants with increased tolerance to high or low nitrogen conditions, decreasing the amount of fertilizers used in crop production, using traditionally un-arable land to grow crop plants with increased tolerance to high or low nitrogen conditions, developing a genetic confinement system designed to reduce or prevent gene flow from transgenic pants to commercial crops and wild-type counterparts, and for other agricultural and/or horticultural purposes.

Nucleotides and polypeptides that are useful for modulating plant characteristics in traits such as nutrient uptake include those that have been given the designation Nutrient uptake in the Category column of Table 1. Nucleotides and polypeptides that have been given the Nutrient uptake designation include those that are able to confer one or more of the following phenotypes, relative to wild-type control, when mis-expressed in plants: increased or decreased lateral root length under high nitrogen conditions; increased or decreased lateral root length under low nitrogen conditions; increased or decreased lateral root length; increased or decreased number of lateral roots; increased or decreased root hair length; increased or decreased number of root hairs; increased or decreased primary root length(s); increased or decreased thickness of primary root(s); increased or decreased number of primary roots; altered root architecture; altered root growth pattern; and increased or decreased root mass. Altering nutrient uptake through genetic technologies is valuable for producing plants which are more efficient in gathering nutrients from the environment, using traditionally un-arable land to grow crop plants which are more efficient in gathering nutrients from the environment, decreasing the amount of fertilizers used for crop production, increasing plant biomass production per acre or arable land, increasing crop yield per acre of arable land, developing a genetic confinement system designed to reduce or prevent gene flow from transgenic pants to commercial crops and wild-type counterparts, making ornamental plants, and for other agricultural and/or horticultural purposes.

Nucleotides and polypeptides that are useful for modulating plant characteristics in traits such as photosynthetic capacity include those that have been given the designation Photosynthetic capacity in the Category column of Table 1. Nucleotides and polypeptides that have been given the Photosynthetic capacity designation include those that are able to confer one or more of the following phenotypes, relative to wild-type control, when mis-expressed in plants: darker green or lighter green plants (indicative of a higher or lower chlorophyll content respectively); and increased or decreased chlorophyll content. Altering photosynthetic capacity through genetic technologies is valuable for increasing plant biomass produced per acre of arable land, increasing crop yield per acre of arable land, developing a genetic confinement system designed to reduce or prevent gene flow from transgenic pants to commercial crops and wild-type counterparts, and for other agricultural and/or horticultural purposes.

Nucleotides and polypeptides that are useful for modulating plant characteristics in traits such as abiotic stress tolerance include those that have been given the designation Stress tolerance in the Category column of Table 1. Nucleotides and polypeptides that have been given the Stress tolerance designation include those that are able to confer one or more of the following phenotypes, relative to wild-type control, when mis-expressed in plants: increased or decreased tolerance to drought and/or surrogate drought conditions (e.g. exposure to effective amounts of ABA, PEG, mannitol or sucrose); increased or decreased tolerance to low temperature conditions; increased or decreased tolerance to high temperature conditions; increased or decreased salt tolerance; increased or decreased tolerance to oxidative stressors and/or surrogate oxidative stressors (e.g. exposure to an effective amount of arginine or salicylic acid); and having leaves with shiny or dull appearance (indicative of altered wax composition and/or content). Altering abiotic stress tolerance through genetic technologies is valuable for farmers seeking to minimize economic losses due to drought, cold, heat, flooding and oxidative stressors; producing crop plants with increased tolerance to abiotic stressors; using traditionally un-arable land to grow crop plants with increased tolerance to abiotic stressors; developing a genetic confinement system designed to reduce or prevent gene flow from transgenic pants to commercial crops and wild-type counterparts; making ornamental plants; and for other agricultural and/or horticultural purposes.

Nucleotides and polypeptides that are useful for modulating plant characteristics in traits such as vigor include those that have been given the designation Vigor in the Category column of Table 1. Nucleotides and polypeptides that have been given the Vigor designation include those that are able to confer one or more of the following phenotypes, relative to wild-type control, when mis-expressed in plants: increased or decreased thickness of the primary inflorescence; and increased or decreased rigidity of the primary inflorescence. Altering vigor through genetic technologies is valuable for using traditionally un-arable land to grow crop plants which are more tolerant to biotic and/or abiotic stressors; developing a genetic confinement system designed to reduce or prevent gene flow from transgenic pants to commercial crops and wild-type counterparts, and for other agricultural and/or horticultural purposes.

Nucleotides and polypeptides that are useful for modulating plant characteristics in traits such as yield include those that have been given the designation Yield in the Category column of Table 1. Nucleotides and polypeptides that have been given the Yield designation include those that are able to confer one or more of the following phenotypes, relative to wild-type control, when mis-expressed in plants: increased or decreased fruit size; increased or decreased fruit length; increased or decreased fruit number; altered fruit shape; increased or decreased seed size; and alter seed shape. The ability to maximize plant yield through genetic technologies is valuable for increasing crop yield per acre of arable land; increasing plant biomass production per acre of arable land, using plants as chemical factories by increasing the content of valuable pharmaceutical compounds (e.g. increased alkaloids and/or terpenoids), developing a genetic confinement system designed to reduce or prevent gene flow from transgenic pants to commercial crops and wild-type counterparts, making ornamental plants and for other agricultural and/or horticultural purposes.

The phenotypes disclosed in Table 1 can be modulated by controlling the expression of nucleic acid sequences and polypeptide sequences that confer phenotype(s) when mis-expressed in plants. Modulation of a phenotype can also be achieved by inhibiting the expression of nucleic acid sequences and polypeptide sequences that confer phenotype(s) when mis-expressed in plants. A phenotype resulting from the expression of a nucleic acid sequence and/or polypeptide sequence can be modulated (e.g. increase or decrease of an observable/measurable phenotypic change in relation to wild-type control) using recombinant-DNA methods, as discussed in previous paragraphs.

According to another aspect, the nucleotide sequences of the invention encode polypeptides that can be utilized as herbicide targets, those useful in the screening of new herbicide compounds. Thus, the proteins encoded by the nucleotide sequences provide the bases for assays designed to easily and rapidly identify novel herbicides.

According to yet another aspect, the present invention provides a method of identifying a herbicidal compound, comprising: (a) combining a polypeptide comprising an amino acid sequence at least 85% identical to an amino acid sequence selected from the group consisting of the polypeptides described in the sequence listing with a compound to be tested for the ability to inhibit the activity of said polypeptide, under conditions conducive to inhibition; (b) selecting a compound identified in (a) that inhibits the activity of said polypeptide; (c) applying a compound selected in (b) to a plant to test for herbicidal activity; (d) selecting a compound identified in (c) that has herbicidal activity. The polypeptide can alternatively comprise an amino acid sequence at least 90%, or at least 95%, or at least 99% identical to an amino acid sequence selected from the group consisting of the polypeptides in the sequence listing. The present invention also provides a method for killing or inhibiting the growth or viability of a plant, comprising applying to the plant a herbicidal compound identified according to this method.

The Sequence Listing sets forth the polypeptide and polynucleotide sequences of the invention, including functional homologs/orthologs of specific query sequences.

The Sequence Listing indicates which of the functional homologs/orthologs are associated with each query sequence. The sequence listing also presents other information for each of the functional homologs, such as the % identity of the homolog relative to the query/Lead sequence, the corresponding E-value, the plant species for the homolog, the Sequence ID No. in the Sequence Listing.

The present invention further encompasses nucleotides that encode the above described polypeptides, as well as the complements thereof, and including alternatives thereof based upon the degeneracy of the genetic code.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

REFERENCES (1) Zhang et al. (2004) *Plant Physiol.* 135:615.
(2) Salomon et al. (1984) *EMBO J.* 3:141.
(3) Herrera-Estrella et al. (1983) *EMBO J.* 2:987.
(4) Escudero et al. (1996) *Plant J* 10:355.
(5) Ishida et al. (1996) *Nature Biotechnology* 14:745.
(6) May et al. (1995) *Bio/Technology* 13:486)
(7) Armaleo et al. (1990) *Current Genetics* 17:97.
(8) Smith. T. F. and Waterman, M. S. (1981)*Adv. App. Math.* 2:482.
(9) Needleman and Wunsch (1970) *J. Mol. Biol.* 48:443.
(10) Pearson and Lipman (1988) *Proc. Natl. Acad. Sci.* (*USA*) 85: 2444.
(11) Yamauchi et al. (1996) *Plant Mol. Biol.* 30:321-9.
(12) Xu et al. (1995) *Plant Mol. Biol.* 27:237.
(13) Yamamoto et al. (1991) *Plant Cell* 3:371.
(14) P. Tijessen, Hybridization with Nucleic Acid Probes In Laboratory Techniques in Biochemistry and Molecular Biology, P. C. vand der Vliet, ed., c. 1993 by Elsevier, Amsterdam.
(15) Bonner et al., (1973) *J. Mol. Biol.* 81:123.
(16) Sambrook et al., Molecular Cloning: A Laboratory Manual, Second Edition, Cold Spring Harbor Laboratory Press, 1989, New York.
(17) Shizuya et al. (1992) *Proc. Natl. Acad. Sci. USA*, 89: 8794-8797.
(18) Hamilton et al. (1996) *Proc. Natl. Acad. Sci. USA*, 93: 9975-9979.
(19) Burke et al. (1987) *Science,* 236:806-812.
(20) Sternberg N. et al. (1990) *Proc Natl Acad Sci USA.,* 87:103-7.
(21) Bradshaw et al. (1995) *Nucl Acids Res*, 23: 4850-4856.
(22) Frischauf et al. (1983) *J. Mol Biol,* 170: 827-842.

(23) Huynh et al., Glover N M (ed) DNA Cloning: A practical Approach, Vol. 1 Oxford: IRL Press (1985).
(24) Walden et al. (1990) *Mol Cell Biol* 1: 175-194.
(25) Vissenberg et al. (2005) *Plant Cell Physiol* 46:192.
(26) Husebye et al. (2002) *Plant Physiol* 128:1180.
(27) Plesch et al. (2001) *Plant J* 28:455.
(28) Weising et al. (1988) *Ann. Rev. Genet.,* 22:421.
(29) Christou (1995) *Euphytica*, v. 85, n. 1-3:13-27.
(30) Newell (2000)
(31) Griesbach (1987) *Plant Sci.* 50:69-77.
(32) Fromm et al. (1985) *Proc. Natl. Acad. Sci. USA* 82:5824.
(33) Paszkowski et al. (1984) *EMBO J.* 3:2717.
(34) Klein et al. (1987) *Nature* 327:773.
(35) Willmitzer, L. (1993) Transgenic Plants. In: iotechnology, A Multi-Volume Comprehensive treatise (H. J. Rehm, G. Reed, A. Püler, P. Stadler, eds., Vol. 2, 627-659, VCH Weinheim-New York-Basel-Cambridge).
(36) *Crit. Rev. Plant. Sci.* 4:146.
(37) Fromm et al. (1990) *Biotechnology* 8:833-844.
(38) Cho et al. (2000) *Planta* 210:195-204.
(39) Brootghaerts et al. (2005) *Nature* 433:629-633.
(40) Lincoln et al. (1998) *Plant Mol. Biol. Rep.* 16:1-4.
(41) Lacomme et al. (2001), Genetically Engineered Viruses (C. J. A. Ring and E. D. Blair, Eds). Pp. 59-99, BIOS Scientific Publishers, Ltd. Oxford, UK.

SEQUENCE LISTING (4192 sequences)

SEQ ID NO: 1 - protein, 144 aa, Arabidopsis thaliana
  misc_feature (1)..(144): Ceres CLONE ID no. 45
  misc_feature (1)..(144): Also Known As Ceres CDNA ID no. 23389169
  misc_feature (1)..(144): Also Known As Ceres GEMINI ID 533E11
  misc_feature (85)..(125): Pfam Name: zf-AN1 Pfam Description: AN1-like Zinc finger
  misc_feature 54:<222: Transcription Factor
  misc_feature: Phenotype: Activates expression of the gene endogenous to the AtATTPS3 (SEQ ID NO 4165) regalutory region Useful for modulating Terpenoid Biosynthesis
MNLCSKCYRSLRAEEDQTAVAKAAVKNSLKLPSCSIIAPGQKHPLEIKPAHLETVVVTAEPSSVPVAAEQDEAEPSRPVRPNNRCFSCNKKVGVMGFKCKCGSTFCGSHRYPEKHECSFDFKEVGRDAIAKANPLVKADKVQRI

SEQ ID NO: 2 - DNA, 525 bp, Populus balsamifera subsp. trichocarpa
  misc_feature (1)..(525): Ceres ANNOT ID no. 1447323
  misc_feature 109:<222: Transcription Factor
  misc_feature: Phenotype: Activates expression of the gene endogenous to the AtATTPS3 (SEQ ID NO 4165) regalutory region Useful for modulating Terpenoid Biosynthesis
atgggttctgagcaaaacgatggcacaagcttcccaccagcagagccaaagctttgtgttaatgggtgtggattttttggtacggctgcaaacatgaacctttgctccaagtgttaccgtgaccttcgtgccgaagaagagcaagctgcctctgccaaggctgccatggaaaagacactgaatatcaatccaaaacaaaatattgattctaaggttgttgtcgatgcccctcaagttgtggtggctaattccgtgcagtcagttgtgtctgctgaagcttcttcgtcagcagaaactgttgttgctggtggtgatcaggtgccatcaaagccggcaaataggtgctttagctgcagtaagaaggttggtttgacaggattccagtgcaagtgcggtggcacttactgcgggactcataggtacgcagagaatcacgagtgcctctttgatttcaaaggtgctggccgtgatgcaatcgcgaaggcaaatcctgtgattaaggctaataaggtggagaggttctga

SEQ ID NO: 3 - protein, 174 aa, Populus balsamifera subsp. trichocarpa
  misc_feature (1)..(174): Ceres ANNOT ID no. 1447323
  misc_feature (115)..(155): Pfam Name: zf-AN1 Pfam Description: AN1-like Zinc finger
  misc_feature (16)..(40): Pfam Name: zf-A20 Pfam Description: A20-like zinc finger
  misc_feature: SWISSPROT Homolog: ZF2N3_ARATH Zinc finger A20 and AN1 domains-containing protein At4g12040 with e-value of 4.8e-76 and BLAST sequence identity of 100.0
  misc_feature: SWISSPROT Homolog: ZF2N1_ARATH Zinc finger A20 and AN1 domains-containing protein At1g12440 with e-value of 6.9e-36 and BLAST sequence identity of 57.2
  misc_feature: SWISSPROT Homolog: ZF2N2_ARATH Zinc finger A20 and AN1 domains-containing protein At2g36320 with e-value of 4.6e-30 and BLAST sequence identity of 51.4
  misc_feature: SWISSPROT Homolog: Z20D2_MOUSE Zinc finger A20 domain-containing protein 2 (Zinc finger protein 216) with e-value of 2.3e-21 and BLAST sequence identity of 48.4
  misc_feature: SWISSPROT Homolog: Z20D2_HUMAN Zinc finger A20 domain-containing protein 2 (Zinc finger protein 216) with e-value of 2.9e-21 and BLAST sequence identity of 48.4
  misc_feature 201:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(174): Functional Homolog of  Ceres CLONE ID no. 45 at SEQ ID NO. 1 with e-value of 2.19E-36 and BLAST sequence identity of 58.2
MGSEQNDGTSFPPAEPKLCVNGCGFFGTAANMNLCSKCYRDLRAEEEQAASAKAAMEKTLNINPKQNIDSKVVVDAPQVVVANSVQSVVSAEASSSAETVVAGGDQVPSKPANRCFSCSKKVGLTGFQCKCGGTYCGTHRYAENHECLFDFKGAGRDAIAKANPVIKANKVERF

SEQ ID NO: 4 - DNA, 516 bp, Populus balsamifera subsp. trichocarpa
  misc_feature (1)..(516): Ceres ANNOT ID no. 1491680
  misc_feature 267:<222: Transcription Factor
  misc_feature: Phenotype: Activates expression of the gene endogenous to the AtATTPS3 (SEQ ID NO 4165) regalutory region Useful for modulating Terpenoid Biosynthesis
atgggttctgagcaaaacgaaggtacaagctttccatcgtcacagccacagctttgtgctaatggatgtggtttttttggcacggctgcaaacatgaacctttgctccaagtgttaccgtgaccttcgtgctgaagaagagcaagctgcctttgctaaggctgctatggaaaagacgctaaacatgaagtcacaacaacatattgactctagggttgctgttgatgcccctcaagttgcggtggctaattccatgcaatccgctgaagcctcttcttcggcagaaactgctgttgctgctggcgatcaggtgtcatcgaagccggcaaataggtgcttcagctgcaataagaaggttggcttgacaggattcatgtgcaaatgcggtggcacatactgtgggactcataggtactctgagaatcacgagtgctccttcgatttcaagggtgctggccgtaatgctattgccaaggcgaatcctgtgattaaggctgataaggtggggaggttctga

SEQ ID NO: 5 - protein, 140 aa, Populus balsamifera subsp. trichocarpa
  misc_feature (1)..(140): Ceres ANNOT ID no. 1491680
  misc_feature (81)..(121): Pfam Name: zf-AN1 Pfam Description: AN1-like Zinc finger
  misc_feature: SWISSPROT Homolog: ZF2N3_ARATH Zinc finger A20 and AN1 domains-containing protein At4g12040 with e-value of 4.8e-76 and BLAST sequence identity of 100.0
  misc_feature: SWISSPROT Homolog: ZF2N1_ARATH Zinc finger A20 and AN1 domains-containing protein At1g12440 with e-value of 6.9e-36 and BLAST sequence identity of 57.2
  misc_feature: SWISSPROT Homolog: ZF2N2_ARATH Zinc finger A20 and AN1 domains-containing protein At2g36320 with e-value of 4.6e-30 and BLAST sequence identity of 51.4
  misc_feature: SWISSPROT Homolog: Z20D2_MOUSE Zinc finger A20 domain-containing protein 2 (Zinc finger protein 216) with e-value of 2.3e-21 and BLAST sequence identity of 48.4
  misc_feature: SWISSPROT Homolog: Z20D2_HUMAN Zinc finger A20 domain-containing protein 2 (Zinc finger protein 216) with e-value of 2.9e-21 and BLAST sequence identity of 48.4
  misc_feature 353:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(140): Functional Homolog of  Ceres CLONE ID no. 45 at SEQ ID NO. 1 with e-value of 3.29E-35 and BLAST sequence identity of 55.3
MNLCSKCYRDLRAEEEQAAFAKAAMEKTLNMKSQQHIDSRVAVDAPQVAVANSMQSAEASSSAETAVAAGDQVSSKPANRCFSCNKKVGLTGFMCKCGGTYCGTHRYSENHECSFDFKGAGRNAIAKANPVIKADKVGRF

SEQ ID NO: 6 - protein, 281 aa, Arabidopsis thaliana
  misc_feature (1)..(281): Ceres CLONE ID no. 75
  misc_feature: Phenotype: WHOLE PLANT - Early Senescence Useful for modulating crop development and harvest
  misc_feature: Phenotype: FLOWER - Reduced fertility Useful for sterility, genetic confinement systems
MEFVVEEGKLVNEDCSTLVLPALSIGNVGQLAVDLLVSSTGAERVGYLDDPNLLPCVGNDAYGPLPCGEIALPLEVYESSSIATTLAQQRSPVAKGMMIKFAENIANFAASSGKKHVIVLSSLDFQRLHNLDMSRGPQVYYLSNAESDGRDDHCERLGFGRLHEYDSEGRCWKYLSSVFEKNSVEELALPSEDELEDIDYYPSLPFAALFSAFKARGLKMTCLLCYCSEGDNIPEAFLLAEASSKLMGLTPDKFHGEEGGKWQIPYSWKSMYGAPPDMSMF

SEQ ID NO: 7 - DNA, 963 bp, Populus balsamifera subsp. trichocarpa
  misc_feature (1)..(963): Ceres ANNOT ID no. 1503293
  misc_feature 496:<222: Transcription Factor
  misc_feature: Phenotype: WHOLE PLANT - Early Senescence Useful for modulating crop development and harvest
  misc_feature: Phenotype: FLOWER - Reduced fertility Useful for sterility, genetic confinement systems
atggaattcataatcgaagaaggaaaatgccttaacaaggaaacctcaactctgattctgcctgcattatcaataggtaatgttgggcagttagcagttgatttgttagtatcatcaacaagagctgaaagaattgggtatttggatgatccttatatcttgccttgtgttggtaacgatgcttatggtcccactccgtgcggcgagcttgctcttcctcttgaagcttatgattcgaggaataatggggtggcgctcgtgcaacaacgatctccggttgttaaggtagtgggattcttgtcttttcctttctttctaataattatttatgtgaatttggatgtgggattggatgtcgttttgctagtaaagttgatgatatgtagcaaaaaagttgcaaagctggggatgatggtcgaatttgctaggaacctagccgattttgctgttgctactggaatgaatcatgttttggtgctttctagcttagagtttatgagattgcaaaagattgatacatcaagtggcatgcagatattttacctatctagcaccaatactgatggaacagatgattgttgtgaacggctggggtggaaaaaatggcaggaatataatcctgatcaaaggtcttggaaatatcttagctctttagctgaaggaaatgccaggcaggaagacaacctaccatttgaagatgaaccagaagacgaggattactacccaagtttgccttttgctgcccttttttcttgtttcaaggcaaaagggataaaagttacatgtttactgtgttactgctctgaaggggataacacacctgaagcttttagtttggctgaggcaacaagcaaacttttggggctgagtatcgataactcccatggagaaggtggtaaatggctcatcccattttcttggaggactgtgtatggaccacccccagatttgtcaatgttttag

SEQ ID NO: 8 - protein, 320 aa, Populus balsamifera subsp. trichocarpa
  misc_feature (1)..(320): Ceres ANNOT ID no. 1503293
  misc_feature 562:<222: Transcription Factor
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature (1)..(320): Functional Homolog of  Ceres CLONE ID no. 75 at SEQ ID NO. 6 with e-value of 7.20E-95 and BLAST sequence identity of 67.5
MEFIIEEGKCLNKETSTLILPALSIGNVGQLAVDLLVSSTRAERIGYLDDPYILPCVGNDAYGPTPCGELALPLEAYDSRNNGVALVQQRSPVVKVVGFLSFPFFLIIIYVNLDVGLDVVLLVKLMICSKKVAKLGMMVEFARNLADFAVATGMNHVLVLSSLEFMRLQKIDTSSGMQIFYLSSTNTDGTDDCCERLGWKKWQEYNPDQRSWKYLSSLAEGNARQEDNLPFEDEPEDEDYYPSLPFAALFSCFKAKGIKVTCLLCYCSEGDNTPEAFSLAEATSKLLGLSIDNSHGEGGKWLIPFSWRTVYGPPPDLSMF

SEQ ID NO: 9 - protein, 73 aa, Arabidopsis thaliana
  misc_feature (1)..(73): Ceres CLONE ID no. 314
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: WHOLE PLANT - Other Useful for making bigger plants
  misc_feature: Phenotype: INFLORESCENCE - Other Useful for making ornamental plants with modified flowers
MAKPLGTTGEFFRRRDEWRKHPMLSNQMRHALPGLGIGVAAFCVYLVGEQIYNKALAPSKSSHHHQEQTAPSH

SEQ ID NO: 10 - DNA, 207 bp, Populus balsamifera subsp. trichocarpa
  misc_feature (1)..(207): Ceres ANNOT ID no. 1543129
  misc_feature 730:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: WHOLE PLANT - Other Useful for making bigger plants
  misc_feature: Phenotype: INFLORESCENCE - Other Useful for making ornamental plants with modified flowers
atggggaaacctttgggatcaacaggagagttcttcaggagaagagacgaatggaggaagcatcccatgctcaccaaccaattccgccacgccactcctggcctcggcatcgctcttgtagcctttggcgtctatcttgttggagagcaagtctataacaagatttatgctccttcctctgaccactcctcttctcactcccactga

SEQ ID NO: 11 - protein, 68 aa, Populus balsamifera subsp. trichocarpa
  misc_feature (1)..(68): Ceres ANNOT ID no. 1543129
  misc_feature 791:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: WHOLE PLANT - Other Useful for making bigger plants
  misc_feature: Phenotype: INFLORESCENCE - Other Useful for making ornamental plants with modified flowers
  misc_feature (1)..(68): Functional Homolog of  Ceres CLONE ID no. 314 at SEQ ID NO. 9 with e-value of 1.19E-23 and BLAST sequence identity of 78.4
MGKPLGSTGEFFRRRDEWRKHPMLTNQFRHATPGLGIALVAFGVYLVGEQVYNKIYAPSSDHSSSHSH

SEQ ID NO: 12 - protein, 277 aa, Arabidopsis thaliana
  misc_feature (1)..(277): Ceres CLONE ID no. 332
  misc_feature (26)..(89): Pfam Name: AP2 Pfam Description: AP2 domain
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glabrous Useful for making plants with altered chemical composition
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 13 - DNA, 861 bp, Populus balsamifera subsp. trichocarpa
  misc_feature (1)..(861): Ceres ANNOT ID no. 1474923
  misc_feature 1054:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glabrous Useful for making plants with altered chemical composition
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggaaaattgcagaaggtctccattgaagccgtggaagaaaggtccaacaagaggcaaaggcggtcctcaaaatgccatgtgtgagtaccgaggggttcgtcaaagaacatggggcaaatgggtggcagaaataagagaacccaagaagagaaccagactgtggttgggttcttttgccactgctgaagaagctgctatggcctatgatgaggctgcaagaagattgtatggaccggatgcttatcttaatctacctcaccttcagtctaactttaatcctctaaacaaatcacagaagctcaaatggattccttccaagaacttcatttccatgttcccttcttgtgggctgcttaatatacatgcacagcctagcgttcatgtcatccatcagcggctcgaagaactcaagaataacaggccccttcatcaatcctctgtcgcttctagttcttcctcctctgaatccagaaatgaagtgatgattgtaagtgacgaaaaccatgtagcaaatctcgccgtagcagagaaagatgtggaaatatcatcagagaagatgctgctaagaaatcatgacgagaaaccacagattgatctgaacgagttccttcagcagctgggcatactgaaagaagagaaacagccagatagcaatgatgtcgaagaatgtctcacggtgccagaatcttcacaaaaatatgaaaacgaacttgcagcattggcagacaagagtttcaattgggattcactgattgaaatgcatggaattacagatcatcaagcagcagaattaaatagttttccagtttatgacgtccaagatgagccggctttcccaacttccatttggaacttctag

SEQ ID NO: 14 - protein, 286 aa, Populus balsamifera subsp. trichocarpa
  misc_feature (1)..(286): Ceres ANNOT ID no. 1474923
  misc_feature (28)..(91): Pfam Name: AP2 Pfam Description: AP2 domain
  misc_feature: SWISSPROT Homolog: DRE2F_ARATH Dehydration-responsive element-binding protein 2F (DREB2F protein) with e-value of 1.3e-151 and BLAST sequence identity of 100.0
  misc_feature: SWISSPROT Homolog: DRE2G_ARATH Dehydration-responsive element-binding protein 2G (DREB2G protein) with e-value of 1.1e-28 and BLAST sequence identity of 43.3
  misc_feature: SWISSPROT Homolog: DRE2D_ARATH Putative dehydration-responsive element-binding protein 2D (DREB2D protein) with e-value of 1.3e-27 and BLAST sequence identity of 62.1
  misc_feature: SWISSPROT Homolog: DRE2C_ARATH Dehydration-responsive element-binding protein 2C (DREB2C protein) with e-value of 4.9e-26 and BLAST sequence identity of 38.5
  misc_feature: SWISSPROT Homolog: DRE2H_ARATH Putative dehydration-responsive element-binding protein 2H (DREB2H protein) with e-value of 7.2e-25 and BLAST sequence identity of 63.3
  misc_feature 1260:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glabrous Useful for making plants with altered chemical composition
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(286): Functional Homolog of  Ceres CLONE ID no. 332 at SEQ ID NO. 12 with e-value of 2.39E-78 and BLAST sequence identity of 58.9
MENCRRSPLKPWKKGPTRGKGGPQNAMCEYRGVRQRTWGKWVAEIREPKKRTRLWLGSFATAEEAAMAYDEAARRLYGPDAYLNLPHLQSNFNPLNKSQKLKWIPSKNFISMFPSCGLLNIHAQPSVHVIHQRLEELKNNRPLHQSSVASSSSSSESRNEVMIVSDENHVANLAVAEKDVEISSEKMLLRNHDEKPQIDLNEFLQQLGILKEEKQPDSNDVEECLTVPESSQKYENELAALADKSFNWDSLIEMHGITDHQAAELNSFPVYDVQDEPAFPTSIWNF

SEQ ID NO: 15 - protein, 172 aa, Arabidopsis thaliana
  misc_feature (1)..(172): Ceres CLONE ID no. 463
  misc_feature (50)..(167): Pfam Name: DUF393 Pfam Description: Protein of unknown function, DUF393
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
MAILIPASFGRLTITSREKVRVRFSASANQRTIRRDSVDWVKETSSFFEEDKRPIMLFDGVCNLCNGGVKFVRDHDRNRSIRFEALQSEAGKKLLLRSGRAPDDISSVVLVENDRSYIKSEAVLKIMKYIDLPFPQLAFFLQFAPLFVRDFLYENVANNRYAMFGRSDSCEL

SEQ ID NO: 16 - DNA, 438 bp, Populus balsamifera subsp. trichocarpa
  misc_feature (1)..(438): Ceres ANNOT ID no. 1542632
  misc_feature 1520:<222: Transcription Factor
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
atggcaattcttggttcaggcagctgcacactattaaggctgacacctagcaatcatgataaacgaagaatcgccacttttgccactcaatctcctcctagaaatgacagtgcagttaactgggttgaagcaactggtggcttcttcgagaaagactcacgaccaatcatgttatttgatggtgtgtgtaacctctgtaatggaggtgtaaggtttgtgcgagataatgaccgaaataggagaatcaggtatgaggctctccagagtgaggcagggagaaaactgttgaggaggtccggaagagctcctgatgatatttcaagtgttgtactagttgagagagataggttcttgagggattttgtatatgacaaggttgcaaataatcgctacacaatttttgggcgctcagaatcatgcgagatatattatgactga

SEQ ID NO: 17 - protein, 145 aa, Populus balsamifera subsp. trichocarpa
  misc_feature (1)..(145): Ceres ANNOT ID no. 1542632
  misc_feature (116)..(137): Pfam Name: DUF393 Pfam Description: Protein of unknown function, DUF393
  misc_feature: SWISSPROT Homolog: YUXK_BACSU Hypothetical protein yuxK (ORF2) with e-value of 1.8e-21 and BLAST sequence identity of 43.2
  misc_feature 1582:<222: Transcription Factor
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
  misc_feature (1)..(145): Functional Homolog of  Ceres CLONE ID no. 463 at SEQ ID NO. 15 with e-value of 2.19E-38 and BLAST sequence identity of 67.3
MAILGSGSCTLLRLTPSNHDKRRIATFATQSPPRNDSAVNWVEATGGFFEKDSRPIMLFDGVCNLCNGGVRFVRDNDRNRRIRYEALQSEAGRKLLRRSGRAPDDISSVVLVERDRFLRDFVYDKVANNRYTIFGRSESCEIYYD

SEQ ID NO: 18 - protein, 206 aa, Arabidopsis thaliana [sequence omitted]

SEQ ID NO: 19 - DNA, 624 bp, Populus balsamifera subsp. trichocarpa
  misc_feature (1)..(624): Ceres ANNOT ID no. 1447138
  misc_feature: Utility: No N, No PO4 Useful for making plants tolerant to low nitrogen/low phosphate
  misc_feature 1731:<222: Transcription Factor
  misc_feature: Phenotype: WHOLE PLANT - No N, No PO4 Useful for making plants tolerant to low nitrogen/low phosphate
atggttaagcataacaatgttgtgcccaatgggcacttcaagaagcactggcaaaactatgtcaagacatggtttaaccaaccagcccgaaagactcgcagacgcatcgctcgtcagaagaaggcagtcaagatctttcctcggcctacagctggacctcttcgacctattgtacatggccagactttgaagtataatatgaaagtgagagctggtagggggttttctcttgaagaactcaaggctgctggtattccaaagaaacttgctcctacaataggaattgcagttgatcaccgtcgcaagaatcgctccttggagggtatccaggctaacattcggaggctgaacacctacaaggccaaattggttgtcttcccaagacgggctcgcaagttgaaggctggtgattctgctcctgaggagctggcaaccgctactcaagtacaaggacagtttatgcctattgtacgtgagaaggcgtctgtggagcttgtgaaggtcaccgaggagatgaagtcattcaaggcttatgacaagctccgtgcggagcgtacgaatgcccgccatgttggtgttaggctgaagagggctgcagaagccgagaaggaagagaagaagtag

SEQ ID NO: 20 - protein, 207 aa, Populus balsamifera subsp. trichocarpa
  misc_feature (1)..(207): Ceres ANNOT ID no. 1447138
  misc_feature (6)..(184): Pfam Name: Ribosomal_L13e Pfam Description: Ribosomal protein L13e
  misc_feature: SWISSPROT Homolog: RL13_ARATH 60S ribosomal protein L13 (BBC1 protein homolog) with e-value of 6.0e-108 and BLAST sequence identity of 100.0
  misc_feature: SWISSPROT Homolog: RL131_BRANA 60S ribosomal protein L13-1 (Cold-induced protein C24A) with e-value of 1.1e-101 and BLAST sequence identity of 93.7
  misc_feature: SWISSPROT Homolog: RL132_BRANA 60S ribosomal protein L13-2 (Cold-induced protein C24B) with e-value of 1.4e-101 and BLAST sequence identity of 93.2
  misc_feature: SWISSPROT Homolog: RL13_TOBAC 60S ribosomal protein L13 (Clone 6.2.1) with e-value of 1.8e-76 and BLAST sequence identity of 74.7
  misc_feature: SWISSPROT Homolog: RL13_CHLSW 60S ribosomal protein L13 (BBC1 protein homolog) with e-value of 5.9e-62 and BLAST sequence identity of 58.9
  misc_feature: Utility: No N, No PO4 Useful for making plants tolerant to low nitrogen/low phosphate
  misc_feature 1830:<222: Transcription Factor
  misc_feature: Phenotype: WHOLE PLANT - No N, No PO4 Useful for making plants tolerant to low nitrogen/low phosphate
  misc_feature (1)..(207): Functional Homolog of  Ceres CLONE ID no. 585 at SEQ ID NO. 18 with e-value of 4.40E-95 and BLAST sequence identity of 84.4
MVKHNNVVPNGHFKKHWQNYVKTWFNQPARKTRRRIARQKKAVKIFPRPTAGPLRPIVHGQTLKYNMKVRAGRGFSLEELKAAGIPKKLAPTIGIAVDHRRKNRSLEGIQANIRRLNTYKAKLVVFPRRARKLKAGDSAPEELATATQVQGQFMPIVREKASVELVKVTEEMKSFKAYDKLRAERTNARHVGVRLKRAAEAEKEEKK

SEQ ID NO: 21 - DNA, 624 bp, Populus balsamifera subsp. trichocarpa
  misc_feature (1)..(624): Ceres ANNOT ID no. 1469376
  misc_feature: Utility: No N, No PO4 Useful for making plants tolerant to low nitrogen/low phosphate
  misc_feature 1908:<222: Transcription Factor
  misc_feature: Phenotype: WHOLE PLANT - No N, No PO4 Useful for making plants tolerant to low nitrogen/low phosphate
atggttaagcataacaatgttgtgcccaatggacacttcaagaagcactggcaaaactatgtcaagacatggtttaaccaaccagcccgaaagacccgcagacgcatagctcgtcagaagaaggcagtcaaaatctttcctcgacctacggccggacctcttcgacccattgtacatggccagactttgaaatataatatgaaagtgagagctggtaggggtttttctcttgaagaactcaaggctgctggtattccgaagaaacttgctccaacaattggaattgcagttgatcaccgtcgcaggaatcgatctctggagggtctccaagctaatgttcagaggctgaaaacatacaaggccaaattggttgtcttcccaagacgtgctcgcaagttcaaggctggtgattctgctcctgaggaactggcaactgcaacccaagtacaaggacagattatgcctattgtactggagaagccatgcgtggagcttgtgaaggtcactgaggaaatgaagtcattcagggcttatgacaagcttcgtgtggagcgcacgagtgcacgccatgttggtgtcaggttgaagagggctgcagaagccgagaaggaagagaagaagtag

SEQ ID NO: 22 - protein, 207 aa, Populus balsamifera subsp. trichocarpa
  misc_feature (1)..(207): Ceres ANNOT ID no. 1469376
  misc_feature (6)..(184): Pfam Name: Ribosomal_L13e Pfam Description: Ribosomal protein L13e
  misc_feature: SWISSPROT Homolog: RL13_ARATH 60S ribosomal protein L13 (BBC1 protein homolog) with e-value of 6.0e-108 and BLAST sequence identity of 100.0
  misc_feature: SWISSPROT Homolog: RL131_BRANA 60S ribosomal protein L13-1 (Cold-induced protein C24A) with e-value of 1.1e-101 and BLAST sequence identity of 93.7
  misc_feature: SWISSPROT Homolog: RL132_BRANA 60S ribosomal protein L13-2 (Cold-induced protein C24B) with e-value of 1.4e-101 and BLAST sequence identity of 93.2
  misc_feature: SWISSPROT Homolog: RL13_TOBAC 60S ribosomal protein L13 (Clone 6.2.1) with e-value of 1.8e-76 and BLAST sequence identity of 74.7
  misc_feature: SWISSPROT Homolog: RL13_CHLSW 60S ribosomal protein L13 (BBC1 protein homolog) with e-value of 5.9e-62 and BLAST sequence identity of 58.9
  misc_feature: Utility: No N, No PO4 Useful for making plants tolerant to low nitrogen/low phosphate
  misc_feature 2007:<222: Transcription Factor
  misc_feature: Phenotype: WHOLE PLANT - No N, No PO4 Useful for making plants tolerant to low nitrogen/low phosphate
  misc_feature (1)..(207): Functional Homolog of  Ceres CLONE ID no. 585 at SEQ ID NO. 18 with e-value of 1.20E-94 and BLAST sequence identity of 84.9
MVKHNNVVPNGHFKKHWQNYVKTWFNQPARKTRRRIARQKKAVKIFPRPTAGPLRPIVHGQTLKYNMKVRAGRGFSLEELKAAGIPKKLAPTIGIAVDHRRRNRSLEGLQANVQRLKTYKAKLVVFPRRARKFKAGDSAPEELATATQVQGQIMPIVLEKPCVELVKVTEEMKSFRAYDKLRVERTSARHVGVRLKRAAEAEKEEKK

SEQ ID NO: 23 - DNA, 624 bp, Populus balsamifera subsp. trichocarpa
  misc_feature (1)..(624): Ceres ANNOT ID no. 1475299
  misc_feature: Utility: No N, No PO4 Useful for making plants tolerant to low nitrogen/low phosphate
  misc_feature 2085:<222: Transcription Factor
  misc_feature: Phenotype: WHOLE PLANT - No N, No PO4 Useful for making plants tolerant to low nitrogen/low phosphate
atggttaagcataacaatgttgtgccaaatgggcacttcaagaagcactggcaaaattatgtcaagacatggtttaaccaaccagctcgaaagactcgcagacgcattgctcgtcagaagaaggcggtcaaaatatttcctcgacctactgctggacctcttcgacccattgtacatggccagactttgaagtataacatgaaagtgagagccggtagggggttttctcttgaagaactcaaggctgctggtattccaaagaaacttgctccgacaataggaattgcagttgatcaccgtcgcaagaatcactccctggagggactccaggctaacattcagaggctgaaaacatacaaggccaaattggttgtcttcccaagacatgctcgcaagttcaaggctggtgattctgctcctgaggaactggcaactgctactcaagtacaaggacatattatgcctattgcatgtgagaagccatccgtggagcttgtgaaggtcactgaggagatgaagtcattcaaggcttatgacaagcttcgagtggagcgtacaaatgcacgccatgttggtgccaggttgaagagggctgcagaagctgagaaggaagagaagaagtag

SEQ ID NO: 24 - protein, 207 aa, Populus balsamifera subsp. trichocarpa
  misc_feature (1)..(207): Ceres ANNOT ID no. 1475299
  misc_feature (6)..(184): Pfam Name: Ribosomal_L13e Pfam Description: Ribosomal protein L13e
  misc_feature: SWISSPROT Homolog: RL13_ARATH 60S ribosomal protein L13 (BBC1 protein homolog) with e-value of 6.0e-108 and BLAST sequence identity of 100.0
  misc_feature: SWISSPROT Homolog: RL131_BRANA 60S ribosomal protein L13-1 (Cold-induced protein C24A) with e-value of 1.1e-101 and BLAST sequence identity of 93.7
  misc_feature: SWISSPROT Homolog: RL132_BRANA 60S ribosomal protein L13-2 (Cold-induced protein C24B) with e-value of 1.4e-101 and BLAST sequence identity of 93.2
  misc_feature: SWISSPROT Homolog: RL13_TOBAC 60S ribosomal protein L13 (Clone 6.2.1) with e-value of 1.8e-76 and BLAST sequence identity of 74.7
  misc_feature: SWISSPROT Homolog: RL13_CHLSW 60S ribosomal protein L13 (BBC1 protein homolog) with e-value of 5.9e-62 and BLAST sequence identity of 58.9
  misc_feature: Utility: No N, No PO4 Useful for making plants tolerant to low nitrogen/low phosphate
  misc_feature 2184:<222: Transcription Factor
  misc_feature: Phenotype: WHOLE PLANT - No N, No PO4 Useful for making plants tolerant to low nitrogen/low phosphate
  misc_feature (1)..(207): Functional Homolog of  Ceres CLONE ID no. 585 at SEQ ID NO. 18 with e-value of 1.20E-94 and BLAST sequence identity of 84.9
MVKHNNVVPNGHFKKHWQNYVKTWFNQPARKTRRRIARQKKAVKIFPRPTAGPLRPIVHGQTLKYNMKVRAGRGFSLEELKAAGIPKKLAPTIGIAVDHRRKNHSLEGLQANIQRLKTYKAKLVVFPRHARKFKAGDSAPEELATATQVQGHIMPIACEKPSVELVKVTEEMKSFKAYDKLRVERTNARHVGARLKRAAEAEKEEKK

SEQ ID NO: 25 - protein, 365 aa, Arabidopsis thaliana
  misc_feature (1)..(365): Ceres CLONE ID no. 641
  misc_feature (81)..(362): Pfam Name: Phi_1 Pfam Description: Phosphate-induced protein 1 conserved region
  misc_feature: Phenotype: FLOWER - Reduced fertility Useful for sterility, genetic confinement systems
  misc_feature (220)..(220): Xaa is any aa, unknown, or other
MSSPATTITFFFFFTLSSFFYITSSLQNNNNNNNKHTATVNSLNIPSAAAEITLVNPKLPPRSLSLTSSKKFEGSSNLVHLRYHMGPVLSSSPINIYVIWYGQWSRPHKSLIRDFLNSISDAKAPSPSVSEWWRTASLYTDQTGSNVSRSVLIAGEYSDSKYSHGQHLTRLTIQEVIASAARSASFPVDHKNGMYLVLTSHDVTMQDFCRAVCGFHYFTXPSMVGYTMPYAWVGQSGKQCPEVCAYPFALPGYMGHGGPGELRPPNGETGVDGMVSVIGHELAEVVSNPLINAWYAGEDPTAPTEIGDLCEGLYGSGGGGGYIGQVMRDREGKTFNMNGKGGRKFLVQWIWNPNLKACSGPNSVD

SEQ ID NO: 26 - DNA, 1071 bp, Populus balsamifera subsp. trichocarpa
  misc_feature (1)..(1071): Ceres ANNOT ID no. 1488536
  misc_feature 2358:<222: Transcription Factor
  misc_feature: Phenotype: FLOWER - Reduced fertility Useful for sterility, genetic confinement systems
atgtcacaacgtccttattcccccctttcattttgttgtgcccttttcataccattactatttattcaccttgtctatgcttcaacttcttcaactagttccccacaagttcaaaccctgaacacaaaaccagatattataaacccaaaactaccaccaagaaccctctcatcctctaagaaatttgagggctcatcagatttagtccaacttcgttaccatatgggtccagtcctctcttcagccccaataaacatctaccttatctggtatggccgttgggctaattctcaaaaacttctcatcaaagacttcattaactccatctccccctcaactgttgccgccaagccctccgtctctgactggtggcgcactgtgtctttgtacacagatcaaactggggctaacgtctcacgttcaatactcatagccggcgaatatgctgatagtgcttattcacatgggactggcttaacaagacttacaatccaacaagtgatagcttcagctgtaaggtctgcacctttcccagtagatcacaagaatgggatctacctcatattgacctcacaagatgtgaccatgcaagacttctgtagagcagtgtgtgggttccattactttacatttccatcaatggttggctacacattgccttatgcttgggttggtaattcaggcaaacaatgccctgaagtatgtgcttacccttttgcagtccctggttatatgggtggaggtggaccaggagccttgaagccaccaaatggggatgtgggtgttgatggaatgattagtgttataggccatgaacttgcagagttgtcttcaaatcccttggtgaatgcttggtatgctggggaggatccaacagcaccaactgagataggggatttgtgtgaagggttgtatgggacaggtggcggtggtgggtatatagggcaggtgatgagggataggaaaggcaggacctttaatttgaatggtagaagagggaggaagttcttggtgcaatggatctggagccccgagttgaaggcatgtgccggtcctaatgctttggactga

SEQ ID NO: 27 - protein, 356 aa, Populus balsamifera subsp. trichocarpa
  misc_feature (1)..(356): Ceres ANNOT ID no. 1488536
  misc_feature (71)..(353): Pfam Name: Phi_1 Pfam Description: Phosphate-induced protein 1 conserved region
  misc_feature 2425:<222: Transcription Factor
  misc_feature: Phenotype: FLOWER - Reduced fertility Useful for sterility, genetic confinement systems
  misc_feature (1)..(356): Functional Homolog of  Ceres CLONE ID no. 641 at SEQ ID NO. 25 with e-value of 9.80E-146 and BLAST sequence identity of 77.6
MSQRPYSPLSFCCALFIPLLFIHLVYASTSSTSSPQVQTLNTKPDIINPKLPPRTLSSSKKFEGSSDLVQLRYHMGPVLSSAPINIYLIWYGRWANSQKLLIKDFINSISPSTVAAKPSVSDWWRTVSLYTDQTGANVSRSILIAGEYADSAYSHGTGLTRLTIQQVIASAVRSAPFPVDHKNGIYLILTSQDVTMQDFCRAVCGFHYFTFPSMVGYTLPYAWVGNSGKQCPEVCAYPFAVPGYMGGGGPGALKPPNGDVGVDGMISVIGHELAELSSNPLVNAWYAGEDPTAPTEIGDLCEGLYGTGGGGGYIGQVMRDRKGRTFNLNGRRGRKFLVQWIWSPELKACAGPNALD

SEQ ID NO: 28 - DNA, 1062 bp, Populus balsamifera subsp. trichocarpa
  misc_feature (1)..(1062): Ceres ANNOT ID no. 1460253
  misc_feature 2527:<222: Transcription Factor
  misc_feature: Phenotype: FLOWER - Reduced fertility Useful for sterility, genetic confinement systems
atgtcacagcaatcccatttctctatatcattcttttatgccttcatatcattattatttattcaccatgtccttgcttctactagaaccactccacaagttcaaaccttcaacacaaaaccagacattataaacccaaaacttccgccaagaaccctctcctcctctaaaaaatttgagggatcatcagatttagtccatcttcgttaccatatgggtccagttctctcttcaactccgataaacatctaccttatctggtatggccgttgggctaattctcaaaaacttctcatcaaagacttcctcaactccatctcccccaccactgttgccgccaagccctccgtctctgagtggtggcgcaccgtgtctttgtacacagatcaaactggagctaatgtctcacgctcaatactcatagctggtgaatatactgatagtgcttattcacatgggactggcttaacaagacttacaatccaacaagtgatagcttcagcagtaaagtctgcacctttccctgtagatcacaagaatgggatctaccttatattgacatcacaagatgtgactatgcaagacttttgtagggcggtgtgtggatttcattattttacatttccatcaatggttggctacacactgccttatgcttgggttggtaactcaggcaaacaatgtcccgaagtatgcgcttacccttttgcagtccctggttacatgggtggaggggggccaggagccttgaagtcaccaaatggggatgtgggcgtggatgggatgattagtgttataggccatgagctcgcagaattgtcttcaaatcctttagtgaatgcttggtatgctggggaggatccaacagcaccaactgagataggggacttgtgtgaagggttgtatgggacaggtggtggtggtgggtatacagggcaggttatgagggatacgcaaggtaagacttttaatatgaatggcagaagaggtagaaagttcttggtgcaatggatctggagccctgagttgaaggcatgttctggtcctaatgctctggactga

SEQ ID NO: 29 - protein, 353 aa, Populus balsamifera subsp. trichocarpa
  misc_feature (1)..(353): Ceres ANNOT ID no. 1460253
  misc_feature (68)..(350): Pfam Name: Phi_1 Pfam Description: Phosphate-induced protein 1 conserved region
  misc_feature 2594:<222: Transcription Factor
  misc_feature: Phenotype: FLOWER - Reduced fertility Useful for sterility, genetic confinement systems
  misc_feature (1)..(353): Functional Homolog of  Ceres CLONE ID no. 641 at SEQ ID NO. 25 with e-value of 2.60E-145 and BLAST sequence identity of 77.1
MSQQSHFSISFFYAFISLLFIHHVLASTRTTPQVQTFNTKPDIINPKLPPRTLSSSKKFEGSSDLVHLRYHMGPVLSSTPINIYLIWYGRWANSQKLLIKDFLNSISPTTVAAKPSVSEWWRTVSLYTDQTGANVSRSILIAGEYTDSAYSHGTGLTRLTIQQVIASAVKSAPFPVDHKNGIYLILTSQDVTMQDFCRAVCGFHYFTFPSMVGYTLPYAWVGNSGKQCPEVCAYPFAVPGYMGGGGPGALKSPNGDVGVDGMISVIGHELAELSSNPLVNAWYAGEDPTAPTEIGDLCEGLYGTGGGGGYTGQVMRDTQGKTFNMNGRRGRKFLVQWIWSPELKACSGPNALD

SEQ ID NO: 30 - protein, 213 aa, Arabidopsis thaliana
  misc_feature (1)..(213): Ceres CLONE ID no. 907
  misc_feature (43)..(208): Pfam Name: DUF679 Pfam Description: Protein of unknown function (DUF679)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE SEEDLING - Meristem Mutant Useful for making lethal plants for genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MEIKVDEGHQKGTKEDITRPLLEEDKDFPDIERTTWIQKAIGQTFQTTAHLANLLPTGTVLAFQLLSPIFSNGGQCDLVSKIMTSTLVAICGFSCFILSFTDSYKDKNGTICYGLATIHGFWIIDGSTTLPQELSKRYKLRFIDFVHAFMSLFVFGAVVLFDRNAVNCFFPSPSAEALEVLTALPVGVGVFSSMLFATFPTTRNGIGFPLSSK

SEQ ID NO: 31 - DNA, 639 bp, Populus balsamifera subsp. trichocarpa
  misc_feature (1)..(639): Ceres ANNOT ID no. 1502138
  misc_feature 2829:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE SEEDLING - Meristem Mutant Useful for making lethal plants for genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggagattaaggtagaatctcatcatgattcattgcataccaatgaagaaaaactccctctcctgaaaggagtggccatgccgaatgaggatgagcaaaacttgattcagaaagccataagtcagacattcaagagcacagctcatctggccaatcttttacctactggaacaattcttgctttccagcttttattgcccatattttcaaatcagggaaattgcgactcggtcagtaggtccatgactgcaggactagttgccctctgtgggttgtcatgtttcctatcaagctttaccgatagctttagggacaagaacggaaatgtatgttatgggtttgcaacattccgaggcttgtgggtcattgatgggtcggcaaccattccaccagaagttgctgcaaattaccggctgcagtttatagatttcatgcatgccctcatgtcaatactagtattcgcagccattgccttatttgatcagaatgtggtagattgcttctatccatcaccatcaactaaggaagaggaggtcctcacagcattgcctgttgggatcggtgtctttactagtatgttgtttcttgtttttcccaccaggcgccatggaattggcttccccctttctgcaaattaa

SEQ ID NO: 32 - protein, 212 aa, Populus balsamifera subsp. trichocarpa
  misc_feature (1)..(212): Ceres ANNOT ID no. 1502138
  misc_feature (42)..(207): Pfam Name: DUF679 Pfam Description: Protein of unknown function (DUF679)
  misc_feature 2945:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE SEEDLING - Meristem Mutant Useful for making lethal plants for genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(212): Functional Homolog of  Ceres CLONE ID no. 907 at SEQ ID NO. 30 with e-value of 8.39E-69 and BLAST sequence identity of 61.6
MEIKVESHHDSLHTNEEKLPLLKGVAMPNEDEQNLIQKAISQTFKSTAHLANLLPTGTILAFQLLLPIFSNQGNCDSVSRSMTAGLVALCGLSCFLSSFTDSFRDKNGNVCYGFATFRGLWVIDGSATIPPEVAANYRLQFIDFMHALMSILVFAAIALFDQNVVDCFYPSPSTKEEEVLTALPVGIGVFTSMLFLVFPTRRHGIGFPLSAN

SEQ ID NO: 33 - DNA, 618 bp, Populus balsamifera subsp. trichocarpa
  misc_feature (1)..(618): Ceres ANNOT ID no. 1449135
  misc_feature 3083:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE SEEDLING - Meristem Mutant Useful for making lethal plants for genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggagattaaggtagaatctcatcatgattcattgcataccaatgaagaaaaactccctctcctgaaaggagtggccatgccgaatgaggatgagcaaaacttgattcagaaagccataagtcagacattcaagagcacagctcatctggccaatcttttacctactggaacaattcttgctttccagcttttattgcccatattttcaaatcagggaaattgcgactcggtcagtaggtccatgactgcaggactagttgccctctgtgggttgtcatgtttcctatcaagctttaccgatagctttagggacaagaacggaaatgtatgttatgggtttgcaacattccgaggcttgtgggtcattgatgggtcggcaaccattccaccagaagttgctgcaaattaccggctgcagtttatagatttcatgcatgccctcatgtcaatactagtattcgcagccattgccttatttgatcagaatgtggtagattgcttctatccatcaccatcaactaaggaagaggaggtcctcacagcattgcctgttgggatcggtgtctttactaagcttgaacaaacattcacatccagtttagctcctgaaacatga

SEQ ID NO: 34 - protein, 205 aa, Populus balsamifera subsp. trichocarpa
  misc_feature (1)..(205): Ceres ANNOT ID no. 1449135
  misc_feature (42)..(190): Pfam Name: DUF679 Pfam Description: Protein of unknown function (DUF679)
  misc_feature 3199:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE SEEDLING - Meristem Mutant Useful for making lethal plants for genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(205): Functional Homolog of  Ceres CLONE ID no. 907 at SEQ ID NO. 30 with e-value of 9.50E-61 and BLAST sequence identity of 59.0
MEIKVESHHDSLHTNEEKLPLLKGVAMPNEDEQNLIQKAISQTFKSTAHLANLLPTGTILAFQLLLPIFSNQGNCDSVSRSMTAGLVALCGLSCFLSSFTDSFRDKNGNVCYGFATFRGLWVIDGSATIPPEVAANYRLQFIDFMHALMSILVFAAIALFDQNVVDCFYPSPSTKEEEVLTALPVGIGVFTKLEQTFTSSLAPET

SEQ ID NO: 35 - protein, 347 aa, Arabidopsis thaliana
  misc_feature (1)..(347): Ceres CLONE ID no. 949
  misc_feature (284)..(322): Pfam Name: CCT Pfam Description: CCT motif
  misc_feature (56)..(101): Pfam Name: zf-B_box Pfam Description: B-box zinc finger
  misc_feature: Phenotype: WHOLE PLANT - Large Useful for making bigger plants
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 36 - DNA, 1110 bp, Populus balsamifera subsp. trichocarpa
  misc_feature (1)..(1110): Ceres ANNOT ID no. 1449721
  misc_feature 3434:<222: Transcription Factor
  misc_feature: Phenotype: WHOLE PLANT - Large Useful for making bigger plants
atgttgaagcaagagagtagtggtggcggaggtggtgacaacagggctcgtgtatgtgacacgtgtcgtgcagcaccttgcactgtgtactgcagggctgactcggcatacttgtgtgccgggtgtgatgcccgtgtgcacgcagccaatcgtgtggcatcacgccatgagcgcgtatcggtgtgcgaggcgtgtgagcgtgctccggctgccttgttatgcaaggcggatgcggcgtctctctgcactgcctgtgacgcagatatccattctgcaaacccactagcacgccgccaccagcgtgttccaattctgcccatttccggttgccttcacggttccccagtagggcctgcagccggtgagactgaagaccggttcacgacacaagagggagaagagacaataagtgaggaggaggaggatgaagctgcttcatggttgttactaaatcctgtgaagaacagcaagaaccagaataataatggcttcttgtttggtggggaggttgatgagtatttggatcttgtggagtacaactcatgtactgaaaatcaatgctctgatcagtacaatcagcaacactactgtgttccgccaaagagttatgggggtgaccgtgctgtgccaattcagtatggagaaggaaaggatcatcaacagcaacggcagtatcacaattttcagttgggattggagtatgagccctcaaaagctgcttgcagctacaatggttcgatcagtcaaagtgtatccatgtcatccatggatgttggagtggtgccagaatcaacaatgagcgagatctcaatctcgcaacatagacctccaaaagggacaatggaacttttctccagcactgctatccagatgccatctcaacttagtccaatggatagggaggcaagagtcctgagatacagagagaaaaagaagacgaggaagtttgagaagacaatcaggtatgcctcaaggaaggcctatgcagagaccagaccccggataaaaggccgatttgcaaagagaaaagatgtagaagtcgaagatgaccaaatgttctcctccacactaatggcagaaacaggatatggcattgtcccatcattctga

SEQ ID NO: 37 - protein, 369 aa, Populus balsamifera subsp. trichocarpa
  misc_feature (1)..(369): Ceres ANNOT ID no. 1449721
  misc_feature (16)..(61): Pfam Name: zf-B_box Pfam Description: B-box zinc finger
  misc_feature (306)..(344): Pfam Name: CCT Pfam Description: CCT motif
  misc_feature: SWISSPROT Homolog: COL2_ARATH Zinc finger protein CONSTANS-LIKE 2 with e-value of 2.6e-187 and BLAST sequence identity of 100.0
  misc_feature: SWISSPROT Homolog: CONS_ARATH Zinc finger protein CONSTANS with e-value of 1.5e-117 and BLAST sequence identity of 60.8
  misc_feature: SWISSPROT Homolog: COL1_ARATH Zinc finger protein CONSTANS-LIKE 1 with e-value of 4.7e-101 and BLAST sequence identity of 60.7
  misc_feature: SWISSPROT Homolog: COL5_ARATH Zinc finger protein CONSTANS-LIKE 5 with e-value of 4.0e-63 and BLAST sequence identity of 42.6
  misc_feature: SWISSPROT Homolog: COL3_ARATH Zinc finger protein CONSTANS-LIKE 3 with e-value of 9.4e-60 and BLAST sequence identity of 52.3
  misc_feature 3544:<222: Transcription Factor
  misc_feature: Phenotype: WHOLE PLANT - Large Useful for making bigger plants
  misc_feature (1)..(369): Functional Homolog of  Ceres CLONE ID no. 949 at SEQ ID NO. 35 with e-value of 1.19E-106 and BLAST sequence identity of 66.1
MLKQESSGGGGGDNRARVCDTCRAAPCTVYCRADSAYLCAGCDARVHAANRVASRHERVSVCEACERAPAALLCKADAASLCTACDADIHSANPLARRHQRVPILPISGCLHGSPVGPAAGETEDRFTTQEGEETISEEEEDEAASWLLLNPVKNSKNQNNNGFLFGGEVDEYLDLVEYNSCTENQCSDQYNQQHYCVPPKSYGGDRAVPIQYGEGKDHQQQRQYHNFQLGLEYEPSKAACSYNGSISQSVSMSSMDVGVVPESTMSEISISQHRPPKGTMELFSSTAIQMPSQLSPMDREARVLRYREKKKTRKFEKTIRYASRKAYAETRPRIKGRFAKRKDVEVEDDQMFSSTLMAETGYGIVPSF

SEQ ID NO: 38 - protein, 313 aa, Arabidopsis thaliana
  misc_feature (1)..(313): Ceres CLONE ID no. 1241
  misc_feature (14)..(304): Pfam Name: Pkinase Pfam Description: Protein kinase domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 39 - DNA, 921 bp, Populus balsamifera subsp. trichocarpa
  misc_feature (1)..(921): Ceres ANNOT ID no. 1453081
  misc_feature 3765:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggtgtcggcgatggatttattcgagaagctagagaaagtaggagagggaacttacgggaaagtgtacagagcaagggagaaagccaccgggaagatcgttgcactaaaaaagacacgtctccatgaagacgatgaaggtgtcccacccaccacccttcgcgaagtctccatcttgcgtatgctttccagagatcctcacatcgtccgattgttggacgtgaaacaagggcaaaataaagaaggcaagacagttctgtatctggtttttgagtacatggacaccgatctcaagaaatttatccgaagctttcgccaaactggagagaacattcctgtcaaaactgtcaagagcttgatgtatcaactatgtaagggtgtggctttctgccatggccatggagtcttacacagggatcttaagcctcataatctcttgatggaccgcaagactacgatgcttaaaatagctgatctcggactggctcgagcatttactcttcctattaagaagtatacccatgagatattgactttgtggtatagatctcctgaagtccttttgggggctacccgttactcaactgcagtggatgtatggtctgttggctgtatatttgctgaactggccacaaagcaagcactattccctggagactctgaactgcaacagctcctgcatattttcaggttattaggtactccaaatgaagaaatgtggccaggagtaagcaacctgatgaactggcatgagtatccccaatggaaacctcagagtttgtcatcggctgttactaatttggacaaggatgggctggatttactatcacaaatgttgcagtatgacccttcaaagcgcatctcagcaaagaaagccatggaacatccttactttgatgatctagagaaggaccgtctctaa

SEQ ID NO: 40 - protein, 306 aa, Populus balsamifera subsp. trichocarpa
  misc_feature (1)..(306): Ceres ANNOT ID no. 1453081
  misc_feature (8)..(298): Pfam Name: Pkinase Pfam Description: Protein kinase domain
  misc_feature: SWISSPROT Homolog: CDC2D_ANTMA Cell division control protein 2 homolog D (EC 2.7.11.22) (EC 2.7.11.23) with e-value of 1.2e-136 and BLAST sequence identity of 81.6
  misc_feature: SWISSPROT Homolog: CDC2B_ARATH Cell division control protein 2 homolog B (EC 2.7.11.22) (EC 2.7.11.23) with e-value of 6.9e-107 and BLAST sequence identity of 65.6
  misc_feature: SWISSPROT Homolog: CDC2C_ANTMA Cell division control protein 2 homolog C (EC 2.7.11.22) (EC 2.7.11.23) with e-value of 2.3e-106 and BLAST sequence identity of 65.6
  misc_feature: SWISSPROT Homolog: CDC22_XENLA Cell division control protein 2 homolog 2 (EC 2.7.11.22) EC 2.7.11.12 (p34 protein kinase 2) with e-value of 6.0e-92 and BLAST sequence identity of 57.6
  misc_feature: SWISSPROT Homolog: CDC21_ORYSA Cell division control protein 2 homolog 1 (EC 2.7.11.22) with e-value of 3.0e-90 and BLAST sequence identity of 56.7
  misc_feature 3896:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(306): Functional Homolog of  Ceres CLONE ID no. 1241 at SEQ ID NO. 38 with e-value of 3.40E-143 and BLAST sequence identity of 85.5
MVSAMDLFEKLEKVGEGTYGKVYRAREKATGKIVALKKTRLHEDDEGVPPTTLREVSILRMLSRDPHIVRLLDVKQGQNKEGKTVLYLVFEYMDTDLKKFIRSFRQTGENIPVKTVKSLMYQLCKGVAFCHGHGVLHRDLKPHNLLMDRKTTMLKIADLGLARAFTLPIKKYTHEILTLWYRSPEVLLGATRYSTAVDVWSVGCIFAELATKQALFPGDSELQQLLHIFRLLGTPNEEMWPGVSNLMNWHEYPQWKPQSLSSAVTNLDKDGLDLLSQMLQYDPSKRISAKKAMEHPYFDDLEKDRL

SEQ ID NO: 41 - DNA, 966 bp, Populus balsamifera subsp. trichocarpa
  misc_feature (1)..(966): Ceres ANNOT ID no. 1442349
  misc_feature 4017:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggaaaaggcaggaggagtagtagcagcagcaccaacgaacacggtggtgtcggcgatggatgcattcgagaagctagagaaagtaggagagggaacgtacggtaaagtgtacagagcaagggagagagccactggaaagatcgttgctctcaaaaagacacgtctccatgaagacgatgaaggagtcccaaccaccactcttcgtgaagtctccatcttgcgtatgctctccagagatcctcacgtcgtccgtttgatggacgtgaaacaagggcagaataagcaaggcaagacagttctgtatctggtttttgagtacatggacaccgatctcaagaaatttatccgaagcttcctccaaactggagagaacattcctgtcaaaaatgtgaagagcttgatgtatcaattgtgcaagggtgtggctttctgccatggccatggagtcttacacagggatcttaagcctcataacctgttgatggaccgcaagacaatgatgcttaaaatagctgatcttggactagctcgagcatttacacttcctattaagaagtatacccatgagatattgactttgtggtatagagctcctgaagtccttctgggggctacccattactcaactgcagtggatgtatggtctgttggctgtatatttgctgaactggccacaaagcaaccactcttccctggagactctgaactacaacagctcctgcatattttcaggttattaggtactccaaatgaagaaatgtggccaggagtaagcaacctgatgaactggcatgagtatccccaatggaaacctcagagcttgtcgtcatctgtaactaatttggacaaggatgggctggatctactatcacaaatgttgcagtatgacccttcaaagcgtatctcagcaaagaaagccatggaacatccttactttgatgaattggagaaggaatgtctctaa

SEQ ID NO: 42 - protein, 321 aa, Populus balsamifera subsp. trichocarpa
  misc_feature (1)..(321): Ceres ANNOT ID no. 1442349
  misc_feature (23)..(219): Pfam Name: Pkinase_Tyr Pfam Description: Protein tyrosine kinase
  misc_feature: SWISSPROT Homolog: CDC2D_ANTMA Cell division control protein 2 homolog D (EC 2.7.11.22) (EC 2.7.11.23) with e-value of 1.2e-136 and BLAST sequence identity of 81.6
  misc_feature: SWISSPROT Homolog: CDC2B_ARATH Cell division control protein 2 homolog B (EC 2.7.11.22) (EC 2.7.11.23) with e-value of 6.9e-107 and BLAST sequence identity of 65.6
  misc_feature: SWISSPROT Homolog: CDC2C_ANTMA Cell division control protein 2 homolog C (EC 2.7.11.22) (EC 2.7.11.23) with e-value of 2.3e-106 and BLAST sequence identity of 65.6
  misc_feature: SWISSPROT Homolog: CDC22_XENLA Cell division control protein 2 homolog 2 (EC 2.7.11.22) EC 2.7.11.12 (p34 protein kinase 2) with e-value of 6.0e-92 and BLAST sequence identity of 57.6
  misc_feature: SWISSPROT Homolog: CDC21_ORYSA Cell division control protein 2 homolog 1 (EC 2.7.11.22) with e-value of 3.0e-90 and BLAST sequence identity of 56.7
  misc_feature 4150:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(321): Functional Homolog of  Ceres CLONE ID no. 1241 at SEQ ID NO. 38 with e-value of 5.60E-143 and BLAST sequence identity of 85.2
MEKAGGVVAAAPTNTVVSAMDAFEKLEKVGEGTYGKVYRARERATGKIVALKKTRLHEDDEGVPTTTLREVSILRMLSRDPHVVRLMDVKQGQNKQGKTVLYLVFEYMDTDLKKFIRSFLQTGENIPVKNVKSLMYQLCKGVAFCHGHGVLHRDLKPHNLLMDRKTMMLKIADLGLARAFTLPIKKYTHEILTLWYRAPEVLLGATHYSTAVDVWSVGCIFAELATKQPLFPGDSELQQLLHIFRLLGTPNEEMWPGVSNLMNWHEYPQWKPQSLSSSVTNLDKDGLDLLSQMLQYDPSKRISAKKAMEHPYFDELEKECL

SEQ ID NO: 43 - protein, 111 aa, Arabidopsis thaliana
  misc_feature (1)..(111): Ceres CLONE ID no. 1355
  misc_feature (54)..(111): Pfam Name: Abhydrolase_1 Pfam Description: alpha/beta hydrolase fold
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
MEGIDHRMVSVNGITMHIAEKGPKEGPVVLLLHGFPDLWYTWRHQISGLSSLGYRAVAPDLRGYGDSDSPESFSEYTCLNVVGDLVALLDSVAGNQEKVFLVGHDWGAIIG

SEQ ID NO: 44 - DNA, 1008 bp, Populus balsamifera subsp. trichocarpa
  misc_feature (1)..(1008): Ceres ANNOT ID no. 1515808
  misc_feature 4337:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atggcctcctccatagaacacagaaccattaatgtcaatggcattaatattcatgtagcaatcaaaggtccagagaatgccccagttattctcttcatccatggattccctcaactatggtattcctggagacaccagattgaggctctatcctcacttggctacagagctgtggcaccggacttgagagggtatggtgacacagatgcgccagctgaggttacaagttacaccgttctccatgtggttggtgatttgattgggttgcttgatgttgtagctccgaatcaagagagtgtttttgttgtgggacatgattggggtgctttgatagcttggcatttgtctttgtttagaccagatagagttaaagctttggttaacttgagtgttttgtttaatccaaggaatcccagtaggaaagttattgcgactttgaaggctgtttatggtgacgattattatattatcagattccaggagcctggagagattgaagctgagtttgcagagataggtacagagaaagttctcaaggaattcttaacctaccgcactccagctcctatctttttacctaaaggccaagggtttaatggaaagcctctggacactccagttgtcttaccctcttggttgtctgaagaagatgtcaagtactacaccagcaagtttgagcagaaaggctttactggaggattgaactattaccgcaatcttgaccggaactgggaacttaccgcaccatggactggagctcaaataaaagttccagtcaagtttatcgtgggtgatcaggacctcacctataattctctcggtgccaaggattatatagccaagggcgggttcaaaagagacgttccatttctacaggacctagttgtaatggaaggtgtgggtcattttatcaatgaagagaaacctgaagagatcagtaagcacatttacgacttctttcaaaagtctagttcgcttgcttggtttccttcctgttgtctttgctga

SEQ ID NO: 45 - protein, 335 aa, Populus balsamifera subsp. trichocarpa
  misc_feature (1)..(335): Ceres ANNOT ID no. 1515808
  misc_feature (55)..(318): Pfam Name: Abhydrolase_1 Pfam Description: alpha/beta hydrolase fold
  misc_feature: SWISSPROT Homolog: HYES_HUMAN Epoxide hydrolase 2 (EC 3.3.2.3) (Soluble epoxide hydrolase) (SEH) (Epoxide hydratase) (Cytosolic epoxide hydrolase) (CEH) with e-value of 1.8e-19 and BLAST sequence identity of 42.2
  misc_feature: SWISSPROT Homolog: HYES_MOUSE Epoxide hydrolase 2 (EC 3.3.2.3) (Soluble epoxide hydrolase) (SEH) (Epoxide hydratase) (Cytosolic epoxide hydrolase) (CEH) with e-value of 4.9e-19 and BLAST sequence identity of 40.7
  misc_feature: SWISSPROT Homolog: HYES_PIG Epoxide hydrolase 2 (EC 3.3.2.3) (Soluble epoxide hydrolase) (SEH) (Epoxide hydratase) (Cytosolic epoxide hydrolase) (CEH) with e-value of 6.3e-19 and BLAST sequence identity of 38.9
  misc_feature: SWISSPROT Homolog: HYES_RAT Epoxide hydrolase 2 (EC 3.3.2.3) (Soluble epoxide hydrolase) (SEH) (Epoxide hydratase) (Cytosolic epoxide hydrolase) (CEH) with e-value of 8.1e-19 and BLAST sequence identity of 39.8
  misc_feature: SWISSPROT Homolog: HYES_CORS2 Soluble epoxide hydrolase (EC 3.3.2.3) (SEH) (Epoxide hydratase) (Cytosolic epoxide hydrolase) (cEH) with e-value of 3.2e-15 and BLAST sequence identity of 38.9
  misc_feature 4456:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(335): Functional Homolog of  Ceres CLONE ID no. 1355 at SEQ ID NO. 43 with e-value of 5.60E-40 and BLAST sequence identity of 68.2
MASSIEHRTINVNGINIHVAIKGPENAPVILFIHGFPQLWYSWRHQIEALSSLGYRAVAPDLRGYGDTDAPAEVTSYTVLHVVGDLIGLLDVVAPNQESVFVVGHDWGALIAWHLSLFRPDRVKALVNLSVLFNPRNPSRKVIATLKAVYGDDYYIIRFQEPGEIEAEFAEIGTEKVLKEFLTYRTPAPIFLPKGQGFNGKPLDTPVVLPSWLSEEDVKYYTSKFEQKGFTGGLNYYRNLDRNWELTAPWTGAQIKVPVKFIVGDQDLTYNSLGAKDYIAKGGFKRDVPFLQDLVVMEGVGHFINEEKPEEISKHIYDFFQKSSSLAWFPSCCLC

SEQ ID NO: 46 - DNA, 954 bp, Populus balsamifera subsp. trichocarpa
  misc_feature (1)..(954): Ceres ANNOT ID no. 1469219
  misc_feature 4566:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atggaggggataagccatagaatggtgaaagtgaatgacattgacatgcacatagctgagaaaggccaaggtcctgttgtgctattcctccatggatttccagagctttggtactcctggcgccatcagattcttgcattaagttccctgggctaccatgctgttgcaccagatcttaggggctatggtgacactgaagctccagcatcaatctctagctattcttgtcttcatattgttggtgaccttattgcactcattgactatcttggggtggagcaagtgtttcttgttgcacatgactggggtgctcttattggatggtacttgtgcttgttcaggcctgatagagtgaaggcatatgtctgccttagtgttccatacaggccaagaaatcccaagatgaagccagtggagagcatgaaacttgtatttggagaagactattacatgtgcagattccaggaaccaggagtgattgaagctgagattgcatgtgctggaactgaagaagtgctaaagaaaatcttgactgatcgcaaaccaggccccccttgcttgccgaaagaaaatccgttcggaatctatccagaggaatcagttaccatgccatcttggctcccagaagcagacctttctttctatgccacgaaatatagccagaaagggttcactggagggttgaactactacagagctctagatttgaactgggagctcacagcatcgtggactggggcaccagtgatagtgcccgtaaagtttgtggtgggagatcttgacatggtctatactactccagggatgaaggaatttgtcaatagtggtggattcaagcactatgtgccattattggaggaagttgttgtgatggaaggagttggtcatttcattaaccaagagaaggctgaggagatcagcaatcacatttatgactacattagcaaatactga

SEQ ID NO: 47 - protein, 317 aa, Populus balsamifera subsp. trichocarpa
  misc_feature (1)..(317): Ceres ANNOT ID no. 1469219
  misc_feature (52)..(312): Pfam Name: Abhydrolase_1 Pfam Description: alpha/beta hydrolase fold
  misc_feature: SWISSPROT Homolog: HYES_HUMAN Epoxide hydrolase 2 (EC 3.3.2.3) (Soluble epoxide hydrolase) (SEH) (Epoxide hydratase) (Cytosolic epoxide hydrolase) (CEH) with e-value of 1.8e-19 and BLAST sequence identity of 42.2
  misc_feature: SWISSPROT Homolog: HYES_MOUSE Epoxide hydrolase 2 (EC 3.3.2.3) (Soluble epoxide hydrolase) (SEH) (Epoxide hydratase) (Cytosolic epoxide hydrolase) (CEH) with e-value of 4.9e-19 and BLAST sequence identity of 40.7
  misc_feature: SWISSPROT Homolog: HYES_PIG Epoxide hydrolase 2 (EC 3.3.2.3) (Soluble epoxide hydrolase) (SEH) (Epoxide hydratase) (Cytosolic epoxide hydrolase) (CEH) with e-value of 6.3e-19 and BLAST sequence identity of 38.9
  misc_feature: SWISSPROT Homolog: HYES_RAT Epoxide hydrolase 2 (EC 3.3.2.3) (Soluble epoxide hydrolase) (SEH) (Epoxide hydratase) (Cytosolic epoxide hydrolase) (CEH) with e-value of 8.1e-19 and BLAST sequence identity of 39.8
  misc_feature: SWISSPROT Homolog: HYES_CORS2 Soluble epoxide hydrolase (EC 3.3.2.3) (SEH) (Epoxide hydratase) (Cytosolic epoxide hydrolase) (cEH) with e-value of 3.2e-15 and BLAST sequence identity of 38.9
  misc_feature 4683:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(317): Functional Homolog of  Ceres CLONE ID no. 1355 at SEQ ID NO. 43 with e-value of 9.10E-40 and BLAST sequence identity of 72.8
MEGISHRMVKVNDIDMHIAEKGQGPVVLFLHGFPELWYSWRHQILALSSLGYHAVAPDLRGYGDTEAPASISSYSCLHIVGDLIALIDYLGVEQVFLVAHDWGALIGWYLCLFRPDRVKAYVCLSVPYRPRNPKMKPVESMKLVFGEDYYMCRFQEPGVIEAEIACAGTEEVLKKILTDRKPGPPCLPKENPFGIYPEESVTMPSWLPEADLSFYATKYSQKGFTGGLNYYRALDLNWELTASWTGAPVIVPVKFVVGDLDMVYTTPGMKEFVNSGGFKHYVPLLEEVVVMEGVGHFINQEKAEEISNHIYDYISKY

SEQ ID NO: 48 - DNA, 972 bp, Populus balsamifera subsp. trichocarpa
  misc_feature (1)..(972): Ceres ANNOT ID no. 1462513
  misc_feature 4790:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atggcctcctccatagaacacagaaccattaatgtcaatggcattaatattcatgtagcaatcaaaggtccagagaatgccccagttattctcttcatccatggattccctcaactatggtattcctggagacaccagattgaggctctatcctcacttggctacagagctgtggcaccggacttgagagggtatggtgacacagatgcgccagctgaggttacaagttacaccgttctccatgtggttggtgatttgattgggttgcttgatgttgttgctccgaatcaagagagtgtttttgttgtgggacatgattggggtgctttgatggcttggcatttggctttgtttagaccagatagagttaaagctttggttaacttgagtgttttgtttaatccaaggaatcccagtaggaaagttattgcgactttgaaggctgtttatggtgacgattattatattatcagattccaggagcctggagagattgaagctgagtttgcagagataggtacagagaaagttctcaaggaattcttaacctaccgcactccagctcctctctttttacctaaaggccaagggtttaatggaaagcctctggacactccagttgtcttaccctcttggttgtctgaagaagatgtcaagtactacaccagcaagtatgagcagaaaggctttactggaggattgaactattaccgaaatcttgaccggaactgggaacttaccgcaccatggactggagctcaaataaaagttccagtcaagtttatcgtgggtgatcaggacctcacctataattctctcggtgccaaggatcatatagacaagggcgggttcaaaagagacgttccatttctacatgacctagttgtaatggaaggtgtgggtcattttatcaatgaagagaaacctgaagagatcagtaagcacatttacgacttctttcaaaagctctag

SEQ ID NO: 49 - protein, 323 aa, Populus balsamifera subsp. trichocarpa
  misc_feature (1)..(323): Ceres ANNOT ID no. 1462513
  misc_feature (55)..(318): Pfam Name: Abhydrolase_1 Pfam Description: alpha/beta hydrolase fold
  misc_feature: SWISSPROT Homolog: HYES_HUMAN Epoxide hydrolase 2 (EC 3.3.2.3) (Soluble epoxide hydrolase) (SEH) (Epoxide hydratase) (Cytosolic epoxide hydrolase) (CEH) with e-value of 1.8e-19 and BLAST sequence identity of 42.2
  misc_feature: SWISSPROT Homolog: HYES_MOUSE Epoxide hydrolase 2 (EC 3.3.2.3) (Soluble epoxide hydrolase) (SEH) (Epoxide hydratase) (Cytosolic epoxide hydrolase) (CEH) with e-value of 4.9e-19 and BLAST sequence identity of 40.7
  misc_feature: SWISSPROT Homolog: HYES_PIG Epoxide hydrolase 2 (EC 3.3.2.3) (Soluble epoxide hydrolase) (SEH) (Epoxide hydratase) (Cytosolic epoxide hydrolase) (CEH) with e-value of 6.3e-19 and BLAST sequence identity of 38.9
  misc_feature: SWISSPROT Homolog: HYES_RAT Epoxide hydrolase 2 (EC 3.3.2.3) (Soluble epoxide hydrolase) (SEH) (Epoxide hydratase) (Cytosolic epoxide hydrolase) (CEH) with e-value of 8.1e-19 and BLAST sequence identity of 39.8
  misc_feature: SWISSPROT Homolog: HYES_CORS2 Soluble epoxide hydrolase (EC 3.3.2.3) (SEH) (Epoxide hydratase) (Cytosolic epoxide hydrolase) (cEH) with e-value of 3.2e-15 and BLAST sequence identity of 38.9
  misc_feature 4909:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(323): Functional Homolog of  Ceres CLONE ID no. 1355 at SEQ ID NO. 43 with e-value of 1.20E-39 and BLAST sequence identity of 67.2
MASSIEHRTINVNGINIHVAIKGPENAPVILFIHGFPQLWYSWRHQIEALSSLGYRAVAPDLRGYGDTDAPAEVTSYTVLHVVGDLIGLLDVVAPNQESVFVVGHDWGALMAWHLALFRPDRVKALVNLSVLFNPRNPSRKVIATLKAVYGDDYYIIRFQEPGEIEAEFAEIGTEKVLKEFLTYRTPAPLFLPKGQGFNGKPLDTPVVLPSWLSEEDVKYYTSKYEQKGFTGGLNYYRNLDRNWELTAPWTGAQIKVPVKFIVGDQDLTYNSLGAKDHIDKGGFKRDVPFLHDLVVMEGVGHFINEEKPEEISKHIYDFFQKL

SEQ ID NO: 50 - protein, 156 aa, Arabidopsis thaliana
  misc_feature (1)..(156): Ceres CLONE ID no. 1496
  misc_feature (1)..(74): Pfam Name: ubiquitin Pfam Description: Ubiquitin family
  misc_feature (101)..(147): Pfam Name: Ribosomal_S27 Pfam Description: Ribosomal protein S27a
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHTHKKVKLAVLQFYKVDGSGKVQRLKKECPSVSCGPGTFMASHFDRHYCGKCGTTYVFKKADEE

SEQ ID NO: 51 - DNA, 471 bp, Populus balsamifera subsp. trichocarpa
  misc_feature (1)..(471): Ceres ANNOT ID no. 1490668
  misc_feature 5139:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatcttcgtgaagaccttgacggggaagaccataaccctcgaggtcgaatcttcagatacaatcgacaatgtcaaagccaaaatccaagacaaggaaggcatcccaccagaccagcaacgtcttattttcgccggaaaacaactagaagatggacgtacacttgcagactacaacattcagaaggaatccacactccacttggtgcttcgcttgaggggtggagccaagaagagaaagaagaagacttacaccaagcccaagaagatcaagcacaagaagaagaaggtcaagcttgctgttcttcagttctataaagttgacgacagtggcaaagtccagaggctgagaaaagagtgcccaaatgccgaatgtggggctggtacttttatggctaatcattttgataggcattattgtggtaagtgcggcctcacctatgtttatcagaaggctggtggtgactaa

SEQ ID NO: 52 - protein, 156 aa, Populus balsamifera subsp. trichocarpa
  misc_feature (1)..(156): Ceres ANNOT ID no. 1490668
  misc_feature (1)..(74): Pfam Name: ubiquitin Pfam Description: Ubiquitin family
  misc_feature (101)..(147): Pfam Name: Ribosomal_S27 Pfam Description: Ribosomal protein S27a
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 5283:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(156): Functional Homolog of  Ceres CLONE ID no. 1496 at SEQ ID NO. 50 with e-value of 1.40E-73 and BLAST sequence identity of 92.1
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 53 - DNA, 471 bp, Populus balsamifera subsp. trichocarpa
  misc_feature (1)..(471): Ceres ANNOT ID no. 1474027
  misc_feature 5402:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatcttcgtgaaaaccttgacgggcaagacaataaccctcgaggttgagtcctcagacactattgacaatgtcaaagccaagattcaagacaaggaaggtatcccaccggaccaacagcgtctcattttcgctggaaaacagctcgaggacggccgtacacttgctgactacaacatccagaaggagtccactctccacttggtgcttcgcttgaggggtggagccaagaagagaaagaagaagacctacacgaagcccaagaagatcaagcacaagaagaagaaggtcaagctcgctgtactccagttctataaggttgatgatagcggcaaggtccagaggttgaggaaggagtgtcctaatgctgagtgtggtgctggtactttcatggctaatcattttgataggcactactgtggtaagtgtggccttacctatgtttaccagaaggctggtggtgattaa

SEQ ID NO: 54 - protein, 156 aa, Populus balsamifera subsp. trichocarpa; identical to SEQ ID NO: 52
  misc_feature (1)..(156): Ceres ANNOT ID no. 1474027
  misc_feature (1)..(74): Pfam Name: ubiquitin Pfam Description: Ubiquitin family
  misc_feature (101)..(147): Pfam Name: Ribosomal_S27 Pfam Description: Ribosomal protein S27a
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 5546:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(156): Functional Homolog of  Ceres CLONE ID no. 1496 at SEQ ID NO. 50 with e-value of 1.40E-73 and BLAST sequence identity of 92.1

SEQ ID NO: 55 - DNA, 471 bp, Populus balsamifera subsp. trichocarpa
  misc_feature (1)..(471): Ceres ANNOT ID no. 1497865
  misc_feature 5665:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatcttcgtgaaaaccttgacgggtaagacaataaccctcgaggttgagtcctcagacacgatcgacaatgtcaaagccaagattcaagacaaggagggcatcccaccagaccaacagcgtctcattttcgctggaaaacagctcgaggatggccgcacgctcgctgactacaacatccagaaggagtccactctccacttggttcttcggttgaggggtggtgccaagaagagaaagaagaagacctacaccaagcccaagaagatcaagcacaagaagaagaaggtcaagcttgctgtccttcagttctacaaggttgatgatagcggcaaagtccagagattgaggaaggagtgccctaatgctgagtgcggtgctggaactttcatggctaatcattttgataggcactactgtggtaagtgtgggcttacctatgtttaccagaaggctggtggtgattaa

SEQ ID NO: 56 - protein, 156 aa, Populus balsamifera subsp. trichocarpa; identical to SEQ ID NO: 52
  misc_feature (1)..(156): Ceres ANNOT ID no. 1497865
  misc_feature (1)..(74): Pfam Name: ubiquitin Pfam Description: Ubiquitin family
  misc_feature (101)..(147): Pfam Name: Ribosomal_S27 Pfam Description: Ribosomal protein S27a
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 5809:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(156): Functional Homolog of  Ceres CLONE ID no. 1496 at SEQ ID NO. 50 with e-value of 1.40E-73 and BLAST sequence identity of 92.1

SEQ ID NO: 57 - DNA, 471 bp, Populus balsamifera subsp. trichocarpa
  misc_feature (1)..(471): Ceres ANNOT ID no. 1471512
  misc_feature 5928:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatcttcgtgaagaccttgacgggaaagaccataaccctcgaggttgagtcatcagacacaatcgacaatgtcaaagccaagattcaggacaaggagggcatccctccagaccaacagcgtctcattttcgctgggaaacaactcgaggacggtcgcaccctcgctgactacaacatccagaaggagtccactctccacttggtgcttcgcctgaggggtggagccaagaagagaaagaagaagacctacaccaagcccaagaagatcaagcacaagaagaagaaggtcaagctcgctgtgctccagttctataaggttgatgatagcggcaaagtccagaggttgaggaaggagtgccctaatgctgagtgcggtgctgggactttcatggctaatcattttgataggcactactgtggtaagtgtgggcttacctatgtttaccagacggctggtggtgattaa

SEQ ID NO: 58 - protein, 156 aa, Populus balsamifera subsp. trichocarpa
  misc_feature (1)..(156): Ceres ANNOT ID no. 1471512
  misc_feature (1)..(74): Pfam Name: ubiquitin Pfam Description: Ubiquitin family
  misc_feature (101)..(147): Pfam Name: Ribosomal_S27 Pfam Description: Ribosomal protein S27a
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 6072:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(156): Functional Homolog of  Ceres CLONE ID no. 1496 at SEQ ID NO. 50 with e-value of 6.20E-73 and BLAST sequence identity of 91.5
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQTAGGD

SEQ ID NO: 59 - DNA, 465 bp, Populus balsamifera subsp. trichocarpa
  misc_feature (1)..(465): Ceres ANNOT ID no. 1443061
  misc_feature 6191:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatcttcgttaagactttgactggcaagaccataactctcgaggtcgagagtagcgacaccatcgacaacgtcaaagccaagattcaggacaaggaaggcatccctcctgatcagcaaagattgatttttgctggtaaacaattagaagatgggcgaactcttgctgattacaatatccagaaggagtcgacgcttcacttggttttgaggctcaggggaggaactatgatcaaggtgaagactctaactggaaaagaaattgaaatcgacattgaaccaaatgataccattgataggattaaggaacgggttgaggagaaagagggaattcctccagtgcagcaaaggcttatttatgctggcaagcagcttggagatgataagacagctcgtgactacaatattgagggtggctctgtgcttcatcttgttcttgctctgaggggtggttgtctttga

SEQ ID NO: 60 - protein, 154 aa, Populus balsamifera subsp. trichocarpa
  misc_feature (1)..(154): Ceres ANNOT ID no. 1443061
  misc_feature (1)..(74): Pfam Name: ubiquitin Pfam Description: Ubiquitin family
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 6329:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(154): Functional Homolog of  Ceres CLONE ID no. 1496 at SEQ ID NO. 50 with e-value of 9.70E-36 and BLAST sequence identity of 94.1
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPNDTIDRIKERVEEKEGIPPVQQRLIYAGKQLGDDKTARDYNIEGGSVLHLVLALRGGCL

SEQ ID NO: 61 - DNA, 474 bp, Populus balsamifera subsp. trichocarpa
  misc_feature (1)..(474): Ceres ANNOT ID no. 1504203
  misc_feature 6448:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatctttgttaagaccttgactggaaaaaccatcactcttgaggttgagagcagtgacaccattgacaacgtcaaatccaagattcaggacaaggaaggcatccctccagatcagcagaggttgatttttgctggtaagcaattggaagatggccggacacttgctgattataacattcagaaggagtcaacacttcacttggttttaaggctcagaggaggaactatgattaaagtcaagactctcactggaaaagaaattgagattgacattgaacctactgatactattgatcgtgttaaggaacgcgttgaggagaaggaaggaattccacctgtgcaacaaaggcttatttatgctgggaagcagcttggtgatgacaagactgctcgagactacaatattgagggtggctctgtgcttcatcttgtgcttgctctcaggggcggtttttgcttatatcattag

SEQ ID NO: 62 - protein, 157 aa, Populus balsamifera subsp. trichocarpa
  misc_feature (1)..(157): Ceres ANNOT ID no. 1504203
  misc_feature (1)..(74): Pfam Name: ubiquitin Pfam Description: Ubiquitin family
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 6586:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(157): Functional Homolog of  Ceres CLONE ID no. 1496 at SEQ ID NO. 50 with e-value of 1.99E-35 and BLAST sequence identity of 92.9
MQIFVKTLTGKTITLEVESSDTIDNVKSKIQDKEGIPPDQQRLIFAGKQLEDGRTLADYNIQKESTLHLVLRLRGGTMIKVKTLTGKEIEIDIEPTDTIDRVKERVEEKEGIPPVQQRLIYAGKQLGDDKTARDYNIEGGSVLHLVLALRGGFCLYH

SEQ ID NO: 63 - DNA, 465 bp, Populus balsamifera subsp. trichocarpa
  misc_feature (1)..(465): Ceres ANNOT ID no. 1505468
  misc_feature 6705:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgcagatcttcgtcaagacattgactggcaagaccataactctcgaggtcgagagtagcgacaccatcgacaacgtcaaagccaagattcttgacaaggaaggcatccctcctgatcagcaaagattgatttttgctggtaaacaattagaagatggacgtactcttgctgattacaacatccagaaggagtccactcttcacctggttttgaggcttaggggaggaactatgatcaaggtgaagactctcactggaaaagaaattgaaatcgacattgaaccaaatgataccattgataggatcaaggaacgggttgaggagaaagaaggaattcctcctgtgcagcaaaggcttatttatgctggcaagcagcttggagatgacaagacagctcgcgactacaatattgagggtggctctgtgcttcatcttgttcttgctctgaggggtggttgtctctga

SEQ ID NO: 64 - protein, 154 aa, Populus balsamifera subsp. trichocarpa
  misc_feature (1)..(154): Ceres ANNOT ID no. 1505468
  misc_feature (1)..(74): Pfam Name: ubiquitin Pfam Description: Ubiquitin family
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 6843:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(154): Functional Homolog of  Ceres CLONE ID no. 1496 at SEQ ID NO. 50 with e-value of 5.39E-35 and BLAST sequence identity of 92.9
MQIFVKTLTGKTITLEVESSDTIDNVKAKILDKEGIPPDQQRLIFAGKQLEDGRTLADYNIQKESTLHLVLRLRGGTMIKVKTLTGKEIEIDIEPNDTIDRIKERVEEKEGIPPVQQRLIYAGKQLGDDKTARDYNIEGGSVLHLVLALRGGCL

SEQ ID NO: 65 - DNA, 627 bp, Populus balsamifera subsp. trichocarpa
  misc_feature (1)..(627): Ceres ANNOT ID no. 1452369
  misc_feature 6962:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgaaaagaggggtggatgatgcgtcttttgcccatgttattggaaaaaaaaactccgctcatgagctagacctctttcatgggcttagcgggttaggtttttttatagccagacatagaaaatacaagtttagtaacacagaagagaagaagaagaagacgatgcagatcttcgtcaagacattgactggcaagaccataactctcgaggtcgagagtagcgacaccatcgacaacgtcaaagccaagattcttgacaaggaaggcatccctcctgatcagcaaagattgatttttgctggtaaacaattagaagatggacgtactcttgctgattacaacatccagaaggagtccactcttcacctggttttgaggcttaggggaggaactatgatcaaggtgaagactctcactggaaaagaaattgaaatcgacattgaaccaaatgataccattgataggatcaaggaacgggttgaggagaaagaaggaattcctcctgtgcagcaaaggcttatttatgctggcaagcagcttggagatgacaagacagctcgcgactacaatattgagggtggctctgtgcttcatcttgttcttgctctgaggggtggttgtctctga

SEQ ID NO: 66 - protein, 154 aa, Populus balsamifera subsp. trichocarpa; identical to SEQ ID NO: 64
  misc_feature (1)..(154): Ceres ANNOT ID no. 1452369
  misc_feature (1)..(74): Pfam Name: ubiquitin Pfam Description: Ubiquitin family
  misc_feature: SWISSPROT Homolog: R27AA_ARATH 40S ribosomal protein S27a-1 with e-value of 2.1e-41 and BLAST sequence identity of 100.0
  misc_feature: SWISSPROT Homolog: UBIQ_ARATH Ubiquitin with e-value of 3.0e-35 and BLAST sequence identity of 100.0
  misc_feature: SWISSPROT Homolog: UBIQ_ASPOF Ubiquitin with e-value of 3.0e-35 and BLAST sequence identity of 100.0
  misc_feature: SWISSPROT Homolog: UBIQ_AVEFA Ubiquitin with e-value of 3.0e-35 and BLAST sequence identity of 100.0
  misc_feature: SWISSPROT Homolog: UBIQ_AVESA Ubiquitin with e-value of 3.0e-35 and BLAST sequence identity of 100.0
  misc_feature 7106:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(154): Functional Homolog of  Ceres CLONE ID no. 1496 at SEQ ID NO. 50 with e-value of 5.39E-35 and BLAST sequence identity of 92.9

SEQ ID NO: 67 - protein, 207 aa, Arabidopsis thaliana
  misc_feature (1)..(207): Ceres CLONE ID no. 1610
  misc_feature (54)..(207): Pfam Name: Ribosomal_S7 Pfam Description: Ribosomal protein S7p/S5e
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
MATAADVDAEIQQALTNEVKLFNRWTYDDVTVTDISLVDYIGVQAAKHATFVPHTAGRYSVKRFRKAQCPIVERLTNSLMMHGRNNGKKLMAVRIIKHAMEIIHLLSDLNPIQVIIDAIVNSGPREDATRIGSAGVVRRQAVDISPLRRVNQAIFLITTGAREAAFRNIKTIAECLADELINAAKGSSNSYAIKKKDEIERVAKANR

SEQ ID NO: 68 - DNA, 627 bp, Populus balsamifera subsp. trichocarpa
  misc_feature (1)..(627): Ceres ANNOT ID no. 1454586
  misc_feature 7334:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
atggcagaagcagctgtggtggctccaccaaacccggaagttattcagccacaccacgatgtcaagctcttcaatcgctggactttcgaggatattaccgtaaatgacatttctcttgctgactatattggagtccaagctaagcatgctacatatgtcccacacacagctgggagatactctgtcaagcgtttcaggaaggcccaatgcccaattgttgaaaggcttacaaactcactgcagatgcacggcagaaacaacggaaagaaactgaaggctgtgaccattatcaaacatgctatggagatcattcaccttttgactgaccagaacccagtccaagttattgttgatgctgttgtcaacagtgggcctcgtgaagatgctactcgtattggctcagctggtgttgtcaggcgtcaggctgttgatatttcacctcttagacgtgtaaaccaagccttgtatctccttaccactggtgctcgtgaggctgcttttaggaacatcaagaccatagctgaatgcttggctgatgaacttatcaatgcagccaagggttcctcaaacagctatgccatcaagaagaaggatgagattgaaagagttgccaaggccaaccgttga

SEQ ID NO: 69 - protein, 208 aa, Populus balsamifera subsp. trichocarpa
  misc_feature (1)..(208): Ceres ANNOT ID no. 1454586
  misc_feature (55)..(208): Pfam Name: Ribosomal_S7 Pfam Description: Ribosomal protein S7p/S5e
  misc_feature: SWISSPROT Homolog: RS5B_ARATH 40S ribosomal protein S5-2 with e-value of 2.4e-104 and BLAST sequence identity of 99.5
  misc_feature: SWISSPROT Homolog: RS5A_ARATH 40S ribosomal protein S5-1 with e-value of 4.2e-100 and BLAST sequence identity of 94.2
  misc_feature: SWISSPROT Homolog: RS5_CICAR 40S ribosomal protein S5 (Fragment) with e-value of 1.7e-89 and BLAST sequence identity of 90.5
  misc_feature: SWISSPROT Homolog: RS5_BOVIN 40S ribosomal protein S5 with e-value of 3.6e-78 and BLAST sequence identity of 77.3
  misc_feature: SWISSPROT Homolog: RS5_HUMAN 40S ribosomal protein S5 with e-value of 3.6e-78 and BLAST sequence identity of 77.3
  misc_feature 7465:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(208): Functional Homolog of  Ceres CLONE ID no. 1610 at SEQ ID NO. 67 with e-value of 1.00E-88 and BLAST sequence identity of 85.7
MAEAAVVAPPNPEVIQPHHDVKLFNRWTFEDITVNDISLADYIGVQAKHATYVPHTAGRYSVKRFRKAQCPIVERLTNSLQMHGRNNGKKLKAVTIIKHAMEIIHLLTDQNPVQVIVDAVVNSGPREDATRIGSAGVVRRQAVDISPLRRVNQALYLLTTGAREAAFRNIKTIAECLADELINAAKGSSNSYAIKKKDEIERVAKANR

SEQ ID NO: 70 - DNA, 624 bp, Populus balsamifera subsp. trichocarpa
  misc_feature (1)..(624): Ceres ANNOT ID no. 1475043
  misc_feature 7582:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
atggcagaagctgtggtggctccaccaaacccagaagctaaccaggctatctacgatgtcaagctcttcaatcgctggtctttcgatgatattaatgtaaatgacatttctcttgctgactatgttggagtccaagttaagcacgcaacatatgtcccccatacagctggaagatactctgtcaagcgtttcaggaaggcccagtgcccaattgttgagaggctcacaaactctcttcagatgcacggcagaaacaatgggaaaaaattgaaggctgtgaccattgtcaaacatgccatggagatcattcatcttttgactgatcagaacccaatccaagttattgttgatgctgtggtcaacagtgggcctcgtgaagatgccactcgtattggctcagctggtgttgtcagacgtcaggctgttgatatttcacctcttaggcgtgtaaaccaggccttgtatctccttaccactggtgctcgtgaggcagctttcaggaacatcaagaccatagctgaatgcttggctgatgaacttatcaatgcagccaagggttcctcaaacagctatgccattaagaagaaagatgagattgaaagagttgctaaggccaaccgttga

SEQ ID NO: 71 - protein, 207 aa, Populus balsamifera subsp. trichocarpa
  misc_feature (1)..(207): Ceres ANNOT ID no. 1475043
  misc_feature (54)..(207): Pfam Name: Ribosomal_S7 Pfam Description: Ribosomal protein S7p/S5e
  misc_feature: SWISSPROT Homolog: RS5B_ARATH 40S ribosomal protein S5-2 with e-value of 2.4e-104 and BLAST sequence identity of 99.5
  misc_feature: SWISSPROT Homolog: RS5A_ARATH 40S ribosomal protein S5-1 with e-value of 4.2e-100 and BLAST sequence identity of 94.2
  misc_feature: SWISSPROT Homolog: RS5_CICAR 40S ribosomal protein S5 (Fragment) with e-value of 1.7e-89 and BLAST sequence identity of 90.5
  misc_feature: SWISSPROT Homolog: RS5_BOVIN 40S ribosomal protein S5 with e-value of 3.6e-78 and BLAST sequence identity of 77.3
  misc_feature: SWISSPROT Homolog: RS5_HUMAN 40S ribosomal protein S5 with e-value of 3.6e-78 and BLAST sequence identity of 77.3
  misc_feature 7713:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(207): Functional Homolog of  Ceres CLONE ID no. 1610 at SEQ ID NO. 67 with e-value of 3.39E-88 and BLAST sequence identity of 84.8
MAEAVVAPPNPEANQAIYDVKLFNRWSFDDINVNDISLADYVGVQVKHATYVPHTAGRYSVKRFRKAQCPIVERLTNSLQMHGRNNGKKLKAVTIVKHAMEIIHLLTDQNPIQVIVDAVVNSGPREDATRIGSAGVVRRQAVDISPLRRVNQALYLLTTGAREAAFRNIKTIAECLADELINAAKGSSNSYAIKKKDEIERVAKANR

SEQ ID NO: 72 - DNA, 579 bp, Populus balsamifera subsp. trichocarpa
  misc_feature (1)..(579): Ceres ANNOT ID no. 1507756
  misc_feature 7827:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
atggcagaagcagctgtggtggctccaccaaacccggaagttattcagccacaccacgatgtcaagctcttcaatcgctggactttcgaggatattaccgtaaatgacatttctcttgctgactatattggagtccaagctaagcatgctacatatgtcccacacacagctgggagatactctgtcaagcgtttcaggaaggcccaatgcccaattgttgaaaggcttacaaactcactgcagatgcacggcagaaacaacggaaagaaactgaaggctgtgaccattatcaaacatgctatggagatcattcaccttttgactgaccagaacccagtccaagttattgttgatgctgttgtcaacaggcgtcaggctgttgatatttcacctcttagacgtgtaaaccaagccttgtatctccttaccactggtgctcgtgaggctgcttttaggaacatcaagaccatagctgaatgcttggctgatgaacttatcaatgcagccaagggttcctcaaacagctatgccatcaagaagaaggatgagattgaaagagttgccaaggccaaccgttga

SEQ ID NO: 73 - protein, 192 aa, Populus balsamifera subsp. trichocarpa
  misc_feature (1)..(192): Ceres ANNOT ID no. 1507756
  misc_feature (123)..(192): Pfam Name: Ribosomal_S7 Pfam Description: Ribosomal protein S7p/S5e
  misc_feature: SWISSPROT Homolog: RS5B_ARATH 40S ribosomal protein S5-2 with e-value of 2.4e-104 and BLAST sequence identity of 99.5
  misc_feature: SWISSPROT Homolog: RS5A_ARATH 40S ribosomal protein S5-1 with e-value of 4.2e-100 and BLAST sequence identity of 94.2
  misc_feature: SWISSPROT Homolog: RS5_CICAR 40S ribosomal protein S5 (Fragment) with e-value of 1.7e-89 and BLAST sequence identity of 90.5
  misc_feature: SWISSPROT Homolog: RS5_BOVIN 40S ribosomal protein S5 with e-value of 3.6e-78 and BLAST sequence identity of 77.3
  misc_feature: SWISSPROT Homolog: RS5_HUMAN 40S ribosomal protein S5 with e-value of 3.6e-78 and BLAST sequence identity of 77.3
  misc_feature 7956:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(192): Functional Homolog of  Ceres CLONE ID no. 1610 at SEQ ID NO. 67 with e-value of 3.19E-76 and BLAST sequence identity of 84.5
MAEAAVVAPPNPEVIQPHHDVKLFNRWTFEDITVNDISLADYIGVQAKHATYVPHTAGRYSVKRFRKAQCPIVERLTNSLQMHGRNNGKKLKAVTIIKHAMEIIHLLTDQNPVQVIVDAVVNRRQAVDISPLRRVNQALYLLTTGAREAAFRNIKTIAECLADELINAAKGSSNSYAIKKKDEIERVAKANR

SEQ ID NO: 74 - DNA, 564 bp, Populus balsamifera subsp. trichocarpa
  misc_feature (1)..(564): Ceres ANNOT ID no. 1469708
  misc_feature 8070:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
atggcacctgctcctcatcaggattatgatgcatacaaaaaggagcttccgatctttgatgtgaagctgttcaacaaatggacctttgaacatttgcatgcaagtctagaggattattttaggggtgatgcaaccaagcatgctacttatataccgcttacgggcggaaggtactcggcaaagcggttcagcaaggctcaatgccccattgtgggaaggttggtaaacgcattgatgcatgatgctcggacgcaacaatggcaagaagttgatggcagtcaggattgtgaagcatatatgctatggagattatcaaccttcttactgcccaaaaccccgttcaatggtccaagagaagatgcgacacgaattggcgcagcaggtgtggttaggaggcaagctgttgatgtctctccacttcgccgtgtgaaccaagcaatatatcttcttgtcactgctgaatgtttggctgatgaattgattaatgctgccaagggatctactaacagctatgctatcaagaaaaaggatgagatcaaaagagttgccaaggctaatcgttga

SEQ ID NO: 75 - protein, 187 aa, Populus balsamifera subsp. trichocarpa
  misc_feature (1)..(187): Ceres ANNOT ID no. 1469708
  misc_feature (53)..(80): Pfam Name: Ribosomal_S7 Pfam Description: Ribosomal protein S7p/S5e
  misc_feature: SWISSPROT Homolog: RS5B_ARATH 40S ribosomal protein S5-2 with e-value of 2.4e-104 and BLAST sequence identity of 99.5
  misc_feature: SWISSPROT Homolog: RS5A_ARATH 40S ribosomal protein S5-1 with e-value of 4.2e-100 and BLAST sequence identity of 94.2
  misc_feature: SWISSPROT Homolog: RS5_CICAR 40S ribosomal protein S5 (Fragment) with e-value of 1.7e-89 and BLAST sequence identity of 90.5
  misc_feature: SWISSPROT Homolog: RS5_BOVIN 40S ribosomal protein S5 with e-value of 3.6e-78 and BLAST sequence identity of 77.3
  misc_feature: SWISSPROT Homolog: RS5_HUMAN 40S ribosomal protein S5 with e-value of 3.6e-78 and BLAST sequence identity of 77.3
  misc_feature 8199:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(187): Functional Homolog of  Ceres CLONE ID no. 1610 at SEQ ID NO. 67 with e-value of 2.29E-43 and BLAST sequence identity of 61.1
MAPAPHQDYDAYKKELPIFDVKLFNKWTFEHLHASLEDYFRGDATKHATYIPLTGGRYSAKRFSKAQCPIVGRLVNALMHDARTQQWQEVDGSQDCEAYMLWRLSTFLLPKTPFNGPREDATRIGAAGVVRRQAVDVSPLRRVNQAIYLLVTAECLADELINAAKGSTNSYAIKKKDEIKRVAKANR

SEQ ID NO: 76 - protein, 344 aa, Arabidopsis thaliana
  misc_feature (1)..(344): Ceres CLONE ID no. 1959
  misc_feature (211)..(262): Pfam Name: Myb_DNA-binding Pfam Description: Myb-like DNA-binding domain
MMMFKSGDMDYTQKMKRCHEYVEALEEEQKKIQVFQRELPLCLELVTQAIESCRKELSESSEHVGGQSECSERTTSECGGAVFEEFMPIKWSSASSDETDKDEEAEKTEMMTNENNDGDKKKSDWLRSVQLWNQSPDPQPNNKKPMVIEVKRSAGAFQPFQKEKPKAADSQPLIKAITPTSTTTTSSTAETVGGGKEFEEQKQSHSNRKQRRCWSPELHRRFLHALQQLGGSHVATPKQIRDLMKVDGLTNDEVKSHLQKYRLHTRRPATPVVRTGGENPQQRQFMVMEGIWVPSHDTTNNRVYAPVASQPPQSSTSGERSNRGCKSPATSSTTTHTPHLLPLS

SEQ ID NO: 77 - DNA, 1173 bp, Populus balsamifera subsp. trichocarpa
  misc_feature (1)..(1173): Ceres ANNOT ID no. 1517331
  misc_feature 8397:<222: Transcription Factor
atggattttgcagagaaaatgcaacggtgtcatgaatatgtagaagcattagaagaagaaagacgcaagattcaagtgtttgaacgcgagcttcctttgtgtctagagcttgttactcaagcgatcgaggcatgtaagagggagttatcagggacaactgaggatcataatatgcatggacaatcggaatgctctgagcagacatcgagtgaagggcctgttttggaggaatttattcctattaagagaactcactcttccgatgacgaagagaatgataataatcatgatgatgatgatcatcaagaacaacaatcacagaatgataataagagaaacaagagtaacagcagcatcagcaacaacgatcacaagaagaaatccgattggcttagatctgtccagttgtggaatcaatccccagatccacctcaaaaacaggatttgccaagaaaggcagcggtgacagaagtgaaaagaaatggggctggaggtgcattccaaccatttcacagagagaaaagtgttgggaagagtagtaatcaggcaatctctaaggcaccgccttcagtgccggcttctgcaacaagttcaatagcgggtgctgtgacaggaggaactggtggtggaggcaataaaaaggaagacaaagaaaagggaaatcaaagaaagcaaagaagatgttggtcacctgagctgcatagaaggttcttacattctcttcaacagcttggtggctcacatgctgcaactccaaagcaaataagggagctcatgaaggtggatggacttactaatgatgaagttaagagtcatttacagaaataccgtttgcatacaagaagaccaagccctacaatccacactaacagcagtcaacaggcaccacaatttgtagttgttggtggcatctgggttccaccgactgagtatgcagcagtggctgccacaacaacagcaggagaaacttccactatttccgcggccaatggaatttatgcaccaatagccgcaccaccacccgctgtcccacaaaatcgacagcataaacaatctgagcactcgcagtcagaaggtaggggcagtcatggtgaaagggggggtgctcattctaataattcccccgctacatcttcctccacgcatactaccacgacatccccagtgttttga

SEQ ID NO: 78 - protein, 390 aa, Populus balsamifera subsp. trichocarpa
  misc_feature (1)..(390): Ceres ANNOT ID no. 1517331
  misc_feature (226)..(277): Pfam Name: Myb_DNA-binding Pfam Description: Myb-like DNA-binding domain
  misc_feature: SWISSPROT Homolog: ARR18_ARATH Two-component response regulator ARR18 with e-value of 5.5e-11 and BLAST sequence identity of 36.4
  misc_feature: SWISSPROT Homolog: ARR11_ARATH Two-component response regulator ARR11 (Receiver-like protein 3) with e-value of 2.4e-10 and BLAST sequence identity of 50.7
  misc_feature: SWISSPROT Homolog: ARR19_ARATH Putative two-component response regulator ARR19 with e-value of 2.1e-09 and BLAST sequence identity of 32.8
  misc_feature: SWISSPROT Homolog: MYBF_ARATH Putative Myb family transcription factor At1g14600 with e-value of 2.9e-09 and BLAST sequence identity of 59.2
  misc_feature: SWISSPROT Homolog: ARR1_ARATH Two-component response regulator ARR1 with e-value of 3.1e-09 and BLAST sequence identity of 46.7
  misc_feature 8497:<222: Transcription Factor
  misc_feature (1)..(390): Functional Homolog of  Ceres CLONE ID no. 1959 at SEQ ID NO. 76 with e-value of 2.40E-87 and BLAST sequence identity of 63.0
MDFAEKMQRCHEYVEALEEERRKIQVFERELPLCLELVTQAIEACKRELSGTTEDHNMHGQSECSEQTSSEGPVLEEFIPIKRTHSSDDEENDNNHDDDDHQEQQSQNDNKRNKSNSSISNNDHKKKSDWLRSVQLWNQSPDPPQKQDLPRKAAVTEVKRNGAGGAFQPFHREKSVGKSSNQAISKAPPSVPASATSSIAGAVTGGTGGGGNKKEDKEKGNQRKQRRCWSPELHRRFLHSLQQLGGSHAATPKQIRELMKVDGLTNDEVKSHLQKYRLHTRRPSPTIHTNSSQQAPQFVVVGGIWVPPTEYAAVAATTTAGETSTISAANGIYAPIAAPPPAVPQNRQHKQSEHSQSEGRGSHGERGGAHSNNSPATSSSTHTTTTSPVF

SEQ ID NO: 79 - DNA, 1146 bp, Populus balsamifera subsp. trichocarpa
  misc_feature (1)..(1146): Ceres ANNOT ID no. 1458878
  misc_feature 8598:<222: Transcription Factor
atggattttgctgagaaaatacaaaggtgtggtgaatatgtagaagctttagaagaagaaagacgcaagattcaagtctttgaacgcgagcttcctttgtgtttagagcttgttactcaagcgattgaggcatgtaagagggagttatcagggacaactacggagtataacatgcatggacaatcagaatgctctgagcagacatcaagtgaagggccggttttagaggaatttattcctatcaagagaactcactcttatgatgaaaatgataatgaaaatgacgatcatcaagagcagcaatcacatgataatagtaagagaaacaagactagcatcagcagcggtaacaatgatcacaagaagaaatctgattggcttagatctgtccagttgtggaatcactccccggatctaccacaaaaacaggatctgccaagaaaggcagcggtgacagaagtgaaaagaaatggggctggaggtgcatttcagcccttccacagggagaaaagtatagggaagactagtaatcaggcaattgccaaggcaccaacttcagtgcccgcttccacaacaagttcaacagcggttgttgcgacaggagggattggtggtggaagcaataaaaaggaagacatagatgggggaaatcaaagaaagcaaagaaggtgttggtcacctgagctgcatagaaggttcttacatgctcttcgacagcttggtggttcacatgctgcaacaccaaagcaaattagggagctaatgaaggtggatggacttactaatgatgaagtcaagagtcatttacagaaataccgtctgcatacaagaagaccaagccctactatccacaataacagcaatcaacaggcaccacaatttgtagttgttggtggtatctgggttccaccacccgaatatgcagcagtggctgccacaaccgcctcagcggaaacttcccctatttccgctgccaacggaatctatgcaccaatagctgcagcaccacccacagtccctcaaaagccacaccatgtacaatatgagcccttgcaatcagaaggagggggcagtcatagtgaagggggtgctcattctaataattcccctgctacatcttcctccacacatactacaacaacgtaa

SEQ ID NO: 80 - protein, 381 aa, Populus balsamifera subsp. trichocarpa
  misc_feature (1)..(381): Ceres ANNOT ID no. 1458878
  misc_feature (222)..(273): Pfam Name: Myb_DNA-binding Pfam Description: Myb-like DNA-binding domain
  misc_feature: SWISSPROT Homolog: ARR18_ARATH Two-component response regulator ARR18 with e-value of 5.5e-11 and BLAST sequence identity of 36.4
  misc_feature: SWISSPROT Homolog: ARR11_ARATH Two-component response regulator ARR11 (Receiver-like protein 3) with e-value of 2.4e-10 and BLAST sequence identity of 50.7
  misc_feature: SWISSPROT Homolog: ARR19_ARATH Putative two-component response regulator ARR19 with e-value of 2.1e-09 and BLAST sequence identity of 32.8
  misc_feature: SWISSPROT Homolog: MYBF_ARATH Putative Myb family transcription factor At1g14600 with e-value of 2.9e-09 and BLAST sequence identity of 59.2
  misc_feature: SWISSPROT Homolog: ARR1_ARATH Two-component response regulator ARR1 with e-value of 3.1e-09 and BLAST sequence identity of 46.7
  misc_feature 8698:<222: Transcription Factor
  misc_feature (1)..(381): Functional Homolog of  Ceres CLONE ID no. 1959 at SEQ ID NO. 76 with e-value of 1.09E-84 and BLAST sequence identity of 63.3
MDFAEKIQRCGEYVEALEEERRKIQVFERELPLCLELVTQAIEACKRELSGTTTEYNMHGQSECSEQTSSEGPVLEEFIPIKRTHSYDENDNENDDHQEQQSHDNSKRNKTSISSGNNDHKKKSDWLRSVQLWNHSPDLPQKQDLPRKAAVTEVKRNGAGGAFQPFHREKSIGKTSNQAIAKAPTSVPASTTSSTAVVATGGIGGGSNKKEDIDGGNQRKQRRCWSPELHRRFLHALRQLGGSHAATPKQIRELMKVDGLTNDEVKSHLQKYRLHTRRPSPTIHNNSNQQAPQFVVVGGIWVPPPEYAAVAATTASAETSPISAANGIYAPIAAAPPTVPQKPHHVQYEPLQSEGGGSHSEGGAHSNNSPATSSSTHTTTT

SEQ ID NO: 81 - protein, 138 aa, Arabidopsis thaliana
  misc_feature (1)..(138): Ceres CLONE ID no. 1994
  misc_feature: Utility: Mannitol Useful for making plants with enhanced tolerance to drought
  misc_feature: Phenotype: WHOLE PLANT - Mannitol Useful for making plants with enhanced tolerance to drought
MATVEVEQVTPVAVENVEVPTKTVEETVVETEVTQQPEESVPAVTEQKSEAPIVETNEEVVVEEAEKKDEETEKKTEEKDEKTEVITETPVVEEEEKKAEEVTETPAVVEEEKKTEVVEEKQTEVAAAEEVAVEKAEE

SEQ ID NO: 82 - DNA, 453 bp, Populus balsamifera subsp. trichocarpa
  misc_feature (1)..(453): Ceres ANNOT ID no. 1506401
  misc_feature: Utility: Mannitol Useful for making plants with enhanced tolerance to drought
  misc_feature 8857:<222: Transcription Factor
  misc_feature: Phenotype: WHOLE PLANT - Mannitol Useful for making plants with enhanced tolerance to drought
atggccactgttgaggttgaagctgctccatcaattcctgagaccgaggtacctaaggtgaccaagactgaggagacaacaacagaaactgcaccacctgcctctgagccagtagctgaagagccaacagaagcagcacccgctgatgctccagccgcagaacctgaagctgaacctgcagttgaggttgaaaccaaggaggttgtagaagaaccagcaaaaactgagcctgaagaggttgcagccccagcagcagaagaaactcctgaggacaagcctgaagagactgttgctgaggagactgttgctaaggagactgttgtcgaagagactaaagaggaggcagcaccggctcctgttgaggaagagaagccagcagaagaagagaagccagctgagacaccagctgcagagacaaccaccacagaagttcctgtggagactaatgagtga

SEQ ID NO: 83 - protein, 150 aa, Populus balsamifera subsp. trichocarpa
  misc_feature (1)..(150): Ceres ANNOT ID no. 1506401
  misc_feature: SWISSPROT Homolog: IE68_SHV21 Immediate-early protein with e-value of 2.7e-11 and BLAST sequence identity of 38.8
  misc_feature: SWISSPROT Homolog: PATL1_ARATH Patellin-1 with e-value of 3.1e-11 and BLAST sequence identity of 43.3
  misc_feature: SWISSPROT Homolog: ALL5_HEVBR Major latex allergen Hev b 5 with e-value of 1.9e-10 and BLAST sequence identity of 35.9
  misc_feature: SWISSPROT Homolog: IF2_AQUAE Translation initiation factor IF-2 with e-value of 3.7e-10 and BLAST sequence identity of 37.4
  misc_feature: SWISSPROT Homolog: SMI1_CANGA KNR4/SMI1 homolog with e-value of 6.3e-10 and BLAST sequence identity of 35.7
  misc_feature: Utility: Mannitol Useful for making plants with enhanced tolerance to drought
  misc_feature 8939:<222: Transcription Factor
  misc_feature: Phenotype: WHOLE PLANT - Mannitol Useful for making plants with enhanced tolerance to drought
  misc_feature (1)..(150): Functional Homolog of  Ceres CLONE ID no. 1994 at SEQ ID NO. 81 with e-value of 5.90E-13 and BLAST sequence identity of 50.4
MATVEVEAAPSIPETEVPKVTKTEETTTETAPPASEPVAEEPTEAAPADAPAAEPEAEPAVEVETKEVVEEPAKTEPEEVAAPAAEETPEDKPEETVAEETVAKETVVEETKEEAAPAPVEEEKPAEEEKPAETPAAETTTTEVPVETNE

SEQ ID NO: 84 - protein, 253 aa, Arabidopsis thaliana
  misc_feature (1)..(253): Ceres CLONE ID no. 2036
  misc_feature (9)..(143): Pfam Name: Cyclin_N Pfam Description: Cyclin, N-terminal domain
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: FLOWER - Other Useful for making ornamental plants with modified flowers
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 85 - DNA, 756 bp, Populus balsamifera subsp. trichocarpa
  misc_feature (1)..(756): Ceres ANNOT ID no. 1526068
  misc_feature 9092:<222: Transcription Factor
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: FLOWER - Other Useful for making ornamental plants with modified flowers
atggctgccaatttctggacctcctctcactacaagcagctttttgaccaagaagaagtagatgtggtgcacccactagacaaagaaaagggcataactcttgaagatttcaagatcatcaagacgcagatggcaatttatataggcattttggctcaacaagttaaagtgaggcaaagggttgtcgctactgcagttgcatatatgaggcgtgtctataccagaaagagcatgtcagaatacgatccacgtcttgcagccccaacttgcttgtatttggcatcaaaagcagaagagagcacaattcaagccagagttctttcattttacataaaaaaattatattctgatgacaagtatagatatgagatcaaagagatacttgagatggaaatgaagattttggaagctcttaacttttatctagttgtatttcatccttatcgttcattgcctcaatttttgcaggatgctggcataaatgatataaacatgactcaattgacatggggacttgtcaacgacacgtacaagatggatttgattcttgtacatcccccacatattattgctttagcctgcatatacattgctagcgtgtatagagaaaaagattcgacagcatggtttgaagagctccgtgtagatttgaatgtggtgaaaaatatttcaatggagatgttatatttttatgaaagccatagattgattacagaggagagaattactgctgctttcaacaaactgaaaccgtaa

SEQ ID NO: 86 - protein, 251 aa, Populus balsamifera subsp. trichocarpa
  misc_feature (1)..(251): Ceres ANNOT ID no. 1526068
  misc_feature (9)..(143): Pfam Name: Cyclin_N Pfam Description: Cyclin, N-terminal domain
  misc_feature: SWISSPROT Homolog: CCNC_ORYSA G1/S-specific cyclin C-type with e-value of 1.5e-88 and BLAST sequence identity of 65.9
  misc_feature: SWISSPROT Homolog: CCNC_CHICK Cyclin-C with e-value of 9.6e-46 and BLAST sequence identity of 41.2
  misc_feature: SWISSPROT Homolog: CCNC_HUMAN Cyclin-C with e-value of 9.6e-46 and BLAST sequence identity of 41.2
  misc_feature: SWISSPROT Homolog: CCNC_RAT Cyclin-C with e-value of 1.6e-45 and BLAST sequence identity of 40.8
  misc_feature: SWISSPROT Homolog: CCNC_MOUSE Cyclin-C with e-value of 8.7e-45 and BLAST sequence identity of 40.8
  misc_feature 9198:<222: Transcription Factor
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: FLOWER - Other Useful for making ornamental plants with modified flowers
  misc_feature (1)..(251): Functional Homolog of  Ceres CLONE ID no. 2036 at SEQ ID NO. 84 with e-value of 2.20E-102 and BLAST sequence identity of 73.8
MAANFWTSSHYKQLFDQEEVDVVHPLDKEKGITLEDFKIIKTQMAIYIGILAQQVKVRQRVVATAVAYMRRVYTRKSMSEYDPRLAAPTCLYLASKAEESTIQARVLSFYIKKLYSDDKYRYEIKEILEMEMKILEALNFYLVVFHPYRSLPQFLQDAGINDINMTQLTWGLVNDTYKMDLILVHPPHIIALACIYIASVYREKDSTAWFEELRVDLNVVKNISMEMLYFYESHRLITEERITAAFNKLKP

SEQ ID NO: 87 - protein, 106 aa, Arabidopsis thaliana
  misc_feature (1)..(106): Ceres CLONE ID no. 2083
  misc_feature: Utility: ABA Useful for making plants with enhanced tolerance to drought
  misc_feature: Utility: Cold Growth Useful for making plants with increased tolerance to cold stress
  misc_feature: Phenotype: WHOLE PLANT - ABA Useful for making plants with enhanced tolerance to drought
  misc_feature: Phenotype: WHOLE PLANT - Cold Growth Useful for making plants with increased tolerance to cold stress
MEFREKLLKFKLQIVFAFVLSLLTVALVAYSPGFLTVLSYFWPLFLSTALFLAAVFFFARTSDLPASSTIIPGEGAGLKVAAEGILDYVVGGQHEDILFDSFTKLD

SEQ ID NO: 88 - DNA, 288 bp, Populus balsamifera subsp. trichocarpa
  misc_feature (1)..(288): Ceres ANNOT ID no. 1441581
  misc_feature: Utility: ABA Useful for making plants with enhanced tolerance to drought
  misc_feature: Utility: Cold Growth Useful for making plants with increased tolerance to cold stress
  misc_feature 9367:<222: Transcription Factor
  misc_feature: Phenotype: WHOLE PLANT - ABA Useful for making plants with enhanced tolerance to drought
  misc_feature: Phenotype: WHOLE PLANT - Cold Growth Useful for making plants with increased tolerance to cold stress
atggagatcaaagaaaagctactaaattacaagtatcatatcttcttcaccctcgttttctctcttattcttgtctctataatcgttgttgcgccgagtttcctcacaattttggcctacttttgtcctctacttctctccacagctctctttcttggcgctgtcatcttcttcggcaagacctctttaccgggcaccgactcttccagtgacaaagccgccgaggggctcttggattatgttgcaggacagcccgagcaagcggtggaaagtttcaagtcggattag

SEQ ID NO: 89 - protein, 95 aa, Populus balsamifera subsp. trichocarpa
  misc_feature (1)..(95): Ceres ANNOT ID no. 1441581
  misc_feature: Utility: ABA Useful for making plants with enhanced tolerance to drought
  misc_feature: Utility: Cold Growth Useful for making plants with increased tolerance to cold stress
  misc_feature 9421:<222: Transcription Factor
  misc_feature: Phenotype: WHOLE PLANT - ABA Useful for making plants with enhanced tolerance to drought
  misc_feature: Phenotype: WHOLE PLANT - Cold Growth Useful for making plants with increased tolerance to cold stress
  misc_feature (1)..(95): Functional Homolog of  Ceres CLONE ID no. 2083 at SEQ ID NO. 87 with e-value of 2.30E-18 and BLAST sequence identity of 54.3
MEIKEKLLNYKYHIFFTLVFSLILVSIIVVAPSFLTILAYFCPLLLSTALFLGAVIFFGKTSLPGTDSSSDKAAEGLLDYVAGQPEQAVESFKSD

SEQ ID NO: 90 - protein, 223 aa, Arabidopsis thaliana
  misc_feature (1)..(223): Ceres CLONE ID no. 2121
  misc_feature (20)..(214): Pfam Name: EBP Pfam Description: Emopamil binding protein
  misc_feature: Utility: Metabolic Profiling Useful for making plants with enhanced metabolite accumulation
  misc_feature: Phenotype: WHOLE PLANT - Metabolic Profiling Useful for making plants with enhanced metabolite accumulation
MKELAHPYVPRDLNLPGYVPISMSMSSIVSIYLGSSLLVVSLVWLLFGRKKAKLDKLLMCWWTFTGLTHVILEGYFVFSPEFFKDNTSAYLAEVWKEYSKGDSRYVGRDSAVVSVEGITAVIVGPASLLAIYAIAKEKSYSYVLQLAISVCQLYGCLVYFITAILEGDNFATNSFYYYSYYIGANCWWVLIPSLISFRCWKKICAAAAIANNNVETKTKKKTR

SEQ ID NO: 91 - DNA, 663 bp, Populus balsamifera subsp. trichocarpa
  misc_feature (1)..(663): Ceres ANNOT ID no. 1500813
  misc_feature: Utility: Metabolic Profiling Useful for making plants with enhanced metabolite accumulation
  misc_feature 9563:<222: Transcription Factor
  misc_feature: Phenotype: WHOLE PLANT - Metabolic Profiling Useful for making plants with enhanced metabolite accumulation
atggaggggcagccgcatccatacgcaccaagagatctgaaactgcctggctatgtacctaatttcctcactcaatccaccattgtcggcgtctatttactcacctcccttcttgtcgtctctctcatctggatcctctctggaaggtctcgtaagataacaaaaatgaataggttgctcatgtgctggtgggctttcactggtctcacacacttgattctcgagggttattttgctttctctccagaattttacaaggacaagactgctcattatctggctgaagtttggaaagaatatagcaaaggtgattcaagatatgcagcaagggatgctgcaacagttactgttgaaggattgactgctgttctcgagggaccagctagcctcctggcagtgtatgctattgcttcaggaaaatcgtacagctacatacttcagtttgctgtttgtttgggacagctctatggaacagctgtgtatttcttaactgcctacttggaaggtgatcattttgctaccagtccgtaccactattacgtatactatattggtgcaaatgcctcctgggttgtaattccctcgctcatcgctatgcgttgttggaaaaagatttgctcagcagtccaagttcatggccagaaaaggaccaaaactcgttga

SEQ ID NO: 92 - protein, 220 aa, Populus balsamifera subsp. trichocarpa
  misc_feature (1)..(220): Ceres ANNOT ID no. 1500813
  misc_feature (20)..(216): Pfam Name: EBP Pfam Description: Emopamil binding protein
  misc_feature: SWISSPROT Homolog: EBP_ARATH Probable 3-beta-hydroxysteroid-delta(8),delta(7)-isomerase with e-value of 1.2e-118 and BLAST sequence identity of 99.6
  misc_feature: SWISSPROT Homolog: EBP_ARATH EC 5.3.3.5 Cholestenol delta-isomerase Delta8-delta7 sterol isomerase D8-D7 sterol isomerase
  misc_feature: SWISSPROT Homolog: EBP_ORYSA Probable 3-beta-hydroxysteroid-delta(8),delta(7)-isomerase EC 5.3.3.5 (Cholestenol delta-isomerase) with e-value of 1.1e-67 and BLAST sequence identity of 58.6
  misc_feature: SWISSPROT Homolog: EBP_RAT 3-beta-hydroxysteroid-delta(8),delta(7)-isomerase with e-value of 9.1e-34 and BLAST sequence identity of 34.5
  misc_feature: SWISSPROT Homolog: EBP_RAT EC 5.3.3.5 Cholestenol delta-isomerase Delta8-delta7 sterol isomerase D8-D7 sterol isomerase , Emopamil-binding protein
  misc_feature: SWISSPROT Homolog: EBP_MOUSE 3-beta-hydroxysteroid-delta(8),delta(7)-isomerase with e-value of 6.4e-33 and BLAST sequence identity of 35.3
  misc_feature: SWISSPROT Homolog: EBP_MOUSE EC 5.3.3.5 (Cholestenol delta-isomerase) Delta8-delta7 sterol isomerase D8-D7 sterol isomerase (Emopamil-binding protein)
  misc_feature: SWISSPROT Homolog: EBP_CAVPO 3-beta-hydroxysteroid-delta(8),delta(7)-isomerase with e-value of 2.5e-31 and BLAST sequence identity of 35.1
  misc_feature: SWISSPROT Homolog: EBP_CAVPO EC 5.3.3.5 (Cholestenol delta-isomerase) Delta8-delta7 sterol isomerase D8-D7 sterol isomerase (Emopamil-binding protein)
  misc_feature: Utility: Metabolic Profiling Useful for making plants with enhanced metabolite accumulation
  misc_feature 9695:<222: Transcription Factor
  misc_feature: Phenotype: WHOLE PLANT - Metabolic Profiling Useful for making plants with enhanced metabolite accumulation
  misc_feature (1)..(220): Functional Homolog of  Ceres CLONE ID no. 2121 at SEQ ID NO. 93 with e-value of 1.50E-78 and BLAST sequence identity of 66.0
MEGQPHPYAPRDLKLPGYVPNFLTQSTIVGVYLLTSLLVVSLIWILSGRSRKITKMNRLLMCWWAFTGLTHLILEGYFAFSPEFYKDKTAHYLAEVWKEYSKGDSRYAARDAATVTVEGLTAVLEGPASLLAVYAIASGKSYSYILQFAVCLGQLYGTAVYFLTAYLEGDHFATSPYHYYVYYIGANASWVVIPSLIAMRCWKKICSAVQVHGQKRTKTR

SEQ ID NO: 93 - DNA, 630 bp, Populus balsamifera subsp. trichocarpa
  misc_feature (1)..(630): Ceres ANNOT ID no. 1491102
  misc_feature: Utility: Metabolic Profiling Useful for making plants with enhanced metabolite accumulation
  misc_feature 9776:<222: Transcription Factor
  misc_feature: Phenotype: WHOLE PLANT - Metabolic Profiling Useful for making plants with enhanced metabolite accumulation
atggaggggcagccgcatccatacgcaccaacagatctcaaactgcctggctatgttcctaatttcctcactcaattcaccattgtctctgtctatggactctcctctctcatctggatcctctctggaaggtctcgtaaattagccaaaattgatagattgctcatgtgctggtgggctttcactggtctcacacacgtgattcttgagggttattttgttttctctccagaattttacaaggacaagactgctcattatctagctgaagtttgtgattcaagatatgctgcaagggatgctgcaacggttactgttgaaggagtgactgttgtttttgagggtcgagctagtctcctggcagtgtgtgctattgcttcaggaaaatcatacagctacatacttcagttttccgtttctttgggacagctctatggaacagctgtgtatttcctaaccgcctacttggaaggtgatcactttgctgcaagttcatatcactgttatgtgtactatatcggtgcaaatgcctcctgggttgtaataccctcactcatcgctattcgttgttggaacaagattttttcagcagtccaagttcaaggccagaaaaagaccaaaagtcactga

SEQ ID NO: 94 - protein, 209 aa, Populus balsamifera subsp. trichocarpa
  misc_feature (1)..(209): Ceres ANNOT ID no. 1491102
  misc_feature (20)..(205): Pfam Name: EBP Pfam Description: Emopamil binding protein
  misc_feature: SWISSPROT Homolog: EBP_ARATH Probable 3-beta-hydroxysteroid-delta(8),delta(7)-isomerase with e-value of 1.2e-118 and BLAST sequence identity of 99.6
  misc_feature: SWISSPROT Homolog: EBP_ARATH EC 5.3.3.5 Cholestenol delta-isomerase Delta8-delta7 sterol isomerase D8-D7 sterol isomerase
  misc_feature: SWISSPROT Homolog: EBP_ORYSA Probable 3-beta-hydroxysteroid-delta(8),delta(7)-isomerase EC 5.3.3.5 (Cholestenol delta-isomerase) with e-value of 1.1e-67 and BLAST sequence identity of 58.6
  misc_feature: SWISSPROT Homolog: EBP_RAT 3-beta-hydroxysteroid-delta(8),delta(7)-isomerase with e-value of 9.1e-34 and BLAST sequence identity of 34.5
  misc_feature: SWISSPROT Homolog: EBP_RAT EC 5.3.3.5 Cholestenol delta-isomerase Delta8-delta7 sterol isomerase D8-D7 sterol isomerase , Emopamil-binding protein
  misc_feature: SWISSPROT Homolog: EBP_MOUSE 3-beta-hydroxysteroid-delta(8),delta(7)-isomerase with e-value of 6.4e-33 and BLAST sequence identity of 35.3
  misc_feature: SWISSPROT Homolog: EBP_MOUSE EC 5.3.3.5 (Cholestenol delta-isomerase) Delta8-delta7 sterol isomerase D8-D7 sterol isomerase (Emopamil-binding protein)
  misc_feature: SWISSPROT Homolog: EBP_CAVPO 3-beta-hydroxysteroid-delta(8),delta(7)-isomerase with e-value of 2.5e-31 and BLAST sequence identity of 35.1
  misc_feature: SWISSPROT Homolog: EBP_CAVPO EC 5.3.3.5 (Cholestenol delta-isomerase) Delta8-delta7 sterol isomerase D8-D7 sterol isomerase (Emopamil-binding protein)
  misc_feature: Utility: Metabolic Profiling Useful for making plants with enhanced metabolite accumulation
  misc_feature 9904:<222: Transcription Factor
  misc_feature: Phenotype: WHOLE PLANT - Metabolic Profiling Useful for making plants with enhanced metabolite accumulation
  misc_feature (1)..(209): Functional Homolog of  Ceres CLONE ID no. 2121 at SEQ ID NO. 93 with e-value of 2.09E-63 and BLAST sequence identity of 63.1
MEGQPHPYAPTDLKLPGYVPNFLTQFTIVSVYGLSSLIWILSGRSRKLAKIDRLLMCWWAFTGLTHVILEGYFVFSPEFYKDKTAHYLAEVCDSRYAARDAATVTVEGVTVVFEGRASLLAVCAIASGKSYSYILQFSVSLGQLYGTAVYFLTAYLEGDHFAASSYHCYVYYIGANASWVVIPSLIAIRCWNKIFSAVQVQGQKKTKSH

SEQ ID NO: 95 - protein, 77 aa, Arabidopsis thaliana
  misc_feature (1)..(77): Ceres CLONE ID no. 2403
  misc_feature (1)..(73): Pfam Name: ubiquitin Pfam Description: Ubiquitin family
  misc_feature: Utility: Cold Germination Useful for making plants with increased tolerance to cold stress
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
MIKVKTLTGKEIEIDIEPTDTIDRIKERVEEKEGIPPVQQRLIYAGKQLADDKTAKDYAIEGGSVLHLVLALRGGLL

SEQ ID NO: 96 - DNA, 450 bp, Populus balsamifera subsp. trichocarpa
  misc_feature (1)..(450): Ceres ANNOT ID no. 1509972
  misc_feature: Utility: Cold Germination Useful for making plants with increased tolerance to cold stress
  misc_feature 10055:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
atgcagatcattgtcggtaaaaacactcttgaggttgatagcagtgacaccattgacagcgtcaaagccaagattcaggacaaggaaggcatccctccagaccagctgaggttgtttttcgctggtaagcgattggaagatggccggactcttgctgattataacattcagaagggttcaacacttcacttgaatttgaggcttagaggaggaactatgatcaaagtcaagactctcactggaaaagaaattgagattgacattgaacctactgatacaattgaccgtataaaggaacgtgttgaggagaaggaaggaattcctcctgtgcaacaaaggcttatttatgctgggaagcagcttggcgacgacaagactgctcgtgactacaatattgaggggggctctgttcttcatcttgtgcttgctctcaggggcggtagtttttag

SEQ ID NO: 97 - protein, 149 aa, Populus balsamifera subsp. trichocarpa
  misc_feature (1)..(149): Ceres ANNOT ID no. 1509972
  misc_feature (6)..(69): Pfam Name: ubiquitin Pfam Description: Ubiquitin family
  misc_feature: SWISSPROT Homolog: RUB2_ARATH NEDD8-like protein RUB2 precursor (Ubiquitin-related protein 2) (AtRUB2) with e-value of 1.4e-35 and BLAST sequence identity of 100.0
  misc_feature: SWISSPROT Homolog: RUB1_ARATH NEDD8-like protein RUB1 precursor (Ubiquitin-related protein 1) (AtRUB1) with e-value of 4.4e-34 and BLAST sequence identity of 98.7
  misc_feature: SWISSPROT Homolog: RUB1_ORYSA NEDD8-like protein RUB1 precursor (Ubiquitin-related protein 1) (OsRUB1) with e-value of 4.4e-34 and BLAST sequence identity of 98.7
  misc_feature: SWISSPROT Homolog: RUB2_ORYSA NEDD8-like protein RUB2 precursor (Ubiquitin-related protein 2) (OsRUB2) with e-value of 4.4e-34 and BLAST sequence identity of 98.7
  misc_feature: SWISSPROT Homolog: RUB1_DESAN NEDD8-like protein RUB1 precursor (DaRUB1) with e-value of 5.6e-34 and BLAST sequence identity of 97.3
  misc_feature: Utility: Cold Germination Useful for making plants with increased tolerance to cold stress
  misc_feature 10169:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature (1)..(149): Functional Homolog of  Ceres CLONE ID no. 2403 at SEQ ID NO. 98 with e-value of 2.10E-33 and BLAST sequence identity of 96.0
MQIIVGKNTLEVDSSDTIDSVKAKIQDKEGIPPDQLRLFFAGKRLEDGRTLADYNIQKGSTLHLNLRLRGGTMIKVKTLTGKEIEIDIEPTDTIDRIKERVEEKEGIPPVQQRLIYAGKQLGDDKTARDYNIEGGSVLHLVLALRGGSF

SEQ ID NO: 98 - DNA, 474 bp, Populus balsamifera subsp. trichocarpa; identical to SEQ ID NO: 61
  misc_feature (1)..(474): Ceres ANNOT ID no. 1504203
  misc_feature: Utility: Cold Germination Useful for making plants with increased tolerance to cold stress
  misc_feature 10259:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size

SEQ ID NO: 99 - protein, 157 aa, Populus balsamifera subsp. trichocarpa; identical to SEQ ID NO: 62
  misc_feature (1)..(157): Ceres ANNOT ID no. 1504203
  misc_feature (1)..(74): Pfam Name: ubiquitin Pfam Description: Ubiquitin family
  misc_feature: SWISSPROT Homolog: RUB2_ARATH NEDD8-like protein RUB2 precursor (Ubiquitin-related protein 2) (AtRUB2) with e-value of 1.4e-35 and BLAST sequence identity of 100.0
  misc_feature: SWISSPROT Homolog: RUB1_ARATH NEDD8-like protein RUB1 precursor (Ubiquitin-related protein 1) (AtRUB1) with e-value of 4.4e-34 and BLAST sequence identity of 98.7
  misc_feature: SWISSPROT Homolog: RUB1_ORYSA NEDD8-like protein RUB1 precursor (Ubiquitin-related protein 1) (OsRUB1) with e-value of 4.4e-34 and BLAST sequence identity of 98.7
  misc_feature: SWISSPROT Homolog: RUB2_ORYSA NEDD8-like protein RUB2 precursor (Ubiquitin-related protein 2) (OsRUB2) with e-value of 4.4e-34 and BLAST sequence identity of 98.7
  misc_feature: SWISSPROT Homolog: RUB1_DESAN NEDD8-like protein RUB1 precursor (DaRUB1) with e-value of 5.6e-34 and BLAST sequence identity of 97.3
  misc_feature: Utility: Cold Germination Useful for making plants with increased tolerance to cold stress
  misc_feature 10373:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature (1)..(157): Functional Homolog of  Ceres CLONE ID no. 2403 at SEQ ID NO. 98 with e-value of 2.70E-33 and BLAST sequence identity of 94.6

SEQ ID NO: 100 - DNA, 465 bp, Populus balsamifera subsp. trichocarpa; identical to SEQ ID NO: 59
  misc_feature (1)..(465): Ceres ANNOT ID no. 1443061
  misc_feature: Utility: Cold Germination Useful for making plants with increased tolerance to cold stress
  misc_feature 10463:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size

SEQ ID NO: 101 - protein, 154 aa, Populus balsamifera subsp. trichocarpa; identical to SEQ ID NO: 60
  misc_feature (1)..(154): Ceres ANNOT ID no. 1443061
  misc_feature (1)..(74): Pfam Name: ubiquitin Pfam Description: Ubiquitin family
  misc_feature: SWISSPROT Homolog: RUB2_ARATH NEDD8-like protein RUB2 precursor (Ubiquitin-related protein 2) (AtRUB2) with e-value of 1.4e-35 and BLAST sequence identity of 100.0
  misc_feature: SWISSPROT Homolog: RUB1_ARATH NEDD8-like protein RUB1 precursor (Ubiquitin-related protein 1) (AtRUB1) with e-value of 4.4e-34 and BLAST sequence identity of 98.7
  misc_feature: SWISSPROT Homolog: RUB1_ORYSA NEDD8-like protein RUB1 precursor (Ubiquitin-related protein 1) (OsRUB1) with e-value of 4.4e-34 and BLAST sequence identity of 98.7
  misc_feature: SWISSPROT Homolog: RUB2_ORYSA NEDD8-like protein RUB2 precursor (Ubiquitin-related protein 2) (OsRUB2) with e-value of 4.4e-34 and BLAST sequence identity of 98.7
  misc_feature: SWISSPROT Homolog: RUB1_DESAN NEDD8-like protein RUB1 precursor (DaRUB1) with e-value of 5.6e-34 and BLAST sequence identity of 97.3
  misc_feature: Utility: Cold Germination Useful for making plants with increased tolerance to cold stress
  misc_feature 10577:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature (1)..(154): Functional Homolog of  Ceres CLONE ID no. 2403 at SEQ ID NO. 98 with e-value of 3.39E-33 and BLAST sequence identity of 93.5

SEQ ID NO: 102 - DNA, 627 bp, Populus balsamifera subsp. trichocarpa; identical to SEQ ID NO: 65
  misc_feature (1)..(627): Ceres ANNOT ID no. 1452369
  misc_feature: Utility: Cold Germination Useful for making plants with increased tolerance to cold stress
  misc_feature 10667:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size

SEQ ID NO: 103 - protein, 154 aa, Populus balsamifera subsp. trichocarpa; identical to SEQ ID NO: 64
  misc_feature (1)..(154): Ceres ANNOT ID no. 1452369
  misc_feature (1)..(74): Pfam Name: ubiquitin Pfam Description: Ubiquitin family
  misc_feature: SWISSPROT Homolog: RUB2_ARATH NEDD8-like protein RUB2 precursor (Ubiquitin-related protein 2) (AtRUB2) with e-value of 1.4e-35 and BLAST sequence identity of 100.0
  misc_feature: SWISSPROT Homolog: RUB1_ARATH NEDD8-like protein RUB1 precursor (Ubiquitin-related protein 1) (AtRUB1) with e-value of 4.4e-34 and BLAST sequence identity of 98.7
  misc_feature: SWISSPROT Homolog: RUB1_ORYSA NEDD8-like protein RUB1 precursor (Ubiquitin-related protein 1) (OsRUB1) with e-value of 4.4e-34 and BLAST sequence identity of 98.7
  misc_feature: SWISSPROT Homolog: RUB2_ORYSA NEDD8-like protein RUB2 precursor (Ubiquitin-related protein 2) (OsRUB2) with e-value of 4.4e-34 and BLAST sequence identity of 98.7
  misc_feature: SWISSPROT Homolog: RUB1_DESAN NEDD8-like protein RUB1 precursor (DaRUB1) with e-value of 5.6e-34 and BLAST sequence identity of 97.3
  misc_feature: Utility: Cold Germination Useful for making plants with increased tolerance to cold stress
  misc_feature 10787:<222: Transcription Factor
  misc_feature: Phenotype: WHOLE PLANT - Cold Germination Useful for making plants with increased tolerance to cold stress
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature (1)..(154): Functional Homolog of  Ceres CLONE ID no. 2403 at SEQ ID NO. 98 with e-value of 3.39E-33 and BLAST sequence identity of 93.5

SEQ ID NO: 104 - protein, 92 aa, Arabidopsis thaliana
  misc_feature (1)..(92): Ceres CLONE ID no. 2561
  misc_feature (2)..(28): Pfam Name: KOW Pfam Description: KOW motif
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
MQVVRGTFKGREGKVMQVYRRKWVIHIERITREKVNGSTVNVGVNASNVMITKLRLDKDRKSLLERKANGRAAADKEKGTKFSAEDVMENVD

SEQ ID NO: 105 - DNA, 441 bp, Populus balsamifera subsp. trichocarpa
  misc_feature (1)..(441): Ceres ANNOT ID no. 1450958
  misc_feature 10945:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atgaagtataacccaagggtctcctcctccagacgcaagagccggaaggcccacttctcggcgccctcctccttgcgcaggatcctaatgagcgctcctctctccaccgacctccgccagaagtacaacgtccgatccatgcctgtccgtaaggacgatgaagtccaggttgttcgtgggacctacaaaggacgcgagggcaaggtggttcaggtttatcgtcgaaagtgggtcatccacatcgagaggattacacgtgagaaggtgaatgggtcaacagttaatgtcggtatcaacgcgtccaaggttgttatcacgaagttgaggcttgataaggataggaagtctctattggatcgcaaggcaaagggacgtgctgttggagacaaagagaagggcactaagttcactgccgaggacatcatgcagagtgtggactga

SEQ ID NO: 106 - protein, 100 aa, Populus balsamifera subsp. trichocarpa
  misc_feature (1)..(100): Ceres ANNOT ID no. 1450958
  misc_feature (3)..(36): Pfam Name: KOW Pfam Description: KOW motif
  misc_feature: SWISSPROT Homolog: RL26B_ARATH 60S ribosomal protein L26-2 with e-value of 1.6e-43 and BLAST sequence identity of 98.9
  misc_feature: SWISSPROT Homolog: RL26A_ARATH 60S ribosomal protein L26-1 with e-value of 2.0e-38 and BLAST sequence identity of 84.8
  misc_feature: SWISSPROT Homolog: RL26_BRARA 60S ribosomal protein L26 with e-value of 1.3e-34 and BLAST sequence identity of 81.1
  misc_feature: SWISSPROT Homolog: RL26_LITLI 60S ribosomal protein L26 with e-value of 1.2e-22 and BLAST sequence identity of 60.0
  misc_feature: SWISSPROT Homolog: RL26L_HUMAN 60S ribosomal protein L26-like 1 with e-value of 2.5e-22 and BLAST sequence identity of 57.6
  misc_feature 11055:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(100): Functional Homolog of  Ceres CLONE ID no. 2561 at SEQ ID NO. 107 with e-value of 1.30E-38 and BLAST sequence identity of 84.7
MPVRKDDEVQVVRGTYKGREGKVVQVYRRKWVIHIERITREKVNGSTVNVGINASKVVITKLRLDKDRKSLLDRKAKGRAVGDKEKGTKFTAEDIMQSVD

SEQ ID NO: 107 - DNA, 441 bp, Populus balsamifera subsp. trichocarpa
  misc_feature (1)..(441): Ceres ANNOT ID no. 1456475
  misc_feature 11137:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atgaagtacaaccctagagtctcctcctccaggcgcaagaaccggaaggcccacttctcggcgccctcctccttgcgcaggatcctaatgagcgccccactgtccaccgatctccgccagaagtacaacgttcgatccatgcctatccgcaaggacgatgaagtccaggttgttcgtgggacttataaaggacgtgagggcaaggtggttcaagtttatcgcagaaagtgggtaatccacatcgagaggattacacgtgagaaggtgaatgggtctacagttaatgtcggtatcaacccgtccaaggttgttattaccaagttgaggcttgataaggataggaagtctttgttggatcgcaaggcaaagggacgcgctgttggagataaagagaagggcactaagttcactgctgaggacatcatgcagaatgtggactaa

SEQ ID NO: 108 - protein, 100 aa, Populus balsamifera subsp. trichocarpa
  misc_feature (1)..(100): Ceres ANNOT ID no. 1456475
  misc_feature (3)..(36): Pfam Name: KOW Pfam Description: KOW motif
  misc_feature: SWISSPROT Homolog: RL26B_ARATH 60S ribosomal protein L26-2 with e-value of 1.6e-43 and BLAST sequence identity of 98.9
  misc_feature: SWISSPROT Homolog: RL26A_ARATH 60S ribosomal protein L26-1 with e-value of 2.0e-38 and BLAST sequence identity of 84.8
  misc_feature: SWISSPROT Homolog: RL26_BRARA 60S ribosomal protein L26 with e-value of 1.3e-34 and BLAST sequence identity of 81.1
  misc_feature: SWISSPROT Homolog: RL26_LITLI 60S ribosomal protein L26 with e-value of 1.2e-22 and BLAST sequence identity of 60.0
  misc_feature: SWISSPROT Homolog: RL26L_HUMAN 60S ribosomal protein L26-like 1 with e-value of 2.5e-22 and BLAST sequence identity of 57.6
  misc_feature 11247:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(100): Functional Homolog of  Ceres CLONE ID no. 2561 at SEQ ID NO. 107 with e-value of 1.30E-38 and BLAST sequence identity of 84.7
MPIRKDDEVQVVRGTYKGREGKVVQVYRRKWVIHIERITREKVNGSTVNVGINPSKVVITKLRLDKDRKSLLDRKAKGRAVGDKEKGTKFTAEDIMQNVD

SEQ ID NO: 109 - DNA, 441 bp, Populus balsamifera subsp. trichocarpa
  misc_feature (1)..(441): Ceres ANNOT ID no. 1446945
  misc_feature 11329:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atgaagtacaacccaagggtctcctcctcccgccggaagaaccgtaaggcccacttctcggcgccatcgtccgtgcgtcgtatcctcatgagcgcaccactttccactgacctccgtcagaaatacaacgtgagatccatgcctatccgaaaagacgatgagatccaagttgttcgtgggacatacaagggaagggaagggaaggttgtccaggtttataggagaaaatgggttattcatgtcgagaggattacaagggaaaaagttaatggctccactgttaacgtgggaattaacccttcgaaggtggtgattactaagctcagacttgataaggacaggaagtccctgctggatcgcaaggctaaggggcgtgctgttggtgataaggataaggggaccaagttcactgctgaggatatcatgcagagcgtggactga

SEQ ID NO: 110 - protein, 100 aa, Populus balsamifera subsp. trichocarpa
  misc_feature (1)..(100): Ceres ANNOT ID no. 1446945
  misc_feature (3)..(36): Pfam Name: KOW Pfam Description: KOW motif
  misc_feature: SWISSPROT Homolog: RL26B_ARATH 60S ribosomal protein L26-2 with e-value of 1.6e-43 and BLAST sequence identity of 98.9
  misc_feature: SWISSPROT Homolog: RL26A_ARATH 60S ribosomal protein L26-1 with e-value of 2.0e-38 and BLAST sequence identity of 84.8
  misc_feature: SWISSPROT Homolog: RL26_BRARA 60S ribosomal protein L26 with e-value of 1.3e-34 and BLAST sequence identity of 81.1
  misc_feature: SWISSPROT Homolog: RL26_LITLI 60S ribosomal protein L26 with e-value of 1.2e-22 and BLAST sequence identity of 60.0
  misc_feature: SWISSPROT Homolog: RL26L_HUMAN 60S ribosomal protein L26-like 1 with e-value of 2.5e-22 and BLAST sequence identity of 57.6
  misc_feature 11439:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(100): Functional Homolog of  Ceres CLONE ID no. 2561 at SEQ ID NO. 107 with e-value of 1.20E-37 and BLAST sequence identity of 81.5
MPIRKDDEIQVVRGTYKGREGKVVQVYRRKWVIHVERITREKVNGSTVNVGINPSKVVITKLRLDKDRKSLLDRKAKGRAVGDKDKGTKFTAEDIMQSVD

SEQ ID NO: 111 - protein, 286 aa, Arabidopsis thaliana
  misc_feature (1)..(286): Ceres CLONE ID no. 3000
  misc_feature (166)..(187): Pfam Name: ELK Pfam Description: ELK domain
  misc_feature (214)..(248): Pfam Name: Homeobox Pfam Description: Homeobox domain
  misc_feature (23)..(67): Pfam Name: KNOX1 Pfam Description: KNOX1 domain
  misc_feature (74)..(125): Pfam Name: KNOX2 Pfam Description: KNOX2 domain
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
MEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 112 - DNA, 1122 bp, Populus balsamifera subsp. trichocarpa
  misc_feature (1)..(1122): Ceres ANNOT ID no. 1518918
  misc_feature 11768:<222: Transcription Factor
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
atggagggtggtggtggtgatggtggttcaagtaccacttcatgtatgatggcttttggagacaacagtaatggactatgccctatgatgatgatgacgcctctcatgtcttcttcgtcttctgctcatcatcagcatcctcatcatcatcatcgggctaatgagggcgattcgtcaatatcaaataccttattccttcctctacctcctacaaacaatcaaggccataaccgtatccatagtaatgctagtggctcttcttctatgattattgacgatcacaaccgcaaccacaacaacaacactgtcactgctactgggtgttatttcatggataacaatgatggtagtagttcttctgttaaggccaaaattatggctcatcctcactaccatcgtctccttgctgcctatgctaattgtcaaaaggttggagcaccacctgaagtggtggctaggctagaagaagcttgcgcatcggctgcttctattgcccccgctaacacaggctgcatcggtgaagatccagcccttgaccaattcatggaggcttactgtgagatgctgaccaagtatgagcaagagctctctaaacccttaaaggaagccatgctttttcttcagagggttgagtgtcaattcaaagctctcactctttcctctccaatttctggttgtggtgatggcaatgataggaatgtgtcatctgaagaagaggttgatgtgaataacaacttcatagatcctcaagctgaagatcaagagctgaagggtcagctacttcgcaggtacagtggatatttaggcagtctcaagcaggagttcatgaaaaagagaaagaaagggaagttacctaaagaagccaggcaacagctgctggattggtggagcaggcattacaaatggccatatccatcggagtcacagaagctggcccttgctgaatccactggtctggatcagaagcaaataaacaactggttcattaaccaaaggaaacgacactggaaaccatcggaagacatgcagtttgtggtgatggatgccggccatcctcattactacatggataatgttttgggcaatcctttcccaatggacatctctcccacactgctttga

SEQ ID NO: 113 - protein, 357 aa, Populus balsamifera subsp. trichocarpa
  misc_feature (1)..(357): Ceres ANNOT ID no. 1518918
  misc_feature (103)..(147): Pfam Name: KNOX1 Pfam Description: KNOX1 domain
  misc_feature (152)..(203): Pfam Name: KNOX2 Pfam Description: KNOX2 domain
  misc_feature (239)..(260): Pfam Name: ELK Pfam Description: ELK domain
  misc_feature (287)..(321): Pfam Name: Homeobox Pfam Description: Homeobox domain
  misc_feature: SWISSPROT Homolog: STM_ARATH Homeobox protein SHOOT MERISTEMLESS with e-value of 1.1e-156 and BLAST sequence identity of 100.0
  misc_feature: SWISSPROT Homolog: STM_BRAOL Homeobox protein Shootmeristemless with e-value of 6.9e-139 and BLAST sequence identity of 90.9
  misc_feature: SWISSPROT Homolog: HSBH1_SOYBN Homeobox protein SBH1 with e-value of 1.6e-116 and BLAST sequence identity of 78.2
  misc_feature: SWISSPROT Homolog: LET6_LYCES Homeobox protein knotted-1-like LET6 with e-value of 3.9e-113 and BLAST sequence identity of 77.5
  misc_feature: SWISSPROT Homolog: KNAT1_ARATH Homeobox protein knotted-1-like 1 (KNAT1) with e-value of 3.6e-78 and BLAST sequence identity of 56.9
  misc_feature 12038:<222: Transcription Factor
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
  misc_feature (1)..(357): Functional Homolog of  Ceres CLONE ID no. 3000 at SEQ ID NO. 114 with e-value of 3.89E-119 and BLAST sequence identity of 83.5
MAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 114 - DNA, 1110 bp, Populus balsamifera subsp. trichocarpa
  misc_feature (1)..(1110): Ceres ANNOT ID no. 1535677
  misc_feature 12287:<222: Transcription Factor
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
atggagggaggtggtgctggttgttcaagtaccccttcacttatgatggcttttggagacagcagtaatggactatgccctatgatgatgatgccgctaatgtcttcttcatcttctgctcatcagcatcaccatcagcaacaacatgttaatgcgggggattcatcaatatcaaataccttattccttcctctacctcctaccaactatcaaagtcaaaaccgtattaataatagcgctagtggctcttctatgattcttgacgatcacaaccacaacaacaacactgtcactgcgactgggtgttatttcatggagaacaatgatggtggtagtagttctacttctgtaaaggctaaaattatggctcatcctcactaccatcggctcttggctgcctatgccaattgtcaaaaggttggagcaccacctgaagtcgtggctagacttgaagaagcttgtgcatctgctgcctcaatgggccctgcaaatacagacggcatcggtgaagatccagcccttgaccaattcatggaggcctactgtgagatgctgaccaagtatgagcaagaactctctaagcccttgaaggaagccatggtttttcttcagagggtcgaatgccaattcagagccctcactctttcctctccaaattctgcttggggcgagggcaatgataggaatgcatcatccgaagaagagcttgatgtgaataacaaattcatagatcctcaagcagaagatcaagaattgaaaggtcagctactacgcaagtacagtggatatttaggcagtctcaagaaggagttcatgaaaaagagaaagaaagggaagttgcccaaagaagcgaggcagcagctgctggattggtggagcaggcatcacaaatggccatatccatcggagtcacagaagctggccctcgcagagtccactggtctggatcagaagcagataaacaactggttcattaaccaaaggaaacgccactggaaaccatcagaagacatgcagtttgtggtgatggatgccggccatcctcattattacatggataatgttttgggcaatcctttcccaatggacatctctcacacactgctttga

SEQ ID NO: 115 - protein, 354 aa, Populus balsamifera subsp. trichocarpa
  misc_feature (1)..(354): Ceres ANNOT ID no. 1535677
  misc_feature (100)..(144): Pfam Name: KNOX1 Pfam Description: KNOX1 domain
  misc_feature (149)..(200): Pfam Name: KNOX2 Pfam Description: KNOX2 domain
  misc_feature (236)..(257): Pfam Name: ELK Pfam Description: ELK domain
  misc_feature (284)..(318): Pfam Name: Homeobox Pfam Description: Homeobox domain
  misc_feature: SWISSPROT Homolog: STM_ARATH Homeobox protein SHOOT MERISTEMLESS with e-value of 1.1e-156 and BLAST sequence identity of 100.0
  misc_feature: SWISSPROT Homolog: STM_BRAOL Homeobox protein Shootmeristemless with e-value of 6.9e-139 and BLAST sequence identity of 90.9
  misc_feature: SWISSPROT Homolog: HSBH1_SOYBN Homeobox protein SBH1 with e-value of 1.6e-116 and BLAST sequence identity of 78.2
  misc_feature: SWISSPROT Homolog: LET6_LYCES Homeobox protein knotted-1-like LET6 with e-value of 3.9e-113 and BLAST sequence identity of 77.5
  misc_feature: SWISSPROT Homolog: KNAT1_ARATH Homeobox protein knotted-1-like 1 (KNAT1) with e-value of 3.6e-78 and BLAST sequence identity of 56.9
  misc_feature 12557:<222: Transcription Factor
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
  misc_feature (1)..(354): Functional Homolog of  Ceres CLONE ID no. 3000 at SEQ ID NO. 114 with e-value of 1.50E-117 and BLAST sequence identity of 84.1
MAFGDSSNGLCPMMMMPLMSSSSSAHQHHHQQQHVNAGDSSISNTLFLPLPPTNYQSQNRINNSASGSSMILDDHNHNNNTVTATGCYFMENNDGGSSSTSVKAKIMAHPHYHRLLAAYANCQKVGAPPEVVARLEEACASAASMGPANTDGIGEDPALDQFMEAYCEMLTKYEQELSKPLKEAMVFLQRVECQFRALTLSSPNSAWGEGNDRNASSEEELDVNNKFIDPQAEDQELKGQLLRKYSGYLGSLKKEFMKKRKKGKLPKEARQQLLDWWSRHHKWPYPSESQKLALAESTGLDQKQINNWFINQRKRHWKPSEDMQFVVMDAGHPHYYMDNVLGNPFPMDISHTLL

SEQ ID NO: 116 - DNA, 1176 bp, Populus balsamifera subsp. trichocarpa
  misc_feature (1)..(1176): Ceres ANNOT ID no. 1482181
  misc_feature 12806:<222: Transcription Factor
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
atggagggaggtggtgctggttgttcaagtaccccttcacttatgatggcttttggagacagcagtaatggactatgccctatgatgatgatgccgctaatgtcttcttcatcttctgctcatcagcatcaccatcagcaacaacatgttaatgcgggggattcatcaatatcaaataccttattccttcctctacctcctaccaactatcaaagtcaaaaccgtattaataatagcgctagtggctcttctatgattcttgacgatcacaaccacaacaacaacactgtcactgcgactgggtgttatttcatggagaacaatgatggtggtagtagttctacttctgtaaaggctaaaattatggctcatcctcactaccatcggctcttggctgcctatgccaattgtcaaaaggttggagcaccacctgaagtcgtggctagacttgaagaagcttgtgcatctgctgcctcaatgggccctgcaaatacagacggcatcggtgaagatccagcccttgaccaattcatggaggcctactgtgagatgctgaccaagtatgagcaagaactctctaagcccttgaaggaagccatggtttttcttcagagggtcgaatgccaattcagagccctcactctttcctctccaaattctggtgatcataatctctctcccactctccctctcttccccatcctctctctcttgataatgctggcctcttggggcgagggcaatgataggaatgcatcatccgaagaagagcttgatgtgaataacaaattcatagatcctcaagcagaagatcaagaattgaaaggtcagctactacgcaagtacagtggatatttaggcagtctcaagaaggagttcatgaaaaagagaaagaaagggaagttgcccaaagaagcgaggcagcagctgctggattggtggagcaggcatcacaaatggccatatccatcggagtcacagaagctggccctcgcagagtccactggtctggatcagaagcagataaacaactggttcattaaccaaaggaaacgccactggaaaccatcagaagacatgcagtttgtggtgatggatgccggccatcctcattattacatggataatgttttgggcaatcctttcccaatggacatctctcacacactgctttga

SEQ ID NO: 117 - protein, 376 aa, Populus balsamifera subsp. trichocarpa
  misc_feature (1)..(376): Ceres ANNOT ID no. 1482181
  misc_feature (100)..(144): Pfam Name: KNOX1 Pfam Description: KNOX1 domain
  misc_feature (149)..(200): Pfam Name: KNOX2 Pfam Description: KNOX2 domain
  misc_feature (258)..(279): Pfam Name: ELK Pfam Description: ELK domain
  misc_feature (306)..(340): Pfam Name: Homeobox Pfam Description: Homeobox domain
  misc_feature: SWISSPROT Homolog: STM_ARATH Homeobox protein SHOOT MERISTEMLESS with e-value of 1.1e-156 and BLAST sequence identity of 100.0
  misc_feature: SWISSPROT Homolog: STM_BRAOL Homeobox protein Shootmeristemless with e-value of 6.9e-139 and BLAST sequence identity of 90.9
  misc_feature: SWISSPROT Homolog: HSBH1_SOYBN Homeobox protein SBH1 with e-value of 1.6e-116 and BLAST sequence identity of 78.2
  misc_feature: SWISSPROT Homolog: LET6_LYCES Homeobox protein knotted-1-like LET6 with e-value of 3.9e-113 and BLAST sequence identity of 77.5
  misc_feature: SWISSPROT Homolog: KNAT1_ARATH Homeobox protein knotted-1-like 1 (KNAT1) with e-value of 3.6e-78 and BLAST sequence identity of 56.9
  misc_feature 13078:<222: Transcription Factor
  misc_feature: Phenotype: INFLORESCENCE - Acauline Branching Useful for making ornamental plants with modified flowers
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Leaf Fused to Leaf Useful for making ornamental plants with fused leaves
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Trident Shaped Useful for making plants with increased biomass and foliage
  misc_feature: Phenotype: ROSETTE LEAVES - Undulate Shaped Useful for making plants with increased biomass and foliage
  misc_feature (1)..(376): Functional Homolog of  Ceres CLONE ID no. 3000 at SEQ ID NO. 114 with e-value of 1.29E-113 and BLAST sequence identity of 83.5
MAFGDSSNGLCPMMMMPLMSSSSSAHQHHHQQQHVNAGDSSISNTLFLPLPPTNYQSQNRINNSASGSSMILDDHNHNNNTVTATGCYFMENNDGGSSSTSVKAKIMAHPHYHRLLAAYANCQKVGAPPEVVARLEEACASAASMGPANTDGIGEDPALDQFMEAYCEMLTKYEQELSKPLKEAMVFLQRVECQFRALTLSSPNSGDHNLSPTLPLFPILSLLIMLASWGEGNDRNASSEEELDVNNKFIDPQAEDQELKGQLLRKYSGYLGSLKKEFMKKRKKGKLPKEARQQLLDWWSRHHKWPYPSESQKLALAESTGLDQKQINNWFINQRKRHWKPSEDMQFVVMDAGHPHYYMDNVLGNPFPMDISHTLL

SEQ ID NO: 118 - protein, 402 aa, Arabidopsis thaliana
  misc_feature (1)..(402): Ceres CLONE ID no. 3006
  misc_feature (129)..(394): Pfam Name: IGPS Pfam Description: Indole-3-glycerol phosphate synthase
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
MEGLVPVQRLPIKVASPSLYRCNNSVSIRRSISGFAMDRKINFRAPSQFSIRAQQSDLKESLAVSSSSVEDKGNVLRIKEWEVEMYQEELAISQGIRIRRKPPSKAPLGYSGPFELRLHNNDADSPRNILEEITWYKDVEVSRMKELNPLDVLKKAVEDAPPTRDFVGALRMAHKRTGFPGLIAEVKKASPSRGILKENFDPVEIAQAYEKGGAACLSVLTDQKYFQGGFENLEAIRSAGVKCPLLCKEYVVDPWQIYYARTKGADAVLLIAAVLTDLEITFLLKICKKLSLAALVEVHDEREMGRVLGIEGIELVGINNRSLETFEVDISNTKKLLEGEHGRQIRERDMIVVGESGLFTPDDIAYVQAAGVKAVLVGESIVKQNDPEKGIAGLFGRNISHT

SEQ ID NO: 119 - DNA, 1164 bp, Populus balsamifera subsp. trichocarpa
  misc_feature (1)..(1164): Ceres ANNOT ID no. 1472173
  misc_feature 13457:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
atggcggggttgatttctttgagatcaacaagggttcctttccttaccaaacccaaaccttctcctctccatcacgggcccaacaacttctccatgaacccaaacccgggtgccgggaatcggttttccgttacctccattaaagctcaacaggctgaggcttcaacagtgaacaaggaagatgagctaaaagcgaaggaatgggaagtgaggatgctgcaagaagaggtagctgcaagccaaggtataagaatcagacgaaggccacccactggcccacctgtgcactatgtgggaccctttgaatttcggattcagagtgaaggcaacactcctcgtaacatccttgaggaaattgtttggaacaaggatgtggaagtttctcacatgaaacagagaaagccactttcttcgctaaagaaatatcttgagaatgctcctcccacaagggattttgttggagctcttagggaagcaaatcatcgaacggggtttcctggtttgattgctgaagtcaagaaggcttcaccaagtagagggattttaagagaggattttgatcctgttgaaattgccaaagcttacgagaaaggaggagccgcgtgtcttagtgttttgacagatgaaaaatattttaaggggagctttgaaaacctggaggcaataagaaatgctggagtaaagtgccccctgctttgcaaagagtttgttgtggacgcatggcagatcttctatgctcggattaaaggtgcagatgcgattcttttaattgctgctgttcttcctgatcttgacatcaaatacatgactaagatatgcaagatgcttggtttgactgcacttgtggaggtccatgatgagagagaaatggatcgcgtacttgcaatagaaggggttgaacttattggcatcaacaatcgtaaccttgaaacatttgaggttgatatcagtaacacaaagaagcttcttgaaggagagcgcggtcaacttatctgtcaaaaagacataattgttgttggggaatctgggctatttactcctgatgatattgcttatgtgcaagaagctggtgtcaaagcagttttggttggggagtcaattgtgaaacagagtgatcctgggaagggaatatcaggactttttggtaaagatatctccttgtaa

SEQ ID NO: 120 - protein, 387 aa, Populus balsamifera subsp. trichocarpa
  misc_feature (1)..(387): Ceres ANNOT ID no. 1472173
  misc_feature (115)..(380): Pfam Name: IGPS Pfam Description: Indole-3-glycerol phosphate synthase
  misc_feature: SWISSPROT Homolog: TRPC_ARATH Indole-3-glycerol phosphate synthase, chloroplast precursor (EC 4.1.1.48) (IGPS) with e-value of 6.9e-210 and BLAST sequence identity of 99.5
  misc_feature: SWISSPROT Homolog: TRPC_SYNY3 Indole-3-glycerol phosphate synthase (EC 4.1.1.48) (IGPS) with e-value of 7.5e-78 and BLAST sequence identity of 52.2
  misc_feature: SWISSPROT Homolog: TRPC_SYNP7 Indole-3-glycerol phosphate synthase (EC 4.1.1.48) (IGPS) with e-value of 3.1e-72 and BLAST sequence identity of 52.0
  misc_feature: SWISSPROT Homolog: TRPC_CAUCR Indole-3-glycerol phosphate synthase (EC 4.1.1.48) (IGPS) with e-value of 7.1e-50 and BLAST sequence identity of 45.6
  misc_feature: SWISSPROT Homolog: TRPC_ACIAD Indole-3-glycerol phosphate synthase (EC 4.1.1.48) (IGPS) with e-value of 1.7e-48 and BLAST sequence identity of 42.4
  misc_feature 13589:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(387): Functional Homolog of  Ceres CLONE ID no. 3006 at SEQ ID NO. 121 with e-value of 8.29E-133 and BLAST sequence identity of 75.6
MAGLISLRSTRVPFLTKPKPSPLHHGPNNFSMNPNPGAGNRFSVTSIKAQQAEASTVNKEDELKAKEWEVRMLQEEVAASQGIRIRRRPPTGPPVHYVGPFEFRIQSEGNTPRNILEEIVWNKDVEVSHMKQRKPLSSLKKYLENAPPTRDFVGALREANHRTGFPGLIAEVKKASPSRGILREDFDPVEIAKAYEKGGAACLSVLTDEKYFKGSFENLEAIRNAGVKCPLLCKEFVVDAWQIFYARIKGADAILLIAAVLPDLDIKYMTKICKMLGLTALVEVHDEREMDRVLAIEGVELIGINNRNLETFEVDISNTKKLLEGERGQLICQKDIIVVGESGLFTPDDIAYVQEAGVKAVLVGESIVKQSDPGKGISGLFGKDISL

SEQ ID NO: 121 - protein, 391 aa, Arabidopsis thaliana
  misc_feature (1)..(391): Ceres CLONE ID no. 3036
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MAEVEEIAHEEQNIEKREKKKGKHEKPKPWDDDPNIDRWTIEKFDPAWNPTGMTETSTFSTLFPQYREKYLQECWPRVESALKEYGVACKLNLVEGSMTVSTTRKTRDPYIIVKARDLIKLLSRSVPAPQAIKILEDEVQCDIIKIGNLVRNKERFVKRRQRLVGPNSSTLKALEILTNCYILVQGSTVAAMGPFKGLKQLRRIVEDCVQNIMHPVYHIKTLMMKKELEKDPALANESWDRFLPTFRKKNVKQKKPKSKEKKPYTPFPPPQPPSKIDMQLESGEYFMRDKKKSEKKWQEKQEKQSEKSTENKRKRDASFLPPEEPMNNNSNANKSEDGKNDITELTNSLKSKTKELKKQKKTHERVNAEEYIAGPSSSADKSSKKSKKIRD

SEQ ID NO: 122 - DNA, 1194 bp, Populus balsamifera subsp. trichocarpa
  misc_feature (1)..(1194): Ceres ANNOT ID no. 1456840
  misc_feature 13878:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggaggcagacggagcagaaaacacagatatatcaaacacaaagaaaccaaaacacaaaggaaaacatgataagccaaaaccatgggatgaagaccctaatattgaccgttggaagattgaaaaatttgacccgtcttggaatcaaggtggaatggtcgatgtcagctctttctccactcttttccctaaatatcgcgagaagtacttgacggacgcatggccgatggtgaaatctgcgttaaaagagtttggcattgattgcgaacttaataagaatgaggggtcaatgacggttaaaactacgataaagaccagggatccttatattattgttaaagctagggatcttattaagcttttgtcgagaagtgtccctgctcctcagggtagtacttgtgctcctgctgatgtgtctcccgttctgactatacagtacatgtgggctggggctatcaaaattttgaatgacgatatgagttgtgacatcatcaagatcggcaacatgattcgtaataaggaacgatttgttaaaagaagacaaaaccttgtgggcccgaattcatcaaccttgaaggcactagaattattgacaggctgctatattctagttcagggaaacactgttgctgctatgggctcatttaaaggtttaaaacaagtcaggagaattgttgaagactgcatacaaaataaaatgcatcccgtataccatataaagattcttatgatgaagaaagaactcgaaaaagatcctgctcttaaaaatgagaactgggacaggaagaccgtgaaacaaaagaaggttaagagtaaaaagaagaaacaagacacaccattccctcctcctcaacaacctagcatggaagatatacaactggagacaggagaatactttttaagtgacaagaagaaacaagcaaagaagtggcatgaaaaacaagagaagcaattagaaaaaacagctgaaaacaaaagaaaaagagatgccgcctttgttcctcccaaggaactcgtaaaggaggatcctagcacatatgcagataataacaaagatgtggctgccatggccatgtcactaaagaaaaaggcaaaggagtttgggaagcagaagtcttttgagaatgtcaatccagaagattatattgccacatctggagaacaaccccgaaaaaagaaatccaagcgggattag

SEQ ID NO: 123 - protein, 397 aa, Populus balsamifera subsp. trichocarpa
  misc_feature (1)..(397): Ceres ANNOT ID no. 1456840
  misc_feature: SWISSPROT Homolog: MIS3_SCHPO Ribosomal RNA assembly protein mis3 with e-value of 1.1e-106 and BLAST sequence identity of 61.5
  misc_feature: SWISSPROT Homolog: YCF9_YEAST Hypothetical 37.2 kDa protein in CHA1-PRD1 intergenic region with e-value of 1.4e-101 and BLAST sequence identity of 62.4
  misc_feature: SWISSPROT Homolog: HRB2_HUMAN HIV-1 Rev-binding protein 2 (Rev-interacting protein 1) (Rip-1) with e-value of 4.8e-99 and BLAST sequence identity of 53.1
  misc_feature: SWISSPROT Homolog: HRB2_MOUSE HIV-1 Rev-binding protein 2 homolog with e-value of 2.7e-96 and BLAST sequence identity of 51.8
  misc_feature: SWISSPROT Homolog: Y443_METJA Hypothetical protein MJ0443 with e-value of 7.3e-13 and BLAST sequence identity of 25.6
  misc_feature 14042:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(397): Functional Homolog of  Ceres CLONE ID no. 3036 at SEQ ID NO. 124 with e-value of 4.59E-132 and BLAST sequence identity of 72.0
MEADGAENTDISNTKKPKHKGKHDKPKPWDEDPNIDRWKIEKFDPSWNQGGMVDVSSFSTLFPKYREKYLTDAWPMVKSALKEFGIDCELNKNEGSMTVKTTIKTRDPYIIVKARDLIKLLSRSVPAPQGSTCAPADVSPVLTIQYMWAGAIKILNDDMSCDIIKIGNMIRNKERFVKRRQNLVGPNSSTLKALELLTGCYILVQGNTVAAMGSFKGLKQVRRIVEDCIQNKMHPVYHIKILMMKKELEKDPALKNENWDRKTVKQKKVKSKKKKQDTPFPPPQQPSMEDIQLETGEYFLSDKKKQAKKWHEKQEKQLEKTAENKRKRDAAFVPPKELVKEDPSTYADNNKDVAAMAMSLKKKAKEFGKQKSFENVNPEDYIATSGEQPRKKKSKRD

SEQ ID NO: 124 - protein, 345 aa, Arabidopsis thaliana
  misc_feature (1)..(345): Ceres CLONE ID no. 3062
  misc_feature (12)..(122): Pfam Name: Sas10_Utp3 Pfam Description: Sas10/Utp3 family
  misc_feature: Phenotype: INFLORESCENCE - Short Internode Useful for making modulating plant height and plants with modified flowers
  misc_feature: Phenotype: INFLORESCENCE - Short Useful for modulating plant height
MEEITKPVLVGIVKKEAPQLASVLREMKNVLDVVRSKVEALTALVKANSFPTAGGISYLEAKHLLLLSYCQDLVYYILRKAKGLSIDGHPLVRSLVEIRMFLEKIRPIDKKLQYQIQKLTTAGGPVTELAHSEGKGSGEAQKSEDLSNYKPKPDLLADKEDDQEDDGVYRPPKFAPMSMEDKTSKQERDAARKEKHFFRQATENTYMKDVLDDLEDRPEEIRDYYGVESNEQKTFMAQYERQQKAEEELFTRAPRTKEDKKREKRLKSSSGLHELTENFYDDIKFLDKDGEKPGSFGRNKGEGHSRKERQGTDMDTPVVPLAASVHQFCCHEKDTNFRFAFMIKC

SEQ ID NO: 125 - DNA, 963 bp, Populus balsamifera subsp. trichocarpa
  misc_feature (1)..(963): Ceres ANNOT ID no. 1504677
  misc_feature 14314:<222: Transcription Factor
  misc_feature: Phenotype: INFLORESCENCE - Short Internode Useful for making modulating plant height and plants with modified flowers
  misc_feature: Phenotype: INFLORESCENCE - Short Useful for modulating plant height
atggaggcggctaccaaagaagaacagattcaagtcaaagaaaaggaagctccacagttagctacagtgttgaaagaaataaaagaaggattggatatagtgaggaataaagttcaagccttaactgccaaggtaaaaacgaataattttccgactacggaagggataagctaccttgaagctaaacatttactgctactaagttattgccaatcactggttttttatttgatacgcaaggcaaaaggtttgtcaattgagaaacatcctgtagttcgtagccttgtggagataaggttgtttttggagaagatccggatgattgataaaaaacttgaatatcaaattcaaaagctcacaagggatgccggttctgcaagagatcaagtagatgtgagcgaaaacgaatctaaggcatctaagaaaccagaggataatttgaaatatagaccaaacccagacttgcttgaaagcaaaactgatatgttggctcagaatggtggtgtgtatcgaccacccaaaattgcccccatgattatggaggaggataagatgtcaaaacaggaaagaaatgctctgagaaggcagaaagagactcttcgaaaagctaaacatggttttatgaaagaactgatagatgatatggaggatagacccgctgagtttgaagatcgagcacgacaagaagaagaactatttacacgggttcctttgaccaagaaggagaaaaggaagcaaaaggatttgaagaagtcaagaaatgggttgcttggtttgactgatggattcaatgatgaaatcaaaaccttagccttggatgatgatacaaatgagcagacaacaaccatcagtaatggcggcagtgcaatgggaaaactaaagaagcgcaagctggataacaatgctgattctctggtggcttataccaagcttgatctagttcacacttcaatgttaaaatag

SEQ ID NO: 126 - protein, 320 aa, Populus balsamifera subsp. trichocarpa
  misc_feature (1)..(320): Ceres ANNOT ID no. 1504677
  misc_feature (15)..(119): Pfam Name: Sas10_Utp3 Pfam Description: Sas10/Utp3 family
  misc_feature: SWISSPROT Homolog: CN120_HUMAN Protein C14orf120 with e-value of 5.7e-32 and BLAST sequence identity of 33.3
  misc_feature: SWISSPROT Homolog: CN120_MOUSE Protein C14orf120 homolog with e-value of 3.6e-30 and BLAST sequence identity of 30.9
  misc_feature: SWISSPROT Homolog: SAS10_RAT Something about silencing protein 10(Disrupter of silencing SAS10) (Charged amino acid-rich leucine zipper 1) with e-value of 1.1e-15 and BLAST sequence identity of 28.3
  misc_feature: SWISSPROT Homolog: SAS10_MOUSE Something about silencing protein 10(Disrupter of silencing SAS10) (Charged amino acid-rich leucine zipper 1) (Crl-1) with e-value of 4.1e-14 and BLAST sequence identity of 30.0
  misc_feature: SWISSPROT Homolog: SAS10_HUMAN Something about silencing protein 10(Disrupter of silencing SAS10) (Charged amino acid-rich leucine zipper 1) with e-value of 9.7e-14 and BLAST sequence identity of 22.8
  misc_feature 14424:<222: Transcription Factor
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature (1)..(320): Functional Homolog of  Ceres CLONE ID no. 3062 at SEQ ID NO. 127 with e-value of 2.09E-72 and BLAST sequence identity of 55.5
MEAATKEEQIQVKEKEAPQLATVLKEIKEGLDIVRNKVQALTAKVKTNNFPTTEGISYLEAKHLLLLSYCQSLVFYLIRKAKGLSIEKHPVVRSLVEIRLFLEKIRMIDKKLEYQIQKLTRDAGSARDQVDVSENESKASKKPEDNLKYRPNPDLLESKTDMLAQNGGVYRPPKIAPMIMEEDKMSKQERNALRRQKETLRKAKHGFMKELIDDMEDRPAEFEDRARQEEELFTRVPLTKKEKRKQKDLKKSRNGLLGLTDGFNDEIKTLALDDDTNEQTTTISNGGSAMGKLKKRKLDNNADSLVAYTKLDLVHTSMLK

SEQ ID NO: 127 - DNA, 1071 bp, Populus balsamifera subsp. trichocarpa
  misc_feature (1)..(1071): Ceres ANNOT ID no. 1451593
  misc_feature 14527:<222: Transcription Factor
  misc_feature: Phenotype: INFLORESCENCE - Short Internode Useful for making modulating plant height and plants with modified flowers
  misc_feature: Phenotype: INFLORESCENCE - Short Useful for modulating plant height
atggaggcggctaccaaagaagaacagattcaagtcaaagaaaaggaagctccacagttagctacagtgttgaaagaaataaaagaaggattggatatagtgaggaataaagttcaagccttaactgccaaggtaaaaacgaataattttccgactacggaagggataagctaccttgaagctaaacatttactgctactaagttattgccaatcactggttttttatttgatacgcaaggcaaaaggtttgtcaattgagaaacatcctgtagttcgtagccttgtggagataaggttgtttttggagaagatccggatgattgataaaaaacttgaatatcaaattcaaaagctcacaagggatgccggttctgcaagagatcaagtagatgtgagcgaaaacgaatctaaggcatctaagaaaccagaggataatttgaaatatagaccaaacccagacttgcttgaaagcaaaactgatatgttggctcagaatggtggtgtgtatcgaccacccaaaattgcccccatgattatggaggaggataagatgtcaaaacaggaaagaaatgctctgagaaggcagaaagagactcttcgaaaagctaaacatgactactttcacaagttcactggatcacctgtcaatgatggtaaaatcaggttaaagaatatgctggactcgatagttgggaatcccaaagatatgtggaacagtttgaagatcgagcacgacaagaagaagaactatttacacgggttgcttggtttgactgatggattcaatgatgaaatcaaaaccttagccttggatgatgatacaaatgagcagacaacaaccatcagtaatggcggcagtgcaatgggaaaactaaagaagcgcaagctggataacaatgctgattctctggtggcttataccaagcttgatctagttcacaaggacgtattaatgacaacgcatcatcagtttgtgctcttgatgcgtaaaagccaaaagggattcaagagcagcattttaaattcgtggcttaaaaggatgcctacttgtgaattcatcaaaatgtag

SEQ ID NO: 128 - protein, 356 aa, Populus balsamifera subsp. trichocarpa
  misc_feature (1)..(356): Ceres ANNOT ID no. 1451593
  misc_feature (15)..(119): Pfam Name: Sas10_Utp3 Pfam Description: Sas10/Utp3 family
  misc_feature: SWISSPROT Homolog: CN120_HUMAN Protein C14orf120 with e-value of 5.7e-32 and BLAST sequence identity of 33.3
  misc_feature: SWISSPROT Homolog: CN120_MOUSE Protein C14orf120 homolog with e-value of 3.6e-30 and BLAST sequence identity of 30.9
  misc_feature: SWISSPROT Homolog: SAS10_RAT Something about silencing protein 10(Disrupter of silencing SAS10) (Charged amino acid-rich leucine zipper 1) with e-value of 1.1e-15 and BLAST sequence identity of 28.3
  misc_feature: SWISSPROT Homolog: SAS10_MOUSE Something about silencing protein 10(Disrupter of silencing SAS10) (Charged amino acid-rich leucine zipper 1) (Crl-1) with e-value of 4.1e-14 and BLAST sequence identity of 30.0
  misc_feature: SWISSPROT Homolog: SAS10_HUMAN Something about silencing protein 10(Disrupter of silencing SAS10) (Charged amino acid-rich leucine zipper 1) with e-value of 9.7e-14 and BLAST sequence identity of 22.8
  misc_feature 14639:<222: Transcription Factor
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature (1)..(356): Functional Homolog of  Ceres CLONE ID no. 3062 at SEQ ID NO. 127 with e-value of 3.69E-59 and BLAST sequence identity of 55.0
MEAATKEEQIQVKEKEAPQLATVLKEIKEGLDIVRNKVQALTAKVKTNNFPTTEGISYLEAKHLLLLSYCQSLVFYLIRKAKGLSIEKHPVVRSLVEIRLFLEKIRMIDKKLEYQIQKLTRDAGSARDQVDVSENESKASKKPEDNLKYRPNPDLLESKTDMLAQNGGVYRPPKIAPMIMEEDKMSKQERNALRRQKETLRKAKHDYFHKFTGSPVNDGKIRLKNMLDSIVGNPKDMWNSLKIEHDKKKNYLHGLLGLTDGFNDEIKTLALDDDTNEQTTTISNGGSAMGKLKKRKLDNNADSLVAYTKLDLVHKDVLMTTHHQFVLLMRKSQKGFKSSILNSWLKRMPTCEFIKM

SEQ ID NO: 129 - protein, 145 aa, Arabidopsis thaliana
  misc_feature (1)..(145): Ceres CLONE ID no. 3363
  misc_feature (52)..(124): Pfam Name: Histone Pfam Description: Core histone H2A/H2B/H3/H4
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
MAKADKKPAEKKPAEKTPAAEPAAAAEKKPKAGKKLPKEPAVAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 130 - DNA, 447 bp, Populus balsamifera subsp. trichocarpa
  misc_feature (1)..(447): Ceres ANNOT ID no. 1445515
  misc_feature 14862:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
atggcaccaagagcagagaaaaagccagcggagaagaagccggcggaggagaagaagacagtggcagagaaagcccctgcagagaagaagccaaaggcaggcaagaagctcccaaaagaaggcggagcagcagtagctggagacaagaagaagaagagggtgaagaagagcacagagacctacaagatctacatcttcaaggtcctgaaacaagttcatccagatattgggatttcaagcaaggcgatgggtatcatgaattcgttcattaatgatattttcgagaagcttgctcaggaatcctcaagacttgctaggtataacaagaagcccacgattacctcgagggagatccagactgctgtcaggttggtcttgcctggagagttggctaagcatgctgtttctgagggaactaaagcggtcactaagttcactagttcttga

SEQ ID NO: 131 - protein, 148 aa, Populus balsamifera subsp. trichocarpa
  misc_feature (1)..(148): Ceres ANNOT ID no. 1445515
  misc_feature (55)..(127): Pfam Name: Histone Pfam Description: Core histone H2A/H2B/H3/H4
  misc_feature: SWISSPROT Homolog: H2B_GOSHI Histone H2B with e-value of 2.3e-60 and BLAST sequence identity of 88.2
  misc_feature: SWISSPROT Homolog: H2B_ARATH Histone H2B with e-value of 1.6e-59 and BLAST sequence identity of 85.0
  misc_feature: SWISSPROT Homolog: H2B_TOBAC Histone H2B with e-value of 1.9e-58 and BLAST sequence identity of 84.7
  misc_feature: SWISSPROT Homolog: H2B_CAPAN Histone H2B (CaH2B) with e-value of 5.6e-57 and BLAST sequence identity of 84.7
  misc_feature: SWISSPROT Homolog: H2B1_WHEAT Histone H2B with e-value of 1.3e-55 and BLAST sequence identity of 81.2
  misc_feature 15001:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
  misc_feature (1)..(148): Functional Homolog of  Ceres CLONE ID no. 3363 at SEQ ID NO. 132 with e-value of 6.69E-60 and BLAST sequence identity of 88.1
MAPRAEKKPAEKKPAEEKKTVAEKAPAEKKPKAGKKLPKEGGAAVAGDKKKKRVKKSTETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 132 - DNA, 447 bp, Populus balsamifera subsp. trichocarpa
  misc_feature (1)..(447): Ceres ANNOT ID no. 1461861
  misc_feature 15120:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
atggcaccaaaagccgagaagaagcccgccgagaagaagcctgctgaggagaagaagacagtggcagagaaagccccggcagagaagaagccgaaggcagggaagaagcttcccaaagaaggaggcggcgctgctgccggagacaagaagaagaagcgggtgaagaagagcacggagacatacaagatttacatcttcaaggtcctaaaacaagttcatccagacatagggatttccagcaaggctatgggtatcatgaattccttcattaatgatattttcgagaagctagcacaggaatcctccaggttagccaggtacaacaaaaagcccacaattacctcaagggagatccagacggctgtgaggttggtgttgcctggagagttggccaagcatgctgtttccgagggtaccaaggctgttactaagtttacaagctcttga

SEQ ID NO: 133 - protein, 148 aa, Populus balsamifera subsp. trichocarpa
  misc_feature (1)..(148): Ceres ANNOT ID no. 1461861
  misc_feature (55)..(127): Pfam Name: Histone Pfam Description: Core histone H2A/H2B/H3/H4
  misc_feature: SWISSPROT Homolog: H2B_GOSHI Histone H2B with e-value of 2.3e-60 and BLAST sequence identity of 88.2
  misc_feature: SWISSPROT Homolog: H2B_ARATH Histone H2B with e-value of 1.6e-59 and BLAST sequence identity of 85.0
  misc_feature: SWISSPROT Homolog: H2B_TOBAC Histone H2B with e-value of 1.9e-58 and BLAST sequence identity of 84.7
  misc_feature: SWISSPROT Homolog: H2B_CAPAN Histone H2B (CaH2B) with e-value of 5.6e-57 and BLAST sequence identity of 84.7
  misc_feature: SWISSPROT Homolog: H2B1_WHEAT Histone H2B with e-value of 1.3e-55 and BLAST sequence identity of 81.2
  misc_feature 15259:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
  misc_feature (1)..(148): Functional Homolog of  Ceres CLONE ID no. 3363 at SEQ ID NO. 132 with e-value of 1.10E-59 and BLAST sequence identity of 88.1
MAPKAEKKPAEKKPAEEKKTVAEKAPAEKKPKAGKKLPKEGGGAAAGDKKKKRVKKSTETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 134 - DNA, 444 bp, Populus balsamifera subsp. trichocarpa
  misc_feature (1)..(444): Ceres ANNOT ID no. 1449363
  misc_feature 15378:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
atggcaccaaaagcagagaagaaaccggcggagaagaagccggccgaagagaagaaaacggtggcagagaaagccccagcagagaagaagccgaaggcagggaagaagctcccaaaggaaggaggagcagcagccggagagaagaagaaaaagagggtgaagaagagcacagagacatacaagatctacatctttaaggtgctgaagcaagttcatccagatatagggatctcaagcaaggccatgggcataatgaattcctttattaatgatattttcgagaagcttgcgcaggaatcctcacgacttgctaggtataacaagaagcccacaattacctcgagggaaatccagactgctgtcaggttggttttgcccggagagttggctaaacatgctgtttcagaagggactaaggctgtcaccaagttcaccagttcttga

SEQ ID NO: 135 - protein, 147 aa, Populus balsamifera subsp. trichocarpa
  misc_feature (1)..(147): Ceres ANNOT ID no. 1449363
  misc_feature (54)..(126): Pfam Name: Histone Pfam Description: Core histone H2A/H2B/H3/H4
  misc_feature: SWISSPROT Homolog: H2B_GOSHI Histone H2B with e-value of 2.3e-60 and BLAST sequence identity of 88.2
  misc_feature: SWISSPROT Homolog: H2B_ARATH Histone H2B with e-value of 1.6e-59 and BLAST sequence identity of 85.0
  misc_feature: SWISSPROT Homolog: H2B_TOBAC Histone H2B with e-value of 1.9e-58 and BLAST sequence identity of 84.7
  misc_feature: SWISSPROT Homolog: H2B_CAPAN Histone H2B (CaH2B) with e-value of 5.6e-57 and BLAST sequence identity of 84.7
  misc_feature: SWISSPROT Homolog: H2B1_WHEAT Histone H2B with e-value of 1.3e-55 and BLAST sequence identity of 81.2
  misc_feature 15517:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
  misc_feature (1)..(147): Functional Homolog of  Ceres CLONE ID no. 3363 at SEQ ID NO. 132 with e-value of 1.79E-59 and BLAST sequence identity of 87.4
MAPKAEKKPAEKKPAEEKKTVAEKAPAEKKPKAGKKLPKEGGAAAGEKKKKRVKKSTETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 136 - DNA, 423 bp, Populus balsamifera subsp. trichocarpa
  misc_feature (1)..(423): Ceres ANNOT ID no. 1465198
  misc_feature 15636:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
atggctcccaaggccgcagagaagaagccggctgagaaaaagccagcggcggcagagaaagccccagcggagaagaagccaagggcagagaagaagatacccaaagaaggagcgattgacaagaagaagaagaggtcaaagaagaacgtcgagacctacaagatctatatctttaaggtcctgaaacaggtccatcctgacattgggatctcaagcaaggcaatgggtatcatgaacagttttatcaacgatatctttgagaaactcgctcaagaggcttcaaggctcgctaggtataacaagaagcccaccattacttctcgggagatccagactgctgtcagattggttttgcctggagagcttgcgaaacatgctgtttctgaagggaccaaggctgtcaccaaatttaccagctcatag

SEQ ID NO: 137 - protein, 140 aa, Populus balsamifera subsp. trichocarpa
  misc_feature (1)..(140): Ceres ANNOT ID no. 1465198
  misc_feature (47)..(119): Pfam Name: Histone Pfam Description: Core histone H2A/H2B/H3/H4
  misc_feature: SWISSPROT Homolog: H2B_GOSHI Histone H2B with e-value of 2.3e-60 and BLAST sequence identity of 88.2
  misc_feature: SWISSPROT Homolog: H2B_ARATH Histone H2B with e-value of 1.6e-59 and BLAST sequence identity of 85.0
  misc_feature: SWISSPROT Homolog: H2B_TOBAC Histone H2B with e-value of 1.9e-58 and BLAST sequence identity of 84.7
  misc_feature: SWISSPROT Homolog: H2B_CAPAN Histone H2B (CaH2B) with e-value of 5.6e-57 and BLAST sequence identity of 84.7
  misc_feature: SWISSPROT Homolog: H2B1_WHEAT Histone H2B with e-value of 1.3e-55 and BLAST sequence identity of 81.2
  misc_feature 15775:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
  misc_feature (1)..(140): Functional Homolog of  Ceres CLONE ID no. 3363 at SEQ ID NO. 132 with e-value of 1.99E-58 and BLAST sequence identity of 89.7
MAPKAAEKKPAEKKPAAAEKAPAEKKPRAEKKIPKEGAIDKKKKRSKKNVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 138 - DNA, 420 bp, Populus balsamifera subsp. trichocarpa
  misc_feature (1)..(420): Ceres ANNOT ID no. 1518517
  misc_feature 15891:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
atggcccctaaggcagagaagaagccggctgagaaaaagccagcggcggcagagaaagccccagctgagaagaagccaagagcagagaagaagatacccaaagaaggagcgattgacaagaagaagaagaggtcaaagaagaacgtcgagacctacaagatctatatctttaaggtcctgaaacaggtccatcctgacattgggatctccagcaaggcaatgggtatcatgaacagttttatcaacgatatctttgagaagctcgctcaagagtcatcgaggcttgcaaggtacaacaagaagcctaccattacttctcgggagatccagacagctgtcagactggttttgcctggagagcttgcgaaacatgctgtctctgaagggaccaaggctgttaccaagtttacaagctcttag

SEQ ID NO: 139 - protein, 139 aa, Populus balsamifera subsp. trichocarpa
  misc_feature (1)..(139): Ceres ANNOT ID no. 1518517
  misc_feature (46)..(118): Pfam Name: Histone Pfam Description: Core histone H2A/H2B/H3/H4
  misc_feature: SWISSPROT Homolog: H2B_GOSHI Histone H2B with e-value of 2.3e-60 and BLAST sequence identity of 88.2
  misc_feature: SWISSPROT Homolog: H2B_ARATH Histone H2B with e-value of 1.6e-59 and BLAST sequence identity of 85.0
  misc_feature: SWISSPROT Homolog: H2B_TOBAC Histone H2B with e-value of 1.9e-58 and BLAST sequence identity of 84.7
  misc_feature: SWISSPROT Homolog: H2B_CAPAN Histone H2B (CaH2B) with e-value of 5.6e-57 and BLAST sequence identity of 84.7
  misc_feature: SWISSPROT Homolog: H2B1_WHEAT Histone H2B with e-value of 1.3e-55 and BLAST sequence identity of 81.2
  misc_feature 16030:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Oval Shaped Useful for making plants with increased biomass and foliage
  misc_feature (1)..(139): Functional Homolog of  Ceres CLONE ID no. 3363 at SEQ ID NO. 132 with e-value of 2.60E-58 and BLAST sequence identity of 91.1
MAPKAEKKPAEKKPAAAEKAPAEKKPRAEKKIPKEGAIDKKKKRSKKNVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 140 - protein, 258 aa, Arabidopsis thaliana
  misc_feature (1)..(258): Ceres CLONE ID no. 3457
  misc_feature (78)..(258): Pfam Name: Allene_ox_cyc Pfam Description: Allene oxide cyclase
  misc_feature: Phenotype: INFLORESCENCE - Late Flowering Useful for modulating flowering time
MASSSAAMSLESISMTTLNNLSRNHQSHRSSLLGFSRSFQNLGISSNGPDFSSRSRSTTSKNLNVTRAFFWNWGKKTENSRPSKIQELNVYELNEGDRNSPAVLKLGKKPTELCLGDLVPFTNKLYTGDLKKRVGITAGLCVLIQHVPEKSGDRFEASYSFYFGDYGHLSVQGQYLTYEDTFLAVTGGSGIFEGAYGQVKLRQLVYPTKLFYTFYLKGLANDLPLELTGTAVTPSKDVKPAPEAKAMEPSGVISNFTN

SEQ ID NO: 141 - DNA, 777 bp, Populus balsamifera subsp. trichocarpa
  misc_feature (1)..(777): Ceres ANNOT ID no. 1458875
  misc_feature 16225:<222: Transcription Factor
  misc_feature: Phenotype: INFLORESCENCE - Late Flowering Useful for modulating flowering time
atggcctctaccagctctctcaagccagtctcttctctcaaactctctaacccaagatcccaatctctcttccaatcccaacaacaattgggtttcactcactcacaaggctttgcaattcaacacctcaaactctccaaagcaaatcgtgatcaagatcatttctcaacaaaaagaagctccggggacttcaccaccagagctttcttcttcaacaagaagcctaggtcccctccagtatctccaaaaccaactaaagttcaagagctgaatgtgtatgaaatcaacgagcgagacagaggcagcccagcctttttaaaactgagtcaaaaaccccaaaactctctcggtgaccttgtgcctttctccaacaagctttactctggagacttacagaaacggctaggcataacttctggtctctgtgtactaatccaaaatgtgccagaaaagaaaggtgatagatatgaggcaacatacagcttctactttggtgattatggtcacatatcagtacaaggagcatacctgacctatgaggatacctacctagctgtgactggtgggtctgggatctttgagggtgtgtatggacaggtcaaattgcagcaacttgtgtttccgttcaagttgttttacactttctatttgaagggaatacctgatttgccagctgaacttctgggacagccagtcaccccatcgccaagtgtggaaccggctcctgctgctaaggccacggaacctcgtgggattatccaaaacttcactaaatga

SEQ ID NO: 142 - protein, 258 aa, Populus balsamifera subsp. trichocarpa
  misc_feature (1)..(258): Ceres ANNOT ID no. 1458875
  misc_feature (80)..(258): Pfam Name: Allene_ox_cyc Pfam Description: Allene oxide cyclase
  misc_feature: SWISSPROT Homolog: AOC3_ARATH Allene oxide cyclase 3, chloroplast precursor (EC 5.3.99.6) with e-value of 1.5e-136 and BLAST sequence identity of 100.0
  misc_feature: SWISSPROT Homolog: AOC4_ARATH Allene oxide cyclase 4, chloroplast precursor (EC 5.3.99.6) with e-value of 9.7e-101 and BLAST sequence identity of 76.5
  misc_feature: SWISSPROT Homolog: AOC2_ARATH Allene oxide cyclase 2, chloroplast precursor (EC 5.3.99.6) with e-value of 1.1e-99 and BLAST sequence identity of 76.9
  misc_feature: SWISSPROT Homolog: AOC1_ARATH Allene oxide cyclase 1, chloroplast precursor (EC 5.3.99.6) (Early-responsive to dehydration 12 protein) with e-value of 3.0e-99 and BLAST sequence identity of 76.0
  misc_feature 16314:<222: Transcription Factor
  misc_feature: Phenotype: INFLORESCENCE - Late Flowering Useful for modulating flowering time
  misc_feature (1)..(258): Functional Homolog of  Ceres CLONE ID no. 3457 at SEQ ID NO. 143 with e-value of 1.29E-74 and BLAST sequence identity of 62.9
MASTSSLKPVSSLKLSNPRSQSLFQSQQQLGFTHSQGFAIQHLKLSKANRDQDHFSTKRSSGDFTTRAFFFNKKPRSPPVSPKPTKVQELNVYEINERDRGSPAFLKLSQKPQNSLGDLVPFSNKLYSGDLQKRLGITSGLCVLIQNVPEKKGDRYEATYSFYFGDYGHISVQGAYLTYEDTYLAVTGGSGIFEGVYGQVKLQQLVFPFKLFYTFYLKGIPDLPAELLGQPVTPSPSVEPAPAAKATEPRGIIQNFTK

SEQ ID NO: 143 - DNA, 756 bp, Populus balsamifera subsp. trichocarpa
  misc_feature (1)..(756): Ceres ANNOT ID no. 1449635
  misc_feature 16398:<222: Transcription Factor
  misc_feature: Phenotype: INFLORESCENCE - Late Flowering Useful for modulating flowering time
atggcggcttattcaagctctgctttgagatccatctcttctgtgaaagcatctgcagcaagatcacacacctgtggcgttgtgcccaccaaaccatcactcttgtctttcaagctggcccaaaacccatgtctcctcacaaaaagtacaagccttggcaacttctctgggacgaagagatccttctcttgcaaaagccaagctgcctcgactgaggattcaagacccaccaaagttcaagagctgagtgtctatgagatcaatgagagagaccgtggaagccctgcttatcttcgtttgagccagaaatctgttaattctcttggcgatcttgtgccttttagcaacaaactttacaccggagacctacagaaacgggtaggaataacagctggactatgcgtgctgatccaaaacaaaccggaaaagaaaggtgacaggtatgaggcgatctacagcttctactttggcgactacggtcacattgcggtgcagggatcttatctgacctatgaggacacgtatctcgctgtgactggagggtcaggtatttttgaaggggtgtatggtcaggttaagctacagcagcttgtgttccctttcaagctgttctacaccttttatttgaagggtctcaaggcggacttgcctgaggagctgcttgggaaggctgtcgagcctagccccgctgtcgagccgagccccgcggctaaggcttgtgagccacacgctgtcattgctaattatactaactaa

SEQ ID NO: 144 - protein, 251 aa, Populus balsamifera subsp. trichocarpa
  misc_feature (1)..(251): Ceres ANNOT ID no. 1449635
  misc_feature (72)..(251): Pfam Name: Allene_ox_cyc Pfam Description: Allene oxide cyclase
  misc_feature: SWISSPROT Homolog: AOC3_ARATH Allene oxide cyclase 3, chloroplast precursor (EC 5.3.99.6) with e-value of 1.5e-136 and BLAST sequence identity of 100.0
  misc_feature: SWISSPROT Homolog: AOC4_ARATH Allene oxide cyclase 4, chloroplast precursor (EC 5.3.99.6) with e-value of 9.7e-101 and BLAST sequence identity of 76.5
  misc_feature: SWISSPROT Homolog: AOC2_ARATH Allene oxide cyclase 2, chloroplast precursor (EC 5.3.99.6) with e-value of 1.1e-99 and BLAST sequence identity of 76.9
  misc_feature: SWISSPROT Homolog: AOC1_ARATH Allene oxide cyclase 1, chloroplast precursor (EC 5.3.99.6) (Early-responsive to dehydration 12 protein) with e-value of 3.0e-99 and BLAST sequence identity of 76.0
  misc_feature 16487:<222: Transcription Factor
  misc_feature: Phenotype: INFLORESCENCE - Late Flowering Useful for modulating flowering time
  misc_feature (1)..(251): Functional Homolog of  Ceres CLONE ID no. 3457 at SEQ ID NO. 143 with e-value of 1.89E-71 and BLAST sequence identity of 63.1
MAAYSSSALRSISSVKASAARSHTCGVVPTKPSLLSFKLAQNPCLLTKSTSLGNFSGTKRSFSCKSQAASTEDSRPTKVQELSVYEINERDRGSPAYLRLSQKSVNSLGDLVPFSNKLYTGDLQKRVGITAGLCVLIQNKPEKKGDRYEAIYSFYFGDYGHIAVQGSYLTYEDTYLAVTGGSGIFEGVYGQVKLQQLVFPFKLFYTFYLKGLKADLPEELLGKAVEPSPAVEPSPAAKACEPHAVIANYTN

SEQ ID NO: 145 - protein, 378 aa, Arabidopsis thaliana
  misc_feature (1)..(378): Ceres CLONE ID no. 3542
  misc_feature (236)..(262): Pfam Name: zf-CCCH Pfam Description: Zinc finger C-x8-C-x5-C-x3-H type (and similar)
  misc_feature (312)..(349): Pfam Name: zf-C3HC4 Pfam Description: Zinc finger, C3HC4 type (RING finger)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
MEPFVVKENIVASASSPMKKRRIDHTESADGSAINASNSSSIGGNDTVMNMAEFGNDNSNNQESQQVCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 146 - DNA, 972 bp, Populus balsamifera subsp. trichocarpa
  misc_feature (1)..(972): Ceres ANNOT ID no. 1471301
  misc_feature 16695:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
atggcagatccaactgaacgcgaacctcaacagactgaagcagtgtgcaatttttttagaaaaccgatgaagaacaagaatattagaaagagaatgattgatgaggatgaggatgaggattcaaaaactcaaacctctctgttacacagtcagaaaaaagccccgaaagctgacaataagctctacttttctactggaccgttaaagaaatcgtctgaatcaaatgcagaacctgaaaggttgttatttcaattcgagtcttctaaggaaattcaagttcagcatgatagtagagcaactgcaactctagaaactgagactgagttttcgaaagatgcccgggccattcgtgagagagctctaaagcaagctgatgatgctttgaagggtaaaaaaatgagttctggtgatgaaaagttgtacaaggggattcatgggtatactgatcataaagctgggtttcgaagagagcaaacgatttcaagtgagaaagcaggtggatcacatgggcctctcagggcttctgctcacataagagtgtcagcaaggtttgattatcagccggatatatgtaaggattataaagaaactggttactgtgggtatggagattcatgcaagtttatgcatgatcgaggggattacaagtctgggtggcagatggagaaagaatgggaggaagccgaaaaggcaaggaagagaaatttggccttgggaatggatgatgaggaggttgggggtgcagggcacgatgatgatgacgaagatgagttgccatttgcttgtttcatttgtagggagaattttgtggatcctgtcatgactaaatgcaaacattacttctgtgagcattgcgctttaaagcatcatgcgaagaacaagaagtgttttgtgtgcaatgaacctactcttggcatcttcaatgcagctcatgaaatacgcaaaaagatggctgatgctggtaaacgatag

SEQ ID NO: 147 - protein, 323 aa, Populus balsamifera subsp. trichocarpa
  misc_feature (1)..(323): Ceres ANNOT ID no. 1471301
  misc_feature (186)..(212): Pfam Name: zf-CCCH Pfam Description: Zinc finger C-x8-C-x5-C-x3-H type (and similar)
  misc_feature (262)..(299): Pfam Name: zf-C3HC4 Pfam Description: Zinc finger, C3HC4 type (RING finger)
  misc_feature: SWISSPROT Homolog: ZN183_BOVIN Zinc finger protein 183 with e-value of 3.8e-58 and BLAST sequence identity of 40.7
  misc_feature: SWISSPROT Homolog: R113A_HUMAN RING finger protein 113A (Zinc finger protein 183) with e-value of 9.2e-57 and BLAST sequence identity of 40.5
  misc_feature: SWISSPROT Homolog: R113B_HUMAN RING finger protein 113B (Zinc finger protein 183-like 1) with e-value of 1.1e-55 and BLAST sequence identity of 39.3
  misc_feature: SWISSPROT Homolog: RN113_CAEEL Putative RING finger protein 113 homolog with e-value of 2.5e-47 and BLAST sequence identity of 38.4
  misc_feature: SWISSPROT Homolog: CWC24_USTMA Pre-mRNA-splicing factor CWC24 with e-value of 2.2e-46 and BLAST sequence identity of 37.3
  misc_feature 16824:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(323): Functional Homolog of  Ceres CLONE ID no. 3542 at SEQ ID NO. 148 with e-value of 6.09E-130 and BLAST sequence identity of 74.5
MADPTEREPQQTEAVCNFFRKPMKNKNIRKRMIDEDEDEDSKTQTSLLHSQKKAPKADNKLYFSTGPLKKSSESNAEPERLLFQFESSKEIQVQHDSRATATLETETEFSKDARAIRERALKQADDALKGKKMSSGDEKLYKGIHGYTDHKAGFRREQTISSEKAGGSHGPLRASAHIRVSARFDYQPDICKDYKETGYCGYGDSCKFMHDRGDYKSGWQMEKEWEEAEKARKRNLALGMDDEEVGGAGHDDDDEDELPFACFICRENFVDPVMTKCKHYFCEHCALKHHAKNKKCFVCNEPTLGIFNAAHEIRKKMADAGKR

SEQ ID NO: 148 - protein, 492 aa, Arabidopsis thaliana
  misc_feature (1)..(492): Ceres CLONE ID no. 3699
  misc_feature (102)..(405): Pfam Name: Aminotran_3 Pfam Description: Aminotransferase class-III
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
PTSITNSDRQRQRVSDQRCRRRLQDRELLWGFRVPRRSRKEFLLHQLLTDAASRCLFPSTRRRKVSVFRNLRKLSMLLKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTETCMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFTEGPVYNFADAKKSDTEKFGRFFRGMLEEGVYFAPSQFEAGFTSLAHTPEDIQLTIAAAERVLSRI

SEQ ID NO: 149 - DNA, 1440 bp, Populus balsamifera subsp. trichocarpa
  misc_feature (1)..(1440): Ceres ANNOT ID no. 1527319
  misc_feature 17069:<222: Transcription Factor
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
atggcttctacaatcacaggagttagtgttggtttaggactttcatgttctacaacaagaaagctgactcagaaaagaaatccttcatcatcaaggttgtctttttgcagcattaaaatggctgtctctgttgaagaagagaaaaagaagaagagtttcactcttgaaaaatctgaagaagctttcagcgctgctaaggaaatgatgccaggaggtgtgaattcacctgtacgtgcttttaaatctgttggtggacaacctattgtgtttgattctgtcaagggttctcacatgagggacattgatggaaatgattacattgattatgttggttcttgggggcctgctataattggtcatgcagatgatgaggtacttgcagccttgtctgaaacaatgaagaaagggaccagctttggtgccccttgtcttctagagaatgttttggcagagatggtgatcaaagcagttccaagcatagaaatggtacgatttgttaactcaggcacagaagcatgcatgggtgtgcttcgcctggcccgtgcctacactggacgggagaagattatcaagtttgagggctgttaccatggccatgctgatccattccttgtcaaagcaggtagtggtgttgcaacccttgggctcccagactcgcctggtgtccccaaagcagcaacctatgaaactctaacagccccctataatgacattgctgctgtggaaaatctttttgagaacaacaaaggagagatttgtggaataatccttgaacctgttgtgggaaatgctggtttcatccccccgaaacctgaatttattaatgccattcgcaggatcactgaagaaaataatgctcttctaatatttgatgaagttatgactggattccgtttgtcatacggtggagctcaggagtattttggcataactcctgatttaacaacactagggaagatcattggtggtggtctgccagttggtgcatatggtgggagaagggagattatggagatggttgcacctgcagggccaatgtaccaggccggaaccttgagtgggaatcccttggctatgactgcagggatacacacactgaagcggttgcagaaaccaggaagttacgaatacttggataagattaccagtgaacttgttcagggcattattgatgctggcaagaaaactgggcatgcaatttgtggaggctatatacgtggaatgtttgggtttttctttacggaaggtcctgtttacaactttgctgatgcaaagaaaagtgacacagcaaagttcgccagattttaccaaggaatgctgagggagggtgtatactttgcaccgtcacaatttgaagctgggtttacaagcttggcacatactgctgaagatatccaaaagacaatagcagcagccgaaaatgttctccggcagatttaa

SEQ ID NO: 150 - protein, 440 aa, Populus balsamifera subsp. trichocarpa
  misc_feature (1)..(440): Ceres ANNOT ID no. 1527319
  misc_feature (50)..(376): Pfam Name: Aminotran_3 Pfam Description: Aminotransferase class-III
  misc_feature: SWISSPROT Homolog: GSA1_ARATH Glutamate-1-semialdehyde 2,1-aminomutase 1, chloroplast precursor with e-value of 9.4e-222 and BLAST sequence identity of 99.3
  misc_feature: SWISSPROT Homolog: GSA1_ARATH EC 5.4.3.8 (GSA 1) (Glutamate-1-semialdehyde aminotransferase 1) (GSA-AT 1)
  misc_feature: SWISSPROT Homolog: GSA_BRANA Glutamate-1-semialdehyde 2,1-aminomutase 1, chloroplast precursor with e-value of 1.5e-216 and BLAST sequence identity of 96.9
  misc_feature: SWISSPROT Homolog: GSA_BRANA EC 5.4.3.8 (GSA) (Glutamate-1-semialdehyde aminotransferase) (GSA-AT)
  misc_feature: SWISSPROT Homolog: GSA2_ARATH Glutamate-1-semialdehyde 2,1-aminomutase 1, chloroplast precursor with e-value of 1.3e-206 and BLAST sequence identity of 91.8
  misc_feature: SWISSPROT Homolog: GSA2_ARATH EC 5.4.3.8 (GSA 2) (Glutamate-1-semialdehyde aminotransferase 2) (GSA-AT 2)
  misc_feature: SWISSPROT Homolog: GSA_LYCES Glutamate-1-semialdehyde 2,1-aminomutase 1, chloroplast precursor with e-value of 9.5e-197 and BLAST sequence identity of 87.4
  misc_feature: SWISSPROT Homolog: GSA_LYCES chloroplast precursor EC 5.4.3.8 (GSA) (Glutamate-1-semialdehyde aminotransferase) (GSA-AT)
  misc_feature: SWISSPROT Homolog: GSA_TOBAC Glutamate-1-semialdehyde 2,1-aminomutase 1, chloroplast precursor with e-value of 4.7e-195 and BLAST sequence identity of 86.7
  misc_feature: SWISSPROT Homolog: GSA_TOBAC EC 5.4.3.8 (GSA) (Glutamate-1-semialdehyde aminotransferase) (GSA-AT)
  misc_feature 17233:<222: Transcription Factor
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
  misc_feature (1)..(440): Functional Homolog of  Ceres CLONE ID no. 3699 at SEQ ID NO. 151 with e-value of 5.39E-193 and BLAST sequence identity of 85.0
MAVSVEEEKKKKSFTLEKSEEAFSAAKEMMPGGVNSPVRAFKSVGGQPIVFDSVKGSHMRDIDGNDYIDYVGSWGPAIIGHADDEVLAALSETMKKGTSFGAPCLLENVLAEMVIKAVPSIEMVRFVNSGTEACMGVLRLARAYTGREKIIKFEGCYHGHADPFLVKAGSGVATLGLPDSPGVPKAATYETLTAPYNDIAAVENLFENNKGEICGIILEPVVGNAGFIPPKPEFINAIRRITEENNALLIFDEVMTGFRLSYGGAQEYFGITPDLTTLGKIIGGGLPVGAYGGRREIMEMVAPAGPMYQAGTLSGNPLAMTAGIHTLKRLQKPGSYEYLDKITSELVQGIIDAGKKTGHAICGGYIRGMFGFFFTEGPVYNFADAKKSDTAKFARFYQGMLREGVYFAPSQFEAGFTSLAHTAEDIQKTIAAAENVLRQI

SEQ ID NO: 151 - DNA, 1626 bp, Populus balsamifera subsp. trichocarpa
  misc_feature (1)..(1626): Ceres ANNOT ID no. 1473907
  misc_feature 17357:<222: Transcription Factor
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
atggctgctctctcttacaatatctttatcatcatcttgaccagacacagattgagaatggcttctacaatcacaggagttagtgttggtttaggactttcatgttctacaacaagaaagctgactcagaaaagaaatccttcatcatcaaggttgtctttttgcagcattaaaatggctgtctctgttgaagaagagaaaaagaagaagagtttcactcttgaaaaatctgaagaagctttcagcgctgctaaggaaatgatgccaggaggtgtgaattcacctgtacgtgcttttaaatctgttggtggacaacctattgtgtttgattctgtcaagggttctcacatgagggacattgatggaaatgattacattgattatgttggttcttgggggcctgctataattggtcatgcagatgatgaggttctattcttcttcaccgccatttgcattttcagtatctatgaacgtttgtctttctgtgagagtcttggtactcaagattgttcacattccattttattagagaagtggcgcatcactaaaagtagagtacttgcagccttgtctgaaacaatgaagaaagggaccagctttggtgccccttgtcttctagagaatgttttggcagagatggtgatcaaagcagttccaagcatagaaatggtacgatttgttaactcaggcacagaagcatgcatgggtgtgcttcgcctggcccgtgcctacactggacgggagaagattatcaagtttgagggctgttaccatggccatgctgatccattccttgtcaaagcaggtagtggtgttgcaacccttgggctcccagactcgcctggtgtccccaaagcagcaacctatgaaactctaacagccccctataatgacattgctgctgtggaaaatctttttgagaacaacaaaggagagatttgtggaataatccttgaacctgttgtgggaaatgctggtttcatccccccgaaacctgaatttattaatgccattcgcaggatcactgaagaaaataatgctcttctaatatttgatgaagttatgactggattccgtttgtcatacggtggagctcaggagtattttggcataactcctgatttaacaacactagggaagatcattggtggtggtctgccagttggtgcatatggtgggagaagggagattatggagatggttgcacctgcagggccaatgtaccaggccggaaccttgagtgggaatcccttggctatgactgcagggatacacacactgaagcggttgcagaaaccaggaagttacgaatacttggataagattaccagtgaacttgttcagggcattattgatgctggcaagaaaactgggcatgcaatttgtggaggctatatacgtggaatgtttgggtttttctttacggaaggtcctgtttacaactttgctgatgcaaagaaaagtgacacagcaaagttcgccagattttaccaaggaatgctgagggagggtgtatactttgcaccgtcacaatttgaagctgggtttacaagcttggcacatactgctgaagatatccaaaagacaatagcagcagccgaaaatgttctccggcagatttaa

SEQ ID NO: 152 - protein, 483 aa, Populus balsamifera subsp. trichocarpa
  misc_feature (1)..(483): Ceres ANNOT ID no. 1473907
  misc_feature (61)..(82): Pfam Name: Aminotran_3 Pfam Description: Aminotransferase class-III
  misc_feature: SWISSPROT Homolog: GSA1_ARATH Glutamate-1-semialdehyde 2,1-aminomutase 1, chloroplast precursor with e-value of 9.4e-222 and BLAST sequence identity of 99.3
  misc_feature: SWISSPROT Homolog: GSA1_ARATH EC 5.4.3.8 (GSA 1) (Glutamate-1-semialdehyde aminotransferase 1) (GSA-AT 1)
  misc_feature: SWISSPROT Homolog: GSA_BRANA Glutamate-1-semialdehyde 2,1-aminomutase 1, chloroplast precursor with e-value of 1.5e-216 and BLAST sequence identity of 96.9
  misc_feature: SWISSPROT Homolog: GSA_BRANA EC 5.4.3.8 (GSA) (Glutamate-1-semialdehyde aminotransferase) (GSA-AT)
  misc_feature: SWISSPROT Homolog: GSA2_ARATH Glutamate-1-semialdehyde 2,1-aminomutase 1, chloroplast precursor with e-value of 1.3e-206 and BLAST sequence identity of 91.8
  misc_feature: SWISSPROT Homolog: GSA2_ARATH EC 5.4.3.8 (GSA 2) (Glutamate-1-semialdehyde aminotransferase 2) (GSA-AT 2)
  misc_feature: SWISSPROT Homolog: GSA_LYCES Glutamate-1-semialdehyde 2,1-aminomutase 1, chloroplast precursor with e-value of 9.5e-197 and BLAST sequence identity of 87.4
  misc_feature: SWISSPROT Homolog: GSA_LYCES chloroplast precursor EC 5.4.3.8 (GSA) (Glutamate-1-semialdehyde aminotransferase) (GSA-AT)
  misc_feature: SWISSPROT Homolog: GSA_TOBAC Glutamate-1-semialdehyde 2,1-aminomutase 1, chloroplast precursor with e-value of 4.7e-195 and BLAST sequence identity of 86.7
  misc_feature: SWISSPROT Homolog: GSA_TOBAC EC 5.4.3.8 (GSA) (Glutamate-1-semialdehyde aminotransferase) (GSA-AT)
  misc_feature 17527:<222: Transcription Factor
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
  misc_feature (1)..(483): Functional Homolog of  Ceres CLONE ID no. 3699 at SEQ ID NO. 151 with e-value of 3.89E-183 and BLAST sequence identity of 85.0
MAVSVEEEKKKKSFTLEKSEEAFSAAKEMMPGGVNSPVRAFKSVGGQPIVFDSVKGSHMRDIDGNDYIDYVGSWGPAIIGHADDEVLFFFTAICIFSIYERLSFCESLGTQDCSHSILLEKWRITKSRVLAALSETMKKGTSFGAPCLLENVLAEMVIKAVPSIEMVRFVNSGTEACMGVLRLARAYTGREKIIKFEGCYHGHADPFLVKAGSGVATLGLPDSPGVPKAATYETLTAPYNDIAAVENLFENNKGEICGIILEPVVGNAGFIPPKPEFINAIRRITEENNALLIFDEVMTGFRLSYGGAQEYFGITPDLTTLGKIIGGGLPVGAYGGRREIMEMVAPAGPMYQAGTLSGNPLAMTAGIHTLKRLQKPGSYEYLDKITSELVQGIIDAGKKTGHAICGGYIRGMFGFFFTEGPVYNFADAKKSDTAKFARFYQGMLREGVYFAPSQFEAGFTSLAHTAEDIQKTIAAAENVLRQI

SEQ ID NO: 153 - protein, 377 aa, Arabidopsis thaliana
  misc_feature (1)..(377): Ceres CLONE ID no. 3819
  misc_feature (8)..(377): Pfam Name: Actin Pfam Description: Actin
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 154 - DNA, 1134 bp, Populus balsamifera subsp. trichocarpa
  misc_feature (1)..(1134): Ceres ANNOT ID no. 1441039
  misc_feature 17774:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggccgatgccgaggatattcaaccccttgtctgtgacaatggaactggaatggtgaaggctgggtttgcaggtgatgatgcacccagggcagtgtttcccagtattgtgggtagaccaagacacactggtgtcatggttggaatggggcagaaggatgcctatgttggtgatgaagcacaatctaaaagaggtatcttgaccttgaaataccccattgagcacggtattgtaagcaactgggatgatatggagaagatttggcatcacactttctacaatgagcttcgtgttgctcctgaagagcacccagtcctcctgactgaggctcccctcaaccctaaggctaacagagagaagatgactcaaattatgtttgagaccttcaatgttcctgcaatgtatgttgccatccaggctgtcctttccctgtatgccagtggtcgtacaactggtattgtgttggattctggtgatggtgtgagtcacactgtgccaatctatgaaggttatgcccttccacacgccatccttcgtttggatcttgctggtcgtgacctcaccgatgctttgatgaagattctgactgagagaggttacatgttcaccaccactgctgaacgggaaattgtccgtgatatgaaggagaaacttgcgtatgttgccctcgactacgagcaggagcttgagactgccaagagcagctcctctgttgagaagaactacgagcttcctgatggtcaggtcatcaccatcggagctgagagattccgttgcccagaagtcctcttccagccttctctcattggaatggaagctgctggcatccacgagactacatacaactcaatcatgaagtgtgatgtggatattagaaaggatctgtatggtaacattgtgctcagtggtggttccactatgttccctggtattgctgaccgaatgagcaaggagatcaccgcccttgccccaagcagcatgaagatcaaggtggttgcaccaccagagagaaagtacagtgtctggattggaggatctatccttgcttccctcagcaccttccagcagatgtggatttccaagggtgagtatgatgagtctggcccatccattgtccacaggaagtgcttctaa

SEQ ID NO: 155 - protein, 377 aa, Populus balsamifera subsp. trichocarpa
  misc_feature (1)..(377): Ceres ANNOT ID no. 1441039
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 17892:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 2.99E-192 and BLAST sequence identity of 92.8
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 156 - DNA, 1134 bp, Populus balsamifera subsp. trichocarpa
  misc_feature (1)..(1134): Ceres ANNOT ID no. 1482966
  misc_feature 18011:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggccgattctgaggatattcagccccttgtctgcgacaatggaactggaatggtgaaggctgggtttgctggggatgatgctcccagggcagtgtttccaagtattgtgggtagaccaagacacactggtgtcatggttggaatggggcagaaggatgcttatgttggtgacgaagcacaatctaagagaggtatcttgaccttgaaataccctattgagcatggtattgttagcaactgggatgatatggagaagatttggcatcacactttctacaatgagcttcgtgttgctcctgaggagcacccagtcctccttacagaggctcctcttaaccctaaggctaacagagagaagatgactcaaatcatgtttgagaccttcaatgtgcctgcaatgtatgttgctatccaggctgtcctttccctgtatgccagtggtcgtacaactggtattgtgctggattctggtgatggtgtgtctcacactgtgcccatctatgaagggtatgcccttccacatgccatccttcgtttggatcttgctggtcgtgatctcactgatgctttgatgaagatcctcaccgagagaggttacatgttcaccaccactgctgaacgggaaattgtccgtgacatgaaggagaaacttgcatatgttgcccttgactatgagcaggagcttgagactgccaagagtagctcctctgttgagaagaactatgagctacctgatggtcaggtcatcaccattggagctgagagattccgttgcccagaagtcctcttccagccatctctcatcggaatggaagctgctggtatccacgagactacttacaattctatcatgaagtgtgatgtggatatcagaaaggatctatatggtaatattgtgctcagtggtggttccactatgttccctggtattgctgaccgtatgagcaaggaaatcactgcccttgccccaagcagcatgaagattaaggttgttgcaccaccagagagaaaatacagtgtctggattggagggtcaatccttgcatctctcagcaccttccagcagatgtggatttccaagggtgagtacgacgagtctggcccatccatcgtccacaggaagtgcttctaa

SEQ ID NO: 157 - protein, 377 aa, Populus balsamifera subsp. trichocarpa
  misc_feature (1)..(377): Ceres ANNOT ID no. 1482966
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 18129:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 6.19E-192 and BLAST sequence identity of 92.5
MADSEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 158 - DNA, 1134 bp, Populus balsamifera subsp. trichocarpa
  misc_feature (1)..(1134): Ceres ANNOT ID no. 1454656
  misc_feature 18248:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcagaaagtgaagatattcagcctcttgtttgcgacaatggtaccggaatggtcaaggctgggtttgccggagatgatgcaccaagggctgttttccctagcattgtgggtcgcccacgccacaccggtgtgatggttggtatgggtcaaaaggatgcgtatgttggtgatgaggcacaatcaaagagaggtattttgactttgaaatacccaattgagcatggtattgttagcaattgggatgatatggagaagatttggcatcacaccttctacaatgagctccgtgtggctcctgaagagcatccggttcttcttacagaagctcctcttaacccaaaagccaatcgtgagaaaatgacccagatcatgtttgagaccttcaacactcccgcaatgtacgttgctatccaggctgtcctttccctttatgccagtggtcgtacaactggtattgttctggactctggagatggtgtgagtcacacagttcccatctatgaaggctatgccctcccacatgccattctgcgtcttgacctggcaggccgtgatctcactgatgccctaatgaaaatcttgactgaacgtggctactccttcaccaccactgcagagcgtgaaattgtaagggacatgaaggagaaactagcctacattgctcttgattatgagcaagagctggagacagcaaagaccagctcatctgttgagaagagctatgaacttccagatgggcaggttatcaccattggagctgaaagattccgttgtccagaggtcctcttccaaccatccatgatagggatggaagctgctggcatacatgaaacaacatacaattctatcatgaagtgtgatgtcgatattaggaaggatctctatggcaatattgttctcagtggtggctctactatgttcccaggcattgctgataggatgagcaaggaaattacagcattggctcccagtagcatgaagattaaggtggttgcaccaccagaaaggaagtacagtgtctggataggaggctccattttggcatccctcagcaccttccagcagatgtggattgcaaaggcagagtatgatgagtccggtccatcaattgtccacaggaagtgcttttaa

SEQ ID NO: 159 - protein, 377 aa, Populus balsamifera subsp. trichocarpa
  misc_feature (1)..(377): Ceres ANNOT ID no. 1454656
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 18366:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 7.89E-192 and BLAST sequence identity of 92.3
MAESEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYSFTTTAEREIVRDMKEKLAYIALDYEQELETAKTSSSVEKSYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 160 - DNA, 1134 bp, Populus balsamifera subsp. trichocarpa
  misc_feature (1)..(1134): Ceres ANNOT ID no. 1528263
  misc_feature 18485:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcagagagtgaggatattcagcctcttgtttgcgacaatggtaccggaatggtcaaggctgggtttgctggggatgatgcaccaagggctgtttttccaagcatcgtgggtcgcccacgccacactggagtgatggttggcatgggtcaaaaagatgcctatgttggcgatgaggctcaatcaaagagaggtattttgactttgaaatacccaattgagcatggtatcgttagcaactgggatgatatggagaagatttggcatcacaccttctacaatgagctccgtgtggctcctgaagagcatccagttctccttacagaagctcctcttaaccccaaggccaatcgtgagaaaatgacccagatcatgtttgagaccttcaacactcctgcaatgtatgtcgctatccaggctgtcctttccctctatgccagtggtcgtacaactggtattgttctggactctggagatggtgtgagtcacacggttcccatctatgaaggctatgccctcccacatgccattctgcgtcttgacctggcaggtcgtgatctcactgatgccctcatgaaaatcttgactgagcgtggctactctttcacaaccacagcagagcgtgaaattgtaagggacatgaaggaaaaactagcctacattgctcttgattatgaacaagagctagagacagcaaagaccagctcatctgttgagaagagctatgagctgccagatgggcaggttatcactattggagctgaacgtttccgttgtcctgaagtcctcttccaaccatccatgataggaatggaagctgcgggcatacatgaaacaacatacaattctatcatgaagtgtgatgtcgatattaggaaggatctctatggcaatattgtcctcagtggtggttctaccatgttcccaggcattgcggataggatgagcaaggaaattacagcattagctcccagtagcatgaagattaaggtggttgcaccacctgaaaggaagtacagtgtctggataggaggttccattttggcatccctcagcaccttccagcagatgtggattgcaaaggctgagtatgatgagtctgggccatcaattgtccacaggaagtgcttttaa

SEQ ID NO: 161 - protein, 377 aa, Populus balsamifera subsp. trichocarpa; identical to SEQ ID NO: 159
  misc_feature (1)..(377): Ceres ANNOT ID no. 1528263
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 18603:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 7.89E-192 and BLAST sequence identity of 92.3

SEQ ID NO: 162 - DNA, 1134 bp, Populus balsamifera subsp. trichocarpa
  misc_feature (1)..(1134): Ceres ANNOT ID no. 1464899
  misc_feature 18722:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcagaagccgaggatattcagccactcgtttgcgataatggaactggaatggtcaaggctggctttgctggagatgatgctccacgagctgtgtttcccagtattgttggccgtcctcgtcacactggtgtgatggttggcatgggccaaaaagatgcatatgttggtgatgaggctcagtccaagagaggtatcttaactttgaagtacccaattgagcatggtattgtgagcaactgggatgacatggaaaagatctggcatcataccttctacaacgagcttcgtgttgccccagaagagcacccagtgctcttaacggaggctcctttaaaccccaaggctaatcgtgagaagatgactcagatcatgtttgagaccttcaacactcctgctatgtatgtcgccattcaggctgttttgtccttgtatgcgagtggtcgtacaactggtattgtgttggactctggtgatggtgtcagccatacagtccccatatacgaggggtatgcccttccacatgccattcttcgtcttgacctggctggtcgtgacctcactgattccttgatgaagatcctcactgagcgtggttattctttcacaaccacagctgaacgggaaattgtgagggacatgaaggaaaagctagcttacattgctcttgactacgagcaagagctagagacctccaaaaccagctcaacagttgagaagagctatgagttgcctgatgggcaggttatcaccattggtgctgagcgattccgttgcccagaggtcctcttccaaccttcaatgatcggaatggaagctgcgggcatccacgagaccacatacaactccatcatgaaatgtgatgtcgatatcaggaaagacttgtatggtaacattgttctcagtggtggttcaactatgttcccaggaattgctgacagaatgagcaaggaaatctcagcactagccccaagcagcatgaaaatcaaggtggttgcaccaccagaaaggaaatacagtgtctggatcggtggctcaatcttggcatcccttagcaccttccagcagatgtggattgctaaggcagagtatgatgagtctggaccatcaattgtgcatcggaaatgcttctaa

SEQ ID NO: 163 - protein, 377 aa, Populus balsamifera subsp. trichocarpa
  misc_feature (1)..(377): Ceres ANNOT ID no. 1464899
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 18840:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 9.99E-192 and BLAST sequence identity of 92.3
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDSLMKILTERGYSFTTTAEREIVRDMKEKLAYIALDYEQELETSKTSSTVEKSYELPDGQVITIGAERFRCPEVLFQPSMIGMEAAGIHETTYNSIMKCDVDIRKDLYGNIVLSGGSTMFPGIADRMSKEISALAPSSMKIKVVAPPERKYSVWIGGSILASLSTFQQMWIAKAEYDESGPSIVHRKCF

SEQ ID NO: 164 - DNA, 1134 bp, Populus balsamifera subsp. trichocarpa
  misc_feature (1)..(1134): Ceres ANNOT ID no. 1458103
  misc_feature 18959:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcagacgcagaggatattcagccactcgtttgcgacaatggaactggaatggtcaaggctggatttgctggagatgatgctccaagagctgtctttcccagtattgttggtcgtcctcgtcacactggtgtgatggttggcatgggccagaaagatgcatatgtcggtgatgaggctcagtccaagagaggtatcttaactttgaaatacccaattgagcatggtattgtgagcaattgggatgatatggaaaagatatggcatcataccttctacaatgagcttcgtgttgccccagaagagcatccagtgctcctaactgaggctcctctgaaccccaaggctaatcgtgagaagatgactcagatcatgtttgagaccttcaacactcctgctatgtatgttgccattcaggctgtcctgtccttgtatgccagtggtcgtacaactggtattgtgttggactctggtgatggtgtcagccatacagtccccatatatgaggggtatgcccttccacatgccatccttcgtcttgacctggctggccgtgacctcactgattccttgatgaagatcctcactgagcgtggttattctttcacaaccacagctgaacgggaaattgtgagggacatgaaggaaaagctagcttacattgctcttgactacgagcaagagctagagacctccaaaaccagctcaacagttgagaagagctatgagttgcctgatgggcaggttatcaccattggtgctgaacgattccgttgcccagaggtcctcttccaaccatcaatgatcggaatggaagcagcgggcatccacgagaccacatacaactccatcatgaagtgtgatgtcgatatcaggaaagacttgtatggtaacattgttctcagtggtggttcaactatgttcccaggaattgctgacagaatgagcaaggaaatctctgcactagccccaagcagcatgaaaatcaaggtggttgcaccaccagaaaggaaatacagtgtctggattggtggttcaatcttggcatcccttagcaccttccagcagatgtggattgcaaaggcagagtatgacgagtcagggccatcaattgtgcatcggaagtgcttctaa

SEQ ID NO: 165 - protein, 377 aa, Populus balsamifera subsp. trichocarpa
  misc_feature (1)..(377): Ceres ANNOT ID no. 1458103
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 19077:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 2.10E-191 and BLAST sequence identity of 92.0
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDSLMKILTERGYSFTTTAEREIVRDMKEKLAYIALDYEQELETSKTSSTVEKSYELPDGQVITIGAERFRCPEVLFQPSMIGMEAAGIHETTYNSIMKCDVDIRKDLYGNIVLSGGSTMFPGIADRMSKEISALAPSSMKIKVVAPPERKYSVWIGGSILASLSTFQQMWIAKAEYDESGPSIVHRKCF

SEQ ID NO: 166 - DNA, 1134 bp, Populus balsamifera subsp. trichocarpa
  misc_feature (1)..(1134): Ceres ANNOT ID no. 1442040
  misc_feature 19196:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggctgaaggtgaggaaattcaacctcttgtctgtgataatggcactggaatggttaaggcaggtttcgcaggagatgatgctccaagggcagtcttccccagtattgttggccggcctaggcatacaggtgttatggttggaatggggcagaaagatgcctatgttggggatgaggcccaatcaaaaagaggtattctcacattgaagtaccctatcgaacatgggattgttagcaactgggatgatatggaaaagatttggcatcacactttctacaatgagcttcgtgtggctccagaagaacatcctgttctcctaactgaagctcccctgaaccctaaggccaacagggaaaaaatgacacagatcatgtttgaaacatttaatgtccctgccatgtatgttgccatccaagcagtgctctccctctatgctagtgggcgtactacaggtattgtgctggattctggtgatggagttagtcacacagttcccatatatgagggctatgcacttccccatgcaatccttaggcttgatcttgctggaagggatttaacagatgccttgatgaagatccttacggagagaggttacacattcaccacaactgctgaacgggaaattgtaagagacattaaagagaagcttgcatatgtggcccttgattatgagcaggagcttgaaacggctaaaagtagctcttcaattgagaagagctatgagctacctgatggccaggttatcaccattggtgcagagtgtttccgttgccctgaggtcctatttcaaccatcactcattggaatggaagcacctggaattcatgaaaccacttataattcgatcatgaagtgtgatgttgatatcaggaaagacttgtatggtaacatagtgctcagtggtggatctaccatgtttccaggaatagctgatcgaatgagcaaggagatcacagctcttgctccaagtagcatgaaaatcaaggtggttgctcctcctgagagaaaatacagtgtttggatcggagggtctatactggcgtccctcagcactttccaacagatgtggatatcaaaggccgagtatgatgaatcaggaccctccattgttcacaggaagtgcttctag

SEQ ID NO: 167 - protein, 377 aa, Populus balsamifera subsp. trichocarpa
  misc_feature (1)..(377): Ceres ANNOT ID no. 1442040
  misc_feature (8)..(377): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 19314:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(377): Functional Homolog of  Ceres CLONE ID no. 3819 at SEQ ID NO. 156 with e-value of 4.99E-190 and BLAST sequence identity of 92.3
MAEGEEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYTFTTTAEREIVRDIKEKLAYVALDYEQELETAKSSSSIEKSYELPDGQVITIGAECFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKAEYDESGPSIVHRKCF

SEQ ID NO: 168 - DNA, 1104 bp, Populus balsamifera subsp. trichocarpa
  misc_feature (1)..(1104): Ceres ANNOT ID no. 1520449
  misc_feature 19433:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggctgatgatgaggaaatccaagctcttgtatgcgataatggcactgtaatgattaaggcaggttttgctggagatgattctccaagggcagtcttcccaagtattgttggaatggggcagaaagatgcctatgttggggatgaggcccagtcaaaaagaggtattctcacgttaaagtaccctatcgagcatgggattgttagcaactgggatgatatggaaaagatttggcatcacactttctacaatgagcttcgtgtggctcctgaagagcatcctgtgctacttactgaagctcccctgaaccctaaggccaacagggaaaaaatgacacagattatgtttgaaacctttaatgtccctgccatgtatgttgctatccaggcagtgctctccttatatgctagtggacgtactacaggtattgtgctggattctggtgatggagttagtcacacagtccccgtctatgaaggttatgcacttcctcatgcaatccttaggcttgatcttgctggaagggatttaacagatgccttgatgaagatccttacagagagagggtactcattcaccacaactgctgaacgggaaattgtaagagacattaaggagaagcttgcatatgtggctcttgattatgagcaggagcttgaaactgctaaaagtagctcttcaattgagaagagctatgagctacctgatggccaggttatcaccatcggtgcagagcgtttccgttgccctgaggtcctatttcaaccatcactcatcgggatggaagcacctggaattcacgaaaccacttatagttcaatcatgaagtgtgatgttgatatcaggaaagacttgtatggtaacatagtgctcagtggtggatctaccatgtttccaggaatagctgatagaatgagtaaggagatcacagctcttgctccaagtagcatgaaaatcaaggtggttgcacctcctgagagaaaatacagtgtctggattggagggtctatactggcttctctcagcactttccaacagatgtggatatcaaagggagagtatgatgaatcaggaccctccattgttcataggaagtgcttctag

SEQ ID NO: 169 - protein, 367 aa, Populus balsamifera subsp. trichocarpa
  misc_feature (1)..(367): Ceres ANNOT ID no. 1520449
  misc_feature (8)..(367): Pfam Name: Actin Pfam Description: Actin
  misc_feature: SWISSPROT Homolog: ACT2_ARATH Actin-2 with e-value of 6.8e-203 and BLAST sequence identity of 100.0
  misc_feature: SWISSPROT Homolog: ACT8_ARATH Actin-8 with e-value of 1.4e-202 and BLAST sequence identity of 99.7
  misc_feature: SWISSPROT Homolog: ACT1_ORYSA Actin-1 with e-value of 4.3e-194 and BLAST sequence identity of 93.4
  misc_feature: SWISSPROT Homolog: ACT3_SOLTU Actin-58 with e-value of 3.4e-192 and BLAST sequence identity of 92.3
  misc_feature: SWISSPROT Homolog: ACT_GOSHI Actin with e-value of 4.4e-192 and BLAST sequence identity of 92.6
  misc_feature 19551:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(367): Functional Homolog of  Ceres CLONE ID no. 3819 at SEQ ID NO. 156 with e-value of 4.09E-179 and BLAST sequence identity of 90.4
MADDEEIQALVCDNGTVMIKAGFAGDDSPRAVFPSIVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPVYEGYALPHAILRLDLAGRDLTDALMKILTERGYSFTTTAEREIVRDIKEKLAYVALDYEQELETAKSSSSIEKSYELPDGQVITIGAERFRCPEVLFQPSLIGMEAPGIHETTYSSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 170 - protein, 285 aa, Arabidopsis thaliana
  misc_feature (1)..(285): Ceres CLONE ID no. 3853
  misc_feature (105)..(229): Pfam Name: DUF477 Pfam Description: Domain of unknown function (DUF477)
  misc_feature: Phenotype: FLOWER - Reduced fertility Useful for sterility, genetic confinement systems
METLLSPRALSPPLNPKPLSLHQTKPTSHSLSLSKPTTFSGPKHLSTRFTKPESRNWLIDAKQGLAALALSLTLTFSPVGTALASEFNILNDGPPKETYVVDDAGVLSRVTKSDLKKLLSDLEYRKKLRLNFITVRKLTSKADAFEYADQVLEKWYPSIEEGNNKGIVVLITSQKEGAITGGPAFIEAVGENILDATVSENLPVLATDEKYNEAVYSSAKRLVAAIDGQPDPGGPTVKDSKRESNFKTKEETDEKRGQFSLVVGGLLVIAFVVPMAQYFAYVSRK

SEQ ID NO: 171 - DNA, 879 bp, Populus balsamifera subsp. trichocarpa
  misc_feature (1)..(879): Ceres ANNOT ID no. 1488920
  misc_feature 19749:<222: Transcription Factor
  misc_feature: Phenotype: FLOWER - Reduced fertility Useful for sterility, genetic confinement systems
atggaaaccttactttcttctcacactctatctcctctcctcaacccaaaaccttcctcttcaaaatcccatctgctaccttcacttcaaacaagaccagactcactctctttcatccccaaaaccatcacttctagcctcaaaaggcacacctttgagtctttgtcagtacccaatagctggttcaatcgtgcccaacagggcctagcagcactagccctttctttggcactcaactttagcccactgttgtacactggcaatgctcaagcatctgaatttgatgtgctctatgaagggccaccaaaagagtcatatatatttgatgatgctggtgtgcttagcagagtgactaagtctgatctcaagcagctgttatctgatttggaatcaaggaagaacttcaagatcaatttcgtcactgttagaaagcttactagcaaagctgatgcttttgagtatgctgaccaagttctggagaaatggtatccctctattgaagacggcaacaataagggaattgttgtgcttgtgaccagccaaaaggaaggggcaattacaggggggccggcgtttatccaagcagttggagaaaatgttcttgatgccactgtatcagagaacctacctgtcttggcgacagaagaaaagtacaatgaagcaatttatagcagtgctaagaggttagtagccgctattgatgggcttccagatcctggtggtccaagggctaatgaaaataaacgagaatccaactttaaaagcagggaagagacagacgagaagaggggacaattcactctagtggttggaggtctgttggtgattgcttttgttgttcctatggcacaatactatgcttatgtttcaaagaaataa

SEQ ID NO: 172 - protein, 292 aa, Populus balsamifera subsp. trichocarpa
  misc_feature (1)..(292): Ceres ANNOT ID no. 1488920
  misc_feature (112)..(236): Pfam Name: DUF477 Pfam Description: Domain of unknown function (DUF477)
  misc_feature 19810:<222: Transcription Factor
  misc_feature: Phenotype: FLOWER - Reduced fertility Useful for sterility, genetic confinement systems
  misc_feature (1)..(292): Functional Homolog of  Ceres CLONE ID no. 3853 at SEQ ID NO. 173 with e-value of 1.10E-105 and BLAST sequence identity of 76.5
METLLSSHTLSPLLNPKPSSSKSHLLPSLQTRPDSLSFIPKTITSSLKRHTFESLSVPNSWFNRAQQGLAALALSLALNFSPLLYTGNAQASEFDVLYEGPPKESYIFDDAGVLSRVTKSDLKQLLSDLESRKNFKINFVTVRKLTSKADAFEYADQVLEKWYPSIEDGNNKGIVVLVTSQKEGAITGGPAFIQAVGENVLDATVSENLPVLATEEKYNEAIYSSAKRLVAAIDGLPDPGGPRANENKRESNFKSREETDEKRGQFTLVVGGLLVIAFVVPMAQYYAYVSKK

SEQ ID NO: 173 - DNA, 966 bp, Populus balsamifera subsp. trichocarpa
  misc_feature (1)..(966): Ceres ANNOT ID no. 1469361
  misc_feature 19900:<222: Transcription Factor
  misc_feature: Phenotype: FLOWER - Reduced fertility Useful for sterility, genetic confinement systems
atggaaaccttactttcttcgcactctctttctcctctcctcaactcaaaaccatcctcttcgaaatcccatttgctaccttctcttcaaacaagatcaaactcactctctttcacccacaagagcatcacttctagcctcaaaaggcacacttctcaatctttgtcggtgcccaatagctggttcagttatgctcaacaaggcctagcagcattagctctcgctttggcactcaactttagtccgctgttgtacattggaaatgctcaagcatctgaatttgacgtgctcaatgaagggccaccaaaagagtcttatatatttgatgatgctggtgtgcttagtagagtgactaaatctgatctgaagcagctgttatctgatttggaatcaaggaagaacttcaagatcaatttcattactgttagaaagcttactagcaaagcagatgcttttgaatatgccgaccaagttctggagaaatggtatcccactgttgaagagggcagcaacaagggaattgttgtgcttgtaaccagccaaaaggaaggggcaattacgggggggcctgcatttatccaagcagttggagaaactgttcttgattccactgtctcggagaaccttcctgaacataaattcattgtatttgcacatgatgcaattgtcacacaagctcagatgtcattagtcttagagatgaggatgctcaagttactcttggcgacggaagaaaagtacaatgaagcgatttatagcagtgccaagaggttagtggctgctatcgatgggcttccagatccaggcggtccgacgactaaagaaaacaaacgagaatccaacttcaaaagcaaggaagagacagaagagaagaggggacaattcactctagtggttggaggtctattggtgattgcttttgttgttcccatggcgcaatactatgcttatgtttcaaagaaatag

SEQ ID NO: 174 - protein, 321 aa, Populus balsamifera subsp. trichocarpa
  misc_feature (1)..(321): Ceres ANNOT ID no. 1469361
  misc_feature (112)..(229): Pfam Name: DUF477 Pfam Description: Domain of unknown function (DUF477)
  misc_feature 19965:<222: Transcription Factor
  misc_feature: Phenotype: FLOWER - Reduced fertility Useful for sterility, genetic confinement systems
  misc_feature (1)..(321): Functional Homolog of  Ceres CLONE ID no. 3853 at SEQ ID NO. 173 with e-value of 1.40E-98 and BLAST sequence identity of 75.2
METLLSSHSLSPLLNSKPSSSKSHLLPSLQTRSNSLSFTHKSITSSLKRHTSQSLSVPNSWFSYAQQGLAALALALALNFSPLLYIGNAQASEFDVLNEGPPKESYIFDDAGVLSRVTKSDLKQLLSDLESRKNFKINFITVRKLTSKADAFEYADQVLEKWYPTVEEGSNKGIVVLVTSQKEGAITGGPAFIQAVGETVLDSTVSENLPEHKFIVFAHDAIVTQAQMSLVLEMRMLKLLLATEEKYNEAIYSSAKRLVAAIDGLPDPGGPTTKENKRESNFKSKEETEEKRGQFTLVVGGLLVIAFVVPMAQYYAYVSKK

SEQ ID NO: 175 - protein, 153 aa, Arabidopsis thaliana
  misc_feature (1)..(153): Ceres CLONE ID no. 3858
  misc_feature (2)..(151): Pfam Name: Bet_v_I Pfam Description: Pathogenesis-related protein Bet v I family
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MAMSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 176 - DNA, 453 bp, Populus balsamifera subsp. trichocarpa
  misc_feature (1)..(453): Ceres ANNOT ID no. 1459068
  misc_feature 20154:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcactacatggaaagattgagacaacattagaactcaagtcctccgcagagaagttctacaaagtgtggaggagccagtccttccatgttcccaaacatgcttccaagcatatccaaggagttgatatacatgcaggtgactgggagactgcgggctctatcaggatttggcagtacacaatcggagggaaagccggggtctttaaagaggaggtttccttcgatgatgagaacaagatcataactcttaatggtttggaaggagatgtcatgaaaatttacaaggtctataggcccgtctggcagcttacaccaaaaggctcgggctgcttggcaaaactgaccattgaatacgaaaaactccatcctgaagtcccggttccagagatttatgttgatcttatggttcatatgactaaagacatcgacgaagcccttagcacggagtaa

SEQ ID NO: 177 - protein, 150 aa, Populus balsamifera subsp. trichocarpa
  misc_feature (1)..(150): Ceres ANNOT ID no. 1459068
  misc_feature (2)..(150): Pfam Name: Bet_v_I Pfam Description: Pathogenesis-related protein Bet v I family
  misc_feature: SWISSPROT Homolog: ML328_ARATH MLP-like protein 328 with e-value of 1.5e-58 and BLAST sequence identity of 71.3
  misc_feature: SWISSPROT Homolog: ML329_ARATH MLP-like protein 329 with e-value of 7.2e-57 and BLAST sequence identity of 69.3
  misc_feature: SWISSPROT Homolog: MLP28_ARATH MLP-like protein 28 with e-value of 2.3e-19 and BLAST sequence identity of 31.6
  misc_feature: SWISSPROT Homolog: MLP34_ARATH MLP-like protein 34 with e-value of 4.9e-19 and BLAST sequence identity of 32.9
  misc_feature: SWISSPROT Homolog: MLP31_ARATH MLP-like protein 31 with e-value of 1.6e-18 and BLAST sequence identity of 31.8
  misc_feature 20271:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(150): Functional Homolog of  Ceres CLONE ID no. 3858 at SEQ ID NO. 178 with e-value of 2.00E-28 and BLAST sequence identity of 42.0
MALHGKIETTLELKSSAEKFYKVWRSQSFHVPKHASKHIQGVDIHAGDWETAGSIRIWQYTIGGKAGVFKEEVSFDDENKIITLNGLEGDVMKIYKVYRPVWQLTPKGSGCLAKLTIEYEKLHPEVPVPEIYVDLMVHMTKDIDEALSTE

SEQ ID NO: 178 - protein, 412 aa, Arabidopsis thaliana
  misc_feature (1)..(412): Ceres CLONE ID no. 3997
  misc_feature (1)..(412): Also Known As Ceres CDNA ID no. 24418108
  misc_feature (1)..(412): Also Known As Ceres GEMINI ID 533D10
  misc_feature (297)..(373): Pfam Name: Helicase_C Pfam Description: Helicase conserved C-terminal domain
  misc_feature (62)..(229): Pfam Name: DEAD Pfam Description: DEAD/DEAH box helicase
  misc_feature 20395:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
MAGSAPEGTQFDTRQFDQRLNEVLDGQDEFFTSYDEVHESFDAMGLQENLLRGIYAYGFEKPSAIQQRGIVPFCKGLDVIQQAQSGTGKTATFCSGVLQQLDYALLQCQALVLAPTRELAQQIEKVMRALGDYQGVKVHACVGGTSVREDQRILQAGVHVVVGTPGRVFDMLRRQSLRPDCIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTLDDQRMLFDIQKFYNVVVEELPSNVADLL

SEQ ID NO: 179 - DNA, 1242 bp, Populus balsamifera subsp. trichocarpa
  misc_feature (1)..(1242): Ceres ANNOT ID no. 1455209
  misc_feature 20526:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atggctagttcggcacctgaaggatcccagtttgatgctcgtcaatttgattctaggatgaatgagctgctcacagctgaaggacaggatttctttacctcctatgatgaggtgcatgaaacttttgatgctatgaatttgaaggagaaccttctgaggggtatttacgcatatggttttgagaagccatctgcaattcagcaaagagggattgtcccattctgcaagggacttgatgtaatccaacaagcacaatcaggaactggaaagacagctacgttttgctctgggattttgcagcagcttgattatgatatagttgaatgccaagcattggttcttgcacctacccgagaactagctcaacagattgaaaaggttatgagagcactaggtgattatctgggtgtgaaggttcatgcttgtgttggtggaaccagtgttcgtgaggatcagcgtattctctcagctggggttcatgttgtagtcggtactcctggtcgtgtgtttgacatgttgcggagacaatcacttcgccctgactatatcaagatgtttgtattggatgaagcagatgaaatgctctcaagaggattcaaggatcagatatatgatattttccaattactgcccccaaagattcaggttggggtcttctctgctactatgccacctgaggccctagaaattacgaggaagttcatgaataaacctgtgaggattttagtgaagcgtgatgagcttacgcttgagggtatcaagcaattctatgttaatgttgacaaggaggaatggaagcttgagacactttgtgatctatatgagaccttggcaataacccaaagtgttatctttgtgaacaccaggcgcaaggtggattggctcacagacaagatgcgcagtcgtgatcacacagtctctgccactcatggagatatggaccaaaacacaagggacattattatgcgagaattccgctctggttcctctcgtgtgctgatcactactgatctgttggcccgtggtattgatgtccagcaagtctcacttgtgatcaattatgatctccctacccagccagagaactacctccatcgtattggtcgtagtggacgttttggaaggaagggtgttgctataaactttgttaccagggatgatgaaagaatgctttctgacatccagagattctataatgtaacggttgaggagctgccatcaaatgttgctgatcttctttga

SEQ ID NO: 180 - protein, 413 aa, Populus balsamifera subsp. trichocarpa
  misc_feature (1)..(413): Ceres ANNOT ID no. 1455209
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 8.7e-219 and BLAST sequence identity of 100.0
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 1.1e-211 and BLAST sequence identity of 96.6
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 6.6e-205 and BLAST sequence identity of 93.2
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 1.8e-204 and BLAST sequence identity of 92.7
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 1.6e-203 and BLAST sequence identity of 92.3
  misc_feature 20673:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(413): Functional Homolog of  Ceres CLONE ID no. 3997 at SEQ ID NO. 190 with e-value of 8.40E-204 and BLAST sequence identity of 93.4
MASSAPEGSQFDARQFDSRMNELLTAEGQDFFTSYDEVHETFDAMNLKENLLRGIYAYGFEKPSAIQQRGIVPFCKGLDVIQQAQSGTGKTATFCSGILQQLDYDIVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLSDIQRFYNVTVEELPSNVADLL

SEQ ID NO: 181 - DNA, 1242 bp, Populus balsamifera subsp. trichocarpa
  misc_feature (1)..(1242): Ceres ANNOT ID no. 1446198
  misc_feature 20812:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atggcgggtttggcaccagaagggtcacaattcgattctaagcaatatgatgccaaaatgaatgatttgctcgcaaatgatggacaagatttcttcacatcatatgatgaggtttatgacacttttgattcaatgggactgcaagagaaccttttgaggggcatctatgcctatggttttgagaagccatctgcaatccagcaaagaggaattgttccattctgcaagggccttgatgtgattcagcaggctcagtcaggaactgggaaaacagcaaccttctgctctggtattctccagcaacttgattatggtctagtgcaatgtcaagctttggtccttgcgcccactagggaacttgcacaacagattgaaaaggttatgcgggcacttggtgattatcttggcgtcaaagttcatgcttgtgttggtggcacaagtgttcgtgaggaccaacgcattcttcaagctggagttcatgttgttgttggcactcctggtcgtgtgtttgatatgttaagaaggcagtcacttcgtccagattacattaaaatgtttgtcctggatgaggctgatgaaatgctgtcccgtggttttaaggatcagatctacgatattttccagttgctgccatctaaagttcaagttggtgtgttctccgctactatgccacctgaagcccttgagatcacaaggaagttcatgaacaagcctgtgaggatcttggttaagcgtgatgagcttacccttgaaggtatcaaacagtttcatgtcaatgttgataaggaggagtggaagcttgaaactctatgtgatctatacgagaccctagccatcactcagagtgttatttttgttaacacccgccgcaaggttgactggctgacagacaagatgcgaagccgtgaccacacagtctcagctactcatggagatatggaccagaacactcgtgatatcattatgcgagaattccggtctggctcttctcgagttctcatcacaactgatctcctggcccgtggaattgatgtgcagcaagtgtcccttgtcataaattatgatctgccgactcaaccagaaaactaccttcaccgtattggacgaagtggacgttttggaagaaagggtgtcgccattaactttgtgacaagggatgatgacagaatgctgtttgatatccagaagttctataatgtggtcatcgaggagcttccatctaacgtggctgatctcctgtga

SEQ ID NO: 182 - protein, 413 aa, Populus balsamifera subsp. trichocarpa
  misc_feature (1)..(413): Ceres ANNOT ID no. 1446198
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 8.7e-219 and BLAST sequence identity of 100.0
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 1.1e-211 and BLAST sequence identity of 96.6
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 6.6e-205 and BLAST sequence identity of 93.2
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 1.8e-204 and BLAST sequence identity of 92.7
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 1.6e-203 and BLAST sequence identity of 92.3
  misc_feature 20959:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(413): Functional Homolog of  Ceres CLONE ID no. 3997 at SEQ ID NO. 190 with e-value of 8.40E-204 and BLAST sequence identity of 92.9
MAGLAPEGSQFDSKQYDAKMNDLLANDGQDFFTSYDEVYDTFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDDRMLFDIQKFYNVVIEELPSNVADLL

SEQ ID NO: 183 - DNA, 1242 bp, Populus balsamifera subsp. trichocarpa
  misc_feature (1)..(1242): Ceres ANNOT ID no. 1490273
  misc_feature 21098:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atggcaggtctggcaccagaaggatcgcaatatgatgctaagcaatatgatgccaaaatgaatgatctgcttgcaaatgatgggcaagatttcttcacaatgtatgaggaggtttttgaaacctttgattcgatgggattgcaagagaaccttctgaggggcatctatgcctatggttttgagaagccatctgcaatccagcaaagaggaattgttccattttgtaaaggccttgatgtgattcagcaggcacaatctggaactgggaaaacagcaactttctgttctggcattctccagcaacttgattatggtttggtgcaatgtcaagcattggtcctggctcccaccagggaactagcacaacagattgaaaaggttatgcgagcacttggtgattatcttggtgtcaaagttcatgcttgtgttggtggcacaagtgttcgtgaggaccaacgcattcttcaagctggtgttcatgttgttgttggcacacctggtcgtgtgtttgacatgttgagaaggcagtcacttcgtcaagattacattaaaatgtttgtcttggatgaggctgatgaaatgctttcacgtggttttaaggatcagatctatgatattttccagttgctgccatcaaaagttcaagttggtgtgttctccgctactatgccacctgaagctcttgagatcacaaggaagttcatgaataagcctgtgaggatcttggttaagcgtgatgagcttactcttgaaggtatcaagcaattttatgttaatgtcgataaggaggagtggaagctcgaaacactatgtgatctatatgagaccctagccatcactcagagtgtcatttttgttaacacccggcgcaaggttgactggctgacagacaagatgcgaggccgtgatcacacagtctcggctactcatggagatatggaccagaacactcgtgatatcattatgcgagaattcaggtccggctcttctcgtgttctcatcactaccgatctcttggctcgtggtattgatgttcagcaagtttcccttgtcataaattatgatctgccgactcaacctgaaaactatcttcaccgtattggacgaagtggacggtttggaagaaagggtgttgctattaactttgtgacaagtgatgatgacagaatgctgtttgatatccagaagttctataatgtggtcgtcgaggagctgccatcgaatgtggccgatctcctttga

SEQ ID NO: 184 - protein, 413 aa, Populus balsamifera subsp. trichocarpa
  misc_feature (1)..(413): Ceres ANNOT ID no. 1490273
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 8.7e-219 and BLAST sequence identity of 100.0
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 1.1e-211 and BLAST sequence identity of 96.6
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 6.6e-205 and BLAST sequence identity of 93.2
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 1.8e-204 and BLAST sequence identity of 92.7
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 1.6e-203 and BLAST sequence identity of 92.3
  misc_feature 21245:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(413): Functional Homolog of  Ceres CLONE ID no. 3997 at SEQ ID NO. 190 with e-value of 8.59E-202 and BLAST sequence identity of 92.4
MAGLAPEGSQYDAKQYDAKMNDLLANDGQDFFTMYEEVFETFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRQDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTSDDDRMLFDIQKFYNVVVEELPSNVADLL

SEQ ID NO: 185 - DNA, 1224 bp, Populus balsamifera subsp. trichocarpa
  misc_feature (1)..(1224): Ceres ANNOT ID no. 1530603
  misc_feature 21384:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atggctggtttggcacctgaaggatcccaattcgatgctcgtcaattcgattctaagatgaatgagttgctcacaactgatgggcaagatttctttacttcatacgatgaggtgtatgacacttttgatgctatgggtttgaaggagaaccttctgaggggtatttatgcatatggttttgagaagccatctgcaattcaacaaagggggattgtcccattctgcaagggacttgatgtaatccagcaagcacaatcaggaactggaaaaacagctaccttttgctctggaattttgcagcagcttgattatgatgtagttgaatgccaagcactagttcttgcacctactcgagaactagcacaacagattgaaaaggttatgagagcactaggtgattatctgggtgtcaaggttcatgcttgtgttggtggaactagtgttcgtgaggaccagcgcattctctcagctggggttcatgttgtagttggtacccctggtcgtgtgttcgacatgttgcggagacaatcacttcggcctgactatatcaagatgtttgtattggatgaagcagatgaaatgctctcacgaggtttcaaggatcagttgctgcccccaaagattcaggttggggttttctccgctactatgccacctgaggcactagaaattacaaggaagttcatgaataaacctgtgaggattttagtgaagcgtgatgagcttacgcttgagggtatcaagcaattctatgttaatgttgacaaggaggaatggaagcttgagacgctttgtgatctatatgagaccttggcaataacccaaagtgtcatctttgtgaacactaggcgcaaggtagattggcttacagacaagatgcgcagtcgcgatcacacagtctctgccactcatggagatatggaccaaaacacaagggacattattatgcgggaatttcgctctggttcctctcgtgtgctgatcactactgatctgttagcccgtggtattgatgtccagcaagtatcacttgtgatcaattatgatctgccaacacagccagagaactacctccatcgtattggtcgtagtggacgttttggaaggaagggtgttgctataaattttgttaccaaggatgatgaaagaatgctttctgacatccagagattttataatgtgacagttgaggagctgccgtcaaatgttgctgatcttctttga

SEQ ID NO: 186 - protein, 407 aa, Populus balsamifera subsp. trichocarpa
  misc_feature (1)..(407): Ceres ANNOT ID no. 1530603
  misc_feature (292)..(368): Pfam Name: Helicase_C Pfam Description: Helicase conserved C-terminal domain
  misc_feature (63)..(224): Pfam Name: DEAD Pfam Description: DEAD/DEAH box helicase
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 8.7e-219 and BLAST sequence identity of 100.0
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 1.1e-211 and BLAST sequence identity of 96.6
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 6.6e-205 and BLAST sequence identity of 93.2
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 1.8e-204 and BLAST sequence identity of 92.7
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 1.6e-203 and BLAST sequence identity of 92.3
  misc_feature 21531:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(407): Functional Homolog of  Ceres CLONE ID no. 3997 at SEQ ID NO. 190 with e-value of 4.39E-198 and BLAST sequence identity of 93.0
MAGLAPEGSQFDARQFDSKMNELLTTDGQDFFTSYDEVYDTFDAMGLKENLLRGIYAYGFEKPSAIQQRGIVPFCKGLDVIQQAQSGTGKTATFCSGILQQLDYDVVECQALVLAPTRELAQQIEKVMRALGDYLGVKVHACVGGTSVREDQRILSAGVHVVVGTPGRVFDMLRRQSLRPDYIKMFVLDEADEMLSRGFKDQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQRFYNVTVEELPSNVADLL

SEQ ID NO: 187 - protein, 151 aa, Arabidopsis thaliana [sequence omitted]

SEQ ID NO: 188 - DNA, 456 bp, Populus balsamifera subsp. trichocarpa
  misc_feature (1)..(456): Ceres ANNOT ID no. 1468992
  misc_feature 21748:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
atgggtcgtatgcacagtcgaggtaagggtatttcagcttcagccctgccttacaagagaacctcaccgagctggctgaaaatttcagcacaagatgttgatgatagcatctgcaagtttgcgaagaagggtttgactccatctcagattggtgtcatacttcgtgactctcatggtattgctcaggtcaggagtgttactggaaaccagatcttgcgtatccttaaggctcatggtcttgcccctgaaattccagaggatttgtaccacctcatcaagaaggctgttgccatcaggaaacatttggaaaggaacaggaaggacaaggattccaagttcaggttgatccttgttgagagcaggattcacaggctggctcgctactacaagaagacaaagaagcttgctcctgtctggaaatacgaatcaagcactgccagcactctggtggcttag

SEQ ID NO: 189 - protein, 151 aa, Populus balsamifera subsp. trichocarpa
  misc_feature (1)..(151): Ceres ANNOT ID no. 1468992
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: SWISSPROT Homolog: RS13B_ARATH 40S ribosomal protein S13-2 with e-value of 8.6e-77 and BLAST sequence identity of 100.0
  misc_feature: SWISSPROT Homolog: RS13A_ARATH 40S ribosomal protein S13-1 with e-value of 2.9e-76 and BLAST sequence identity of 99.3
  misc_feature: SWISSPROT Homolog: RS13_SOYBN 40S ribosomal protein S13 with e-value of 4.0e-72 and BLAST sequence identity of 93.4
  misc_feature: SWISSPROT Homolog: RS13_PEA 40S ribosomal protein S13 with e-value of 2.2e-71 and BLAST sequence identity of 92.1
  misc_feature: SWISSPROT Homolog: RS13_MAIZE 40S ribosomal protein S13 with e-value of 4.3e-66 and BLAST sequence identity of 86.8
  misc_feature 21850:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
  misc_feature (1)..(151): Functional Homolog of  Ceres CLONE ID no. 4058 at SEQ ID NO. 199 with e-value of 1.20E-71 and BLAST sequence identity of 92.7
MGRMHSRGKGISASALPYKRTSPSWLKISAQDVDDSICKFAKKGLTPSQIGVILRDSHGIAQVRSVTGNQILRILKAHGLAPEIPEDLYHLIKKAVAIRKHLERNRKDKDSKFRLILVESRIHRLARYYKKTKKLAPVWKYESSTASTLVA

SEQ ID NO: 190 - DNA, 831 bp, Populus balsamifera subsp. trichocarpa
  misc_feature (1)..(831): Ceres ANNOT ID no. 1444098
  misc_feature 21927:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
atgggtcgtatgcacagtaaaggtaagggtatttcagcgtctgctttgccatacaagagaaccccacctagttggctcaagatttctcctcaagatgttgacgacaacatctgtaagtttgccaagaaaggtttgacaccatctcaaattggtgttattcttcgtgattctcacggtattgctcaggtgaaagctgtcactggcaaccagattttgaggatattgaaggcacatggccttgcccctgaaattcctgaggatttgtaccacctcatcaagaaagcagttgctattaggaagcatctagagaggaacaggaaggataaagattccaagtttaggttgattttggttgagagcaggattcaccgccttgctcgctattacaagaagaccaagaagcttccacctgtctggaaatacttctggtttgatgtttttgatgctacaaaattcgaaacctggttgttaatgcctagcaaatttaagatttggatctacgaaactggccctttaaaatgcagtgaactgcatctcagattatcgaacgagaaactgccacttcttagtttctgcaaagtgctcgaggcagccttgctgtttcggttcgagccttatggttgttcatatgatggccactggaggcttacatggtcgttaacttcagggcccgtgggattagtcgagtttgcgcatacctcgactaatctcatgggtcctgaagttagcgatcatagagagttgcaatacagagaaataaaggaagatgtaaagctgaaacgatggagatatgagaaatggtttccaatgagcaatccagctaggatgtga

SEQ ID NO: 191 - protein, 276 aa, Populus balsamifera subsp. trichocarpa
  misc_feature (1)..(276): Ceres ANNOT ID no. 1444098
  misc_feature (1)..(60): Pfam Name: Ribosomal_S13_N Pfam Description: Ribosomal S13/S15 N-terminal domain
  misc_feature (65)..(147): Pfam Name: Ribosomal_S15 Pfam Description: Ribosomal protein S15
  misc_feature: SWISSPROT Homolog: RS13B_ARATH 40S ribosomal protein S13-2 with e-value of 8.6e-77 and BLAST sequence identity of 100.0
  misc_feature: SWISSPROT Homolog: RS13A_ARATH 40S ribosomal protein S13-1 with e-value of 2.9e-76 and BLAST sequence identity of 99.3
  misc_feature: SWISSPROT Homolog: RS13_SOYBN 40S ribosomal protein S13 with e-value of 4.0e-72 and BLAST sequence identity of 93.4
  misc_feature: SWISSPROT Homolog: RS13_PEA 40S ribosomal protein S13 with e-value of 2.2e-71 and BLAST sequence identity of 92.1
  misc_feature: SWISSPROT Homolog: RS13_MAIZE 40S ribosomal protein S13 with e-value of 4.3e-66 and BLAST sequence identity of 86.8
  misc_feature 22041:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
  misc_feature (1)..(276): Functional Homolog of  Ceres CLONE ID no. 4058 at SEQ ID NO. 199 with e-value of 6.80E-67 and BLAST sequence identity of 91.4
MGRMHSKGKGISASALPYKRTPPSWLKISPQDVDDNICKFAKKGLTPSQIGVILRDSHGIAQVKAVTGNQILRILKAHGLAPEIPEDLYHLIKKAVAIRKHLERNRKDKDSKFRLILVESRIHRLARYYKKTKKLPPVWKYFWFDVFDATKFETWLLMPSKFKIWIYETGPLKCSELHLRLSNEKLPLLSFCKVLEAALLFRFEPYGCSYDGHWRLTWSLTSGPVGLVEFAHTSTNLMGPEVSDHRELQYREIKEDVKLKRWRYEKWFPMSNPARM

SEQ ID NO: 192 - DNA, 582 bp, Populus balsamifera subsp. trichocarpa
  misc_feature (1)..(582): Ceres ANNOT ID no. 1474224
  misc_feature 22142:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
atgggtcgtatgcacagtcacggtaagggtatttcagcttcagctttgccttacaagagaaccccaccaagctggcttaagatttctgctcaagatgttgaggataacatctgcaaatttgcaaagaagggtttgactccatctcagattggtgtcattcttcgtgactctcacggtattgctcaggtcaggagtgttactggaaaccagatcttgcgtatccttaaggctcatggtcttgcccctgaaattcctgaggatctgtaccacctcatcaagaaagctgttgccatcagaaagcatttggaaaggaacaggaaggataaggattccaagttcaggttgatccttgtcgagagcagaattcacaggcttgctcgctactacaagaagacaaagaagcttcctcctgtctggaaatatctccaatggaagataatcatttctacaactgggtttgaactcgaatttcgaaacataacgggaattaatgattacaatttgaactacgaggacacagatcaccccagagcatttgttggagcttggaaggtagcagaagcaggactggaaccggcataa

SEQ ID NO: 193 - protein, 193 aa, Populus balsamifera subsp. trichocarpa
  misc_feature (1)..(193): Ceres ANNOT ID no. 1474224
  misc_feature (1)..(60): Pfam Name: Ribosomal_S13_N Pfam Description: Ribosomal S13/S15 N-terminal domain
  misc_feature (65)..(141): Pfam Name: Ribosomal_S15 Pfam Description: Ribosomal protein S15
  misc_feature: SWISSPROT Homolog: RS13B_ARATH 40S ribosomal protein S13-2 with e-value of 8.6e-77 and BLAST sequence identity of 100.0
  misc_feature: SWISSPROT Homolog: RS13A_ARATH 40S ribosomal protein S13-1 with e-value of 2.9e-76 and BLAST sequence identity of 99.3
  misc_feature: SWISSPROT Homolog: RS13_SOYBN 40S ribosomal protein S13 with e-value of 4.0e-72 and BLAST sequence identity of 93.4
  misc_feature: SWISSPROT Homolog: RS13_PEA 40S ribosomal protein S13 with e-value of 2.2e-71 and BLAST sequence identity of 92.1
  misc_feature: SWISSPROT Homolog: RS13_MAIZE 40S ribosomal protein S13 with e-value of 4.3e-66 and BLAST sequence identity of 86.8
  misc_feature 22248:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
  misc_feature (1)..(193): Functional Homolog of  Ceres CLONE ID no. 4058 at SEQ ID NO. 199 with e-value of 1.79E-66 and BLAST sequence identity of 90.7
MGRMHSHGKGISASALPYKRTPPSWLKISAQDVEDNICKFAKKGLTPSQIGVILRDSHGIAQVRSVTGNQILRILKAHGLAPEIPEDLYHLIKKAVAIRKHLERNRKDKDSKFRLILVESRIHRLARYYKKTKKLPPVWKYLQWKIIISTTGFELEFRNITGINDYNLNYEDTDHPRAFVGAWKVAEAGLEPA

SEQ ID NO: 194 - DNA, 537 bp, Populus balsamifera subsp. trichocarpa
  misc_feature (1)..(537): Ceres ANNOT ID no. 1524351
  misc_feature 22334:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
atgacctggaggctggaaagttccataagcaagggtatctcagcatctgctttgccatacaagaggacctcacctagttggctcaagatttctcctcaagatgttgacgacaatatctgcaagtttgcaaagaaaggtttgacaccatctcaaattggtgttatccttcgtgattctcatggtattgctcaagtgaagactgtaactggcaaccagattttgaggatattgaaggcccatgggcttgcacctgaaattcctgaggatctgtaccacctcattaagaaagcagttgctattaggaagcatctagagaggaacaggaaggataaagattccaaatttaggttgattttggtcgagagcaggatccaccgccttgctcgctattacaagaagaccaagaagcttccaccagtctggaaatacttgctaccatttcctggtcataaggtagcttccgcatgcctacgctgccagcacatcgtcttgccattcacgtgcactcaccatatctgttgctccttcacgtgctag

SEQ ID NO: 195 - protein, 178 aa, Populus balsamifera subsp. trichocarpa
  misc_feature (1)..(178): Ceres ANNOT ID no. 1524351
  misc_feature (11)..(62): Pfam Name: Ribosomal_S13_N Pfam Description: Ribosomal S13/S15 N-terminal domain
  misc_feature (67)..(143): Pfam Name: Ribosomal_S15 Pfam Description: Ribosomal protein S15
  misc_feature: SWISSPROT Homolog: RS13B_ARATH 40S ribosomal protein S13-2 with e-value of 8.6e-77 and BLAST sequence identity of 100.0
  misc_feature: SWISSPROT Homolog: RS13A_ARATH 40S ribosomal protein S13-1 with e-value of 2.9e-76 and BLAST sequence identity of 99.3
  misc_feature: SWISSPROT Homolog: RS13_SOYBN 40S ribosomal protein S13 with e-value of 4.0e-72 and BLAST sequence identity of 93.4
  misc_feature: SWISSPROT Homolog: RS13_PEA 40S ribosomal protein S13 with e-value of 2.2e-71 and BLAST sequence identity of 92.1
  misc_feature: SWISSPROT Homolog: RS13_MAIZE 40S ribosomal protein S13 with e-value of 4.3e-66 and BLAST sequence identity of 86.8
  misc_feature 22438:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: SEED - Other Useful for modifying seed content
  misc_feature (1)..(178): Functional Homolog of  Ceres CLONE ID no. 4058 at SEQ ID NO. 199 with e-value of 3.50E-63 and BLAST sequence identity of 91.1
MTWRLESSISKGISASALPYKRTSPSWLKISPQDVDDNICKFAKKGLTPSQIGVILRDSHGIAQVKTVTGNQILRILKAHGLAPEIPEDLYHLIKKAVAIRKHLERNRKDKDSKFRLILVESRIHRLARYYKKTKKLPPVWKYLLPFPGHKVASACLRCQHIVLPFTCTHHICCSFTC

SEQ ID NO: 196 - protein, 90 aa, Arabidopsis thaliana
  misc_feature (1)..(90): Ceres CLONE ID no. 4067
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: CAULINE LEAVES - Undulate Shaped Useful for making plants with increased biomass and foliage
MAWRSAARSFVSATARAPSLRSPPPTLPRLRPSQSSLPRRRFASFTNPRNLGELGCTESFLPLYNVVAAARLTSHLNVNLRAFCELSNGT

SEQ ID NO: 197 - DNA, 273 bp, Populus balsamifera subsp. trichocarpa
  misc_feature (1)..(273): Ceres ANNOT ID no. 1514362
  misc_feature 22596:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: CAULINE LEAVES - Undulate Shaped Useful for making plants with increased biomass and foliage
atggcttggcgcagtggaggatcactctcgcgttcgctcatgtccgccgccagggcgccgcttcctcgctcttctgcacctctcccccgcctccgtcccccgtcttcctccgcaccccgtttacaatctcgccgcttatcctttgctccttccaggaacttgggagaactgggatgcatgcagtcgttcttgcctttggtgtccgcggggaacttgacatcgcgtctcaatgctaatttgcgggctttttgtgagctgtctcatgatcgctaa

SEQ ID NO: 198 - protein, 90 aa, Populus balsamifera subsp. trichocarpa
  misc_feature (1)..(90): Ceres ANNOT ID no. 1514362
  misc_feature 22666:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: CAULINE LEAVES - Undulate Shaped Useful for making plants with increased biomass and foliage
  misc_feature (1)..(90): Functional Homolog of  Ceres CLONE ID no. 4067 at SEQ ID NO. 208 with e-value of 1.60E-19 and BLAST sequence identity of 69.8
MAWRSGGSLSRSLMSAARAPLPRSSAPLPRLRPPSSSAPRLQSRRLSFAPSRNLGELGCMQSFLPLVSAGNLTSRLNANLRAFCELSHDR

SEQ ID NO: 199 - DNA, 297 bp, Populus balsamifera subsp. trichocarpa
  misc_feature (1)..(297): Ceres ANNOT ID no. 1494090
  misc_feature 22752:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: CAULINE LEAVES - Undulate Shaped Useful for making plants with increased biomass and foliage
atggcttggcgcagtggaggatcactctcgcgttcgctcatgtccgccgccagggcgccgaccccccgctcttccgcacagctcccccgcctccgtccgccgcctacctcctccccccgtttccaatctcgccgcttatccttcgctccttccaggaacttgggagaactgggatgcacgcagtcgttgttgcctttggtggcctcggggcacttgacatcacgtctcaatgctaatgtgcgggctttctgtgagctgtctcatggtaccttctgccgtacttgtccggatcgctaa

SEQ ID NO: 200 - protein, 98 aa, Populus balsamifera subsp. trichocarpa
  misc_feature (1)..(98): Ceres ANNOT ID no. 1494090
  misc_feature 22822:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: CAULINE LEAVES - Undulate Shaped Useful for making plants with increased biomass and foliage
  misc_feature (1)..(98): Functional Homolog of  Ceres CLONE ID no. 4067 at SEQ ID NO. 208 with e-value of 2.60E-19 and BLAST sequence identity of 67.0
MAWRSGGSLSRSLMSAARAPTPRSSAQLPRLRPPPTSSPRFQSRRLSFAPSRNLGELGCTQSLLPLVASGHLTSRLNANVRAFCELSHGTFCRTCPDR

SEQ ID NO: 201 - protein, 158 aa, Arabidopsis thaliana
  misc_feature (1)..(158): Ceres CLONE ID no. 4228
  misc_feature (1)..(158): Also Known As Ceres CDNA ID no. 23375896
  misc_feature (1)..(158): Also Known As Ceres GEMINI ID 534C5
  misc_feature (71)..(141): Pfam Name: RRM_1 Pfam Description: RNA recognition motif. (a.k.a. RRM RBD, or RNP domain)
  misc_feature 22932:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MQVEIALQRDRHNMGRRYVEVFRCSKQDYYNAVAAEEGAYEYEVRASPPPTGPSRAKRFSEKEKLEYTEVLKMRGLPYSVNKPQIIEFFSGYKVIQGRVQVVCRPDGKATGEAFVEFETGEEARRAMAKDKMSIGSRYVELFPTTREEARRAEARSRQ

SEQ ID NO: 202 - DNA, 714 bp, Populus balsamifera subsp. trichocarpa
  misc_feature (1)..(714): Ceres ANNOT ID no. 1504263
  misc_feature 22988:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaatcaaatccctacttcgcagtgagcagtggtgcgagtggctttcaaccttatggatacggtggtggatttcagcccccaccctttcctgtggttcgtctgagggggcttcctttcaactgctcagatgttgagattctcaagttctttgctggattagatattgtggatgtcttgctggtcaacaagagtgggcggttcactggagaagcttttgttgtctttgctggacctatgcaggttgagtttgctttacagagggatcgacaaaacatgggacggaggtatgtggaagtttttaggtgcaagaggcaggattattacaacgctgttgctgcggaggtgaattatgaaggaatctatgacaatgattaccatggaagtcctcctccatctagagcaaagaggttcagtgataaggatcaaatggaatacacagagatcttgaagatgcggggtctccccttttctgcaaaaaaagctgaaataattgaattcttcaaagactttaagctcattgatgaaaggatacacattgcatgccgcccagatgggaaagctactggagaggcatatgtagagttcatttctgctgaggaggccaaaagagctatgagcaaggacaagatgacaattggatcgaggtatgttgagctgtttccttcaacacaagatgaagctagacgggcagagtcgagatcaaggcagtga

SEQ ID NO: 203 - protein, 237 aa, Populus balsamifera subsp. trichocarpa
  misc_feature (1)..(237): Ceres ANNOT ID no. 1504263
  misc_feature (150)..(220): Pfam Name: RRM_1 Pfam Description: RNA recognition motif. (a.k.a. RRM RBD, or RNP domain)
  misc_feature: SWISSPROT Homolog: HNRPF_MACFA Heterogeneous nuclear ribonucleoprotein F (hnRNP F) with e-value of 1.1e-20 and BLAST sequence identity of 42.5
  misc_feature: SWISSPROT Homolog: HNRPF_HUMAN Heterogeneous nuclear ribonucleoprotein F (hnRNP F) (Nucleolin-like protein mcs94-1) with e-value of 1.1e-20 and BLAST sequence identity of 42.5
  misc_feature: SWISSPROT Homolog: HNRH1_HUMAN Heterogeneous nuclear ribonucleoprotein H (hnRNP H) with e-value of 4.6e-19 and BLAST sequence identity of 40.0
  misc_feature: SWISSPROT Homolog: HNRH1_MOUSE Heterogeneous nuclear ribonucleoprotein H (hnRNP H) with e-value of 4.6e-19 and BLAST sequence identity of 40.0
  misc_feature: SWISSPROT Homolog: HNRH2_HUMAN Heterogeneous nuclear ribonucleoprotein H' (hnRNP H') (FTP-3) with e-value of 7.6e-19 and BLAST sequence identity of 40.0
  misc_feature 23085:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(237): Functional Homolog of  Ceres CLONE ID no. 4228 at SEQ ID NO. 213 with e-value of 8.80E-58 and BLAST sequence identity of 72.9
MESNPYFAVSSGASGFQPYGYGGGFQPPPFPVVRLRGLPFNCSDVEILKFFAGLDIVDVLLVNKSGRFTGEAFVVFAGPMQVEFALQRDRQNMGRRYVEVFRCKRQDYYNAVAAEVNYEGIYDNDYHGSPPPSRAKRFSDKDQMEYTEILKMRGLPFSAKKAEIIEFFKDFKLIDERIHIACRPDGKATGEAYVEFISAEEAKRAMSKDKMTIGSRYVELFPSTQDEARRAESRSRQ

SEQ ID NO: 204 - protein, 279 aa, Arabidopsis thaliana
  misc_feature (1)..(279): Ceres CLONE ID no. 4524
  misc_feature: Utility: Cold Germination Useful for making plants with increased tolerance to cold stress
  misc_feature: Utility: Cold Growth Useful for making plants with increased tolerance to cold stress
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
MVSFRFPFSFSQPPRATTSFSGFSISAVAVSVTVGAAAAGAAIAASRNPSHPILEWAFSSHRSSLSPWGSITLADESVVEPKTGFSFPASIGDSRRLLGVGLRKKSLLGLKNIDVYAFGVYADCDDVKKLVGDKYANLPASEIRGNKSFMDDLMEADIKMTIRLQIVYGKLNIRSVRNAFQESVGNRLKKFGGSDNDELLQSFTSLFKDEYKIPRNSTIDLTKDPGHVLSVAIEGNHVGSVKSHLLCRSILDLYIGEEPFDKNAREDFLDNAASLAFDN

SEQ ID NO: 205 - DNA, 891 bp, Populus balsamifera subsp. trichocarpa
  misc_feature (1)..(891): Ceres ANNOT ID no. 1442935
  misc_feature: Utility: Cold Germination Useful for making plants with increased tolerance to cold stress
  misc_feature: Utility: Cold Growth Useful for making plants with increased tolerance to cold stress
  misc_feature 23271:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
atggtttcactgcgcttcccgttcttgttttctcagcccaagaaacaccccaacggcatctcccgtaccatcacttcccgctccttccccgccaccacaaccaccgtggcatgtgccttggccgccggagctgccgcatttgcaggcatagcagccacccgcaactccaaaaatccaaaacaagataacccattcatccaaaacgccctgaatcttctcttctccaatcacttgctagcaccgtgggcttcactctctctagcagacccttcaccttcagttgtggaaacgaagaccggagcagcgtttccttcggttattttcgagtctcggagacttttgggaattgggctgcgtaaaaagactatcttgggattgaagaacattgatgtctacgccttcggtgtttatgcggatgctgatgaagtgaggaaagttctgagtgaaaaatatggaaaactctctgtttcagaactcaaggaaagcaaggagtttaaagaggattttatgggaggtgatattggcatgactgttagacttcagatagtctatagtaagctaagcattcgctctgttagaagtgcctttgaagagtctgtaggaagcagactgcaaaattttggggaaccaaatagcaaggaattgcttcagaggttcacttctcagtttaaggatgaatataaaataccacggggttctgtgattgagctttcaagggagcaaggccatgtacttcgcacaacaattgatgggaaggaggtgggaagtatccagagcaaactcctctgccgatcgattttagatctatacattggcgaggatccatttgataaagaggccaaagaagacatagaaagcaagtttgcatctctccttcaagtagatcactga

SEQ ID NO: 206 - protein, 296 aa, Populus balsamifera subsp. trichocarpa
  misc_feature (1)..(296): Ceres ANNOT ID no. 1442935
  misc_feature: Utility: Cold Germination Useful for making plants with increased tolerance to cold stress
  misc_feature: Utility: Cold Growth Useful for making plants with increased tolerance to cold stress
  misc_feature 23345:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature (1)..(296): Functional Homolog of  Ceres CLONE ID no. 4524 at SEQ ID NO. 216 with e-value of 1.99E-76 and BLAST sequence identity of 61.5
MVSLRFPFLFSQPKKHPNGISRTITSRSFPATTTTVACALAAGAAAFAGIAATRNSKNPKQDNPFIQNALNLLFSNHLLAPWASLSLADPSPSVVETKTGAAFPSVIFESRRLLGIGLRKKTILGLKNIDVYAFGVYADADEVRKVLSEKYGKLSVSELKESKEFKEDFMGGDIGMTVRLQIVYSKLSIRSVRSAFEESVGSRLQNFGEPNSKELLQRFTSQFKDEYKIPRGSVIELSREQGHVLRTTIDGKEVGSIQSKLLCRSILDLYIGEDPFDKEAKEDIESKFASLLQVDH

SEQ ID NO: 207 - protein, 284 aa, Arabidopsis thaliana
  misc_feature (1)..(284): Ceres CLONE ID no. 4581
  misc_feature (119)..(160): Pfam Name: zf-C3HC4 Pfam Description: Zinc finger, C3HC4 type (RING finger)
  misc_feature: Phenotype: SILIQUES - Short Useful for increasing seed/fruit yield or modifying fruit content
  misc_feature (278)..(278): Xaa is any aa, unknown, or other
MNSNDQDPIPFRPEDNNFSGSKTYAMSGKIMLSAIVILFFVVILMVFLHLYARWYLLRARRRHLRRRSRNRRATMVFFTADPSTAATSVVASRGLDPNVIKSLPVFTFSDETHKDPIECAVCLSEFEESETGRVLPNCQHTFHVDCIDMWFHSHSTCPLCRSLVEPLAGIESTAAAREREVVIAVDSDPVLVIEPSSSSGLTDEPHGSGSSQMLREDSGRKPAAIEVPRRTFSEFEDELTRRDSPASQSFRSPMSRMLSFTRMLSRDRRSASSPIAGXRRYRRR

SEQ ID NO: 208 - DNA, 882 bp, Populus balsamifera subsp. trichocarpa
  misc_feature (1)..(882): Ceres ANNOT ID no. 1489321
  misc_feature 23529:<222: Transcription Factor
  misc_feature: Phenotype: SILIQUES - Short Useful for increasing seed/fruit yield or modifying fruit content
atggacccagactcgagagatccaccacctgaatacagagaaggctatgcattaagtggcaagataatgcttagtgctattgttattctcttctttgttgtcattctaatggtttttctccacctttacgctcgttggtacctcactcgtgcacgccagcgccaagtccgccgtgtccgcaaccgccgtacccatcttgtcttctacgtcgactccgcccaagaccccaacaatgtcacctctcatgtcacgcgtggccttgaagagactgtcaagaattctcttcctgtttttgtatattcaagaaaaacccaccaagattcgattgagtgtgcggtttgtttatccgaatttgaagagaacgaaaggggtcgggtcttgcccaagtgtaaccacagtttccacaccgagtgtatcgatatgtggtttcattctcactccacttgccctctttgtcgctctccggttgagccggtggcggaaaaccccgttccagaaggttcaaatttcgggatttcagaagcgggttcgggtctgtgtacctcgtgccagcacgaggaggatcacgtgggatcggcttctacgtcgtcgtttaatgatggaaggaaacctgttgggcttattggtgtgaccatagacgtcccaaggagaaatgggaatttcgaggacgagtcaaataccgagtcaccatcagcgagtcactcttttagatcgccaatgagtcggatgttgtcgtttaagaggatgctaagtagggaaagaagaggtactgtgtctccaaccgtggctaactcagtgagctgcggtggtgggtcagggacgaccgagtttgatattgagcatgggcgggatgagtcgatgcctcagcaaactcggtgttaa

SEQ ID NO: 209 - protein, 293 aa, Populus balsamifera subsp. trichocarpa
  misc_feature (1)..(293): Ceres ANNOT ID no. 1489321
  misc_feature (111)..(152): Pfam Name: zf-C3HC4 Pfam Description: Zinc finger, C3HC4 type (RING finger)
  misc_feature: SWISSPROT Homolog: ATL3F_ARATH RING-H2 finger protein ATL3F (RING-H2 finger protein ATL2) with e-value of 2.4e-145 and BLAST sequence identity of 99.6
  misc_feature: SWISSPROT Homolog: ATL4G_ARATH RING-H2 finger protein ATL4G (RING-H2 finger protein ATL17) with e-value of 1.2e-45 and BLAST sequence identity of 48.7
  misc_feature: SWISSPROT Homolog: ATL3L_ARATH RING-H2 finger protein ATL3L (RING-H2 finger protein ATL5) with e-value of 2.0e-38 and BLAST sequence identity of 39.8
  misc_feature: SWISSPROT Homolog: ATL2L_ARATH RING-H2 finger protein ATL2L with e-value of 9.6e-33 and BLAST sequence identity of 40.2
  misc_feature: SWISSPROT Homolog: ATL2N_ARATH RING-H2 finger protein ATL2N with e-value of 2.8e-32 and BLAST sequence identity of 47.7
  misc_feature 23628:<222: Transcription Factor
  misc_feature: Phenotype: SILIQUES - Short Useful for increasing seed/fruit yield or modifying fruit content
  misc_feature (1)..(293): Functional Homolog of  Ceres CLONE ID no. 4581 at SEQ ID NO. 219 with e-value of 2.99E-64 and BLAST sequence identity of 62.2
MDPDSRDPPPEYREGYALSGKIMLSAIVILFFVVILMVFLHLYARWYLTRARQRQVRRVRNRRTHLVFYVDSAQDPNNVTSHVTRGLEETVKNSLPVFVYSRKTHQDSIECAVCLSEFEENERGRVLPKCNHSFHTECIDMWFHSHSTCPLCRSPVEPVAENPVPEGSNFGISEAGSGLCTSCQHEEDHVGSASTSSFNDGRKPVGLIGVTIDVPRRNGNFEDESNTESPSASHSFRSPMSRMLSFKRMLSRERRGTVSPTVANSVSCGGGSGTTEFDIEHGRDESMPQQTRC

SEQ ID NO: 210 - DNA, 888 bp, Populus balsamifera subsp. trichocarpa
  misc_feature (1)..(888): Ceres ANNOT ID no. 1462498
  misc_feature 23718:<222: Transcription Factor
  misc_feature: Phenotype: SILIQUES - Short Useful for increasing seed/fruit yield or modifying fruit content
atggactcggacttgggagatccaccaaaggaatatagagaaggctttgcattaagtggcaagataatgctaagtgctgttgttattcttttccttgttatcattttaatggtttgtctccacttttacgctcgctggtacctcatccgcgcacggcggcgccatatccgccatgcccgcaaccgccgtaaccatcttgtattctacgtcgactctgcccacaaccctaccattgtcacaactcaagtcacacgtggccttgaagagaccgtcttaaaatcgcttcctgttttcgtgtattcagaaaaaacccaccaagattcgatggagtgtgcggtttgtttatccgagtttcaagagaacgaaacgggtcggactttgcctaaatgtaatcatagcttccacatcgggtgtattgatatgtggtttcattctcactccacgtgccctctctgtcgctctccggttgagccggtgacggaaaacccggttcaagatggtcccggttacgggatttcggtaccgggttcgggttccagttcgggtaccatgtgtcagcatgaggaggatcgtgtgggttcggcttctacgtcgtcgtttaatgacagaaggaaacagatggagcttatcggggtgaccatcgaagtgcctcggagaaatgggaattttgaggatgagtcaaacactgagtcaccatcagcgagtcacgcgtttagatcgccaatgagtcggatgctgtcgtttaagaggatgctaagtagggaaagaagaggtactgcgtctcctaacgtggctacctctgtgagttgcggtggtgagtcagggacgactgagatggatgttgaacgagggcaggatgagtcgatgcctcagcaaactcggtgctaa

SEQ ID NO: 211 - protein, 295 aa, Populus balsamifera subsp. trichocarpa
  misc_feature (1)..(295): Ceres ANNOT ID no. 1462498
  misc_feature (111)..(152): Pfam Name: zf-C3HC4 Pfam Description: Zinc finger, C3HC4 type (RING finger)
  misc_feature: SWISSPROT Homolog: ATL3F_ARATH RING-H2 finger protein ATL3F (RING-H2 finger protein ATL2) with e-value of 2.4e-145 and BLAST sequence identity of 99.6
  misc_feature: SWISSPROT Homolog: ATL4G_ARATH RING-H2 finger protein ATL4G (RING-H2 finger protein ATL17) with e-value of 1.2e-45 and BLAST sequence identity of 48.7
  misc_feature: SWISSPROT Homolog: ATL3L_ARATH RING-H2 finger protein ATL3L (RING-H2 finger protein ATL5) with e-value of 2.0e-38 and BLAST sequence identity of 39.8
  misc_feature: SWISSPROT Homolog: ATL2L_ARATH RING-H2 finger protein ATL2L with e-value of 9.6e-33 and BLAST sequence identity of 40.2
  misc_feature: SWISSPROT Homolog: ATL2N_ARATH RING-H2 finger protein ATL2N with e-value of 2.8e-32 and BLAST sequence identity of 47.7
  misc_feature 23817:<222: Transcription Factor
  misc_feature: Phenotype: SILIQUES - Short Useful for increasing seed/fruit yield or modifying fruit content
  misc_feature (1)..(295): Functional Homolog of  Ceres CLONE ID no. 4581 at SEQ ID NO. 219 with e-value of 3.09E-62 and BLAST sequence identity of 59.2
MDSDLGDPPKEYREGFALSGKIMLSAVVILFLVIILMVCLHFYARWYLIRARRRHIRHARNRRNHLVFYVDSAHNPTIVTTQVTRGLEETVLKSLPVFVYSEKTHQDSMECAVCLSEFQENETGRTLPKCNHSFHIGCIDMWFHSHSTCPLCRSPVEPVTENPVQDGPGYGISVPGSGSSSGTMCQHEEDRVGSASTSSFNDRRKQMELIGVTIEVPRRNGNFEDESNTESPSASHAFRSPMSRMLSFKRMLSRERRGTASPNVATSVSCGGESGTTEMDVERGQDESMPQQTRC

SEQ ID NO: 212 - protein, 148 aa, Arabidopsis thaliana
  misc_feature (1)..(148): Ceres CLONE ID no. 4928
  misc_feature: Utility: Cold Growth Useful for making plants with increased tolerance to cold stress
  misc_feature: Phenotype: WHOLE PLANT - Cold Growth Useful for making plants with increased tolerance to cold stress
MAFRITSQLRPVGNQFGGSRRFATTVADGAKQTYNKFSIMGEFAPVAIIGGFVGLAVLMAGHSLKQQLMHAPAISTRKNRRAAVAEVDDPENCVSSADKFINKSWLRKVGQIQDKSKAILSDPTRPNPFTTPRNAETLNSVGVAPKGI

SEQ ID NO: 213 - DNA, 474 bp, Populus balsamifera subsp. trichocarpa
  misc_feature (1)..(474): Ceres ANNOT ID no. 1447816
  misc_feature: Utility: Cold Growth Useful for making plants with increased tolerance to cold stress
  misc_feature 23971:<222: Transcription Factor
  misc_feature: Phenotype: WHOLE PLANT - Cold Growth Useful for making plants with increased tolerance to cold stress
atggctttcagggcaactagccagtggagagcagtactgctgtctcgattgggacagagtcgaccttttgcatcctccaccgctcccaagtttgcaacaatgtctcacaatgctgcccatcatgtgcctaacagcaggcacgcagcgacgggggagtatgcaccattctatgtgatggcgggaatgatgactgtagcagttgcgatggccttccacaccatgaagcagcagctggtgcatagcccaggagttagcataaacaagaaaaggagagaatccattgctgaggtagacgaccctgatacagtagttgctgatgctagtaaatttctcaaaaaatcattcctcaggaaggttgctcacatccaggaacataatcccaccctgcctgatccaacccgcgctaatgccatcaccaagcctcatgatgcagagacactaaaaactgtcggagtccttcctcgccaccactga

SEQ ID NO: 214 - protein, 157 aa, Populus balsamifera subsp. trichocarpa
  misc_feature (1)..(157): Ceres ANNOT ID no. 1447816
  misc_feature: Utility: Cold Growth Useful for making plants with increased tolerance to cold stress
  misc_feature 24018:<222: Transcription Factor
  misc_feature: Phenotype: WHOLE PLANT - Cold Growth Useful for making plants with increased tolerance to cold stress
  misc_feature (1)..(157): Functional Homolog of  Ceres CLONE ID no. 4928 at SEQ ID NO. 224 with e-value of 1.60E-28 and BLAST sequence identity of 48.9
MAFRATSQWRAVLLSRLGQSRPFASSTAPKFATMSHNAAHHVPNSRHAATGEYAPFYVMAGMMTVAVAMAFHTMKQQLVHSPGVSINKKRRESIAEVDDPDTVVADASKFLKKSFLRKVAHIQEHNPTLPDPTRANAITKPHDAETLKTVGVLPRHH

SEQ ID NO: 215 - protein, 250 aa, Arabidopsis thaliana
  misc_feature (1)..(250): Ceres CLONE ID no. 5055
  misc_feature (75)..(176): Pfam Name: K-box Pfam Description: K-box region
  misc_feature (9)..(59): Pfam Name: SRF-TF Pfam Description: SRF-type transcription factor DNA-binding and dimerisation domain)
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: INFLORESCENCE - Weak Useful for making stronger plants
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 216 - DNA, 729 bp, Populus balsamifera subsp. trichocarpa
  misc_feature (1)..(729): Ceres ANNOT ID no. 1438157
  misc_feature 24178:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: INFLORESCENCE - Weak Useful for making stronger plants
atggggagaggtagggttgagttgaagagaattgagaacaagatcaacaggcaagtaacatttgcaaagagaaggaatggacttttgaagaaagcctatgagctttccgttctttgtgatgcagaggttgctctcatcatcttctccaatagaggaaagctgtacgagttttgcagtagttcaagcatgctcaaaactcttgagaggtaccagaagtgcaattatggagcaccagagccaaatgtgtctgcaagggaggccctggaactgagtagtcagcaggaatatctgaagcttaaagcacgttatgaagccctgcaaagaacccaaaggaatcttttgggagaagaacttggccctctaagcagcaaagagctagaatcacttgaaaggcagcttgatatgtcattgaagcagatcagatcaacaaggacccaatacatgctggatcagctccatgacctacagcataaggagcacatgctgactgcagctaataagtccctgaaagaaaggttgatggaaggctaccaattaaattcactccagttgaatccaagtgcagaagatgtggagtacgctagacaacaagcccaaccccagggtgatgggttttttcatgctttggagtgtgaacctacactacaaattgggtatcagccagaaaatataacaatggtcactgctggcccaagtatgactacttacatgccaggttggttagcatga

SEQ ID NO: 217 - protein, 242 aa, Populus balsamifera subsp. trichocarpa
  misc_feature (1)..(242): Ceres ANNOT ID no. 1438157
  misc_feature (75)..(175): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: SEP3_ARATH Developmental protein SEPALLATA3 (Agamous-like MADS-box protein AGL9) with e-value of 2.9e-131 and BLAST sequence identity of 99.6
  misc_feature: SWISSPROT Homolog: AGL9_SINAL Agamous-like MADS-box protein AGL9 homolog (MADS D) with e-value of 2.8e-119 and BLAST sequence identity of 92.9
  misc_feature: SWISSPROT Homolog: AGL9_PETHY Agamous-like MADS-box protein AGL9 homolog (Floral homeotic protein FBP2) (Floral-binding protein 2) with e-value of 4.7e-92 and BLAST sequence identity of 76.3
  misc_feature: SWISSPROT Homolog: AGL9_ARADE Agamous-like MADS-box protein AGL9 homolog (OM1) with e-value of 5.1e-79 and BLAST sequence identity of 68.4
  misc_feature: SWISSPROT Homolog: AGL9_LYCES Agamous-like MADS-box protein AGL9 homolog (TM5) with e-value of 2.1e-75 and BLAST sequence identity of 83.1
  misc_feature 24296:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: INFLORESCENCE - Weak Useful for making stronger plants
  misc_feature (1)..(242): Functional Homolog of  Ceres CLONE ID no. 5055 at SEQ ID NO. 227 with e-value of 2.80E-93 and BLAST sequence identity of 79.9
MGRGRVELKRIENKINRQVTFAKRRNGLLKKAYELSVLCDAEVALIIFSNRGKLYEFCSSSSMLKTLERYQKCNYGAPEPNVSAREALELSSQQEYLKLKARYEALQRTQRNLLGEELGPLSSKELESLERQLDMSLKQIRSTRTQYMLDQLHDLQHKEHMLTAANKSLKERLMEGYQLNSLQLNPSAEDVEYARQQAQPQGDGFFHALECEPTLQIGYQPENITMVTAGPSMTTYMPGWLA

SEQ ID NO: 218 - DNA, 909 bp, Populus balsamifera subsp. trichocarpa
  misc_feature (1)..(909): Ceres ANNOT ID no. 1500936
  misc_feature 24391:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: INFLORESCENCE - Weak Useful for making stronger plants
atggggagaggtagggttgagttgaagagaattgagaacaagatcaacaggcaagtaacatttgcaaagagaaggaatggacttttgaagaaagcctatgagctttccgttctttgtgatgcagagattgctctcatcatcttctccaatagaggaaagctgtacgagttttgcagtagttcaaggagaagtgtgaaaatctcacactttctgaaaaggattgtgctgaaaagaaaacccttgctgtatatattgtccccatacctgtcactacatgttgtaacaattttcaatctcgatgcatgctcaaaactcttgagaggtaccagaagtgcaactatggagcaccagagccaaatgtgtcagcaagggaggccttggtattttgaatcattcatgctcaaatgggttttattgctgtggctgcaggaactgagtagccagcaggaatatctgaagcttaaagcacgctacgaagctctgcaaagaacccagaggaatcttttgggagaagaccttggccctctgagcagcaaagagcttgaatcacttgaaagacagcttgatatgtcactgaagcagatcagatcaacaaggacccagtacatgctggatcagctcaatgatctacagcataagcattacatgcaggaacacatgttgactgcagctaataagtctctgagagaaaggttgatggaaggctacgaagtaaattcactccagttgaatctaagtgcagaagatgtgggtttttctcgacaacaagctcaaccccaaggttatggattctttcatcctttggagtgcgaacctactttacaaattgggtatcagcctgacagtgctataacagtggtcacttctggcccaagtatgactgcttacatgccaggttggttaccatga

SEQ ID NO: 219 - protein, 302 aa, Populus balsamifera subsp. trichocarpa
  misc_feature (1)..(302): Ceres ANNOT ID no. 1500936
  misc_feature (132)..(234): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: SEP3_ARATH Developmental protein SEPALLATA3 (Agamous-like MADS-box protein AGL9) with e-value of 2.9e-131 and BLAST sequence identity of 99.6
  misc_feature: SWISSPROT Homolog: AGL9_SINAL Agamous-like MADS-box protein AGL9 homolog (MADS D) with e-value of 2.8e-119 and BLAST sequence identity of 92.9
  misc_feature: SWISSPROT Homolog: AGL9_PETHY Agamous-like MADS-box protein AGL9 homolog (Floral homeotic protein FBP2) (Floral-binding protein 2) with e-value of 4.7e-92 and BLAST sequence identity of 76.3
  misc_feature: SWISSPROT Homolog: AGL9_ARADE Agamous-like MADS-box protein AGL9 homolog (OM1) with e-value of 5.1e-79 and BLAST sequence identity of 68.4
  misc_feature: SWISSPROT Homolog: AGL9_LYCES Agamous-like MADS-box protein AGL9 homolog (TM5) with e-value of 2.1e-75 and BLAST sequence identity of 83.1
  misc_feature 24515:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: INFLORESCENCE - Weak Useful for making stronger plants
  misc_feature (1)..(302): Functional Homolog of  Ceres CLONE ID no. 5055 at SEQ ID NO. 227 with e-value of 1.60E-67 and BLAST sequence identity of 73.0
MGRGRVELKRIENKINRQVTFAKRRNGLLKKAYELSVLCDAEIALIIFSNRGKLYEFCSSSRRSVKISHFLKRIVLKRKPLLYILSPYLSLHVVTIFNLDACSKLLRGTRSATMEHQSQMCQQGRPWYFESFMLKWVLLLWLQELSSQQEYLKLKARYEALQRTQRNLLGEDLGPLSSKELESLERQLDMSLKQIRSTRTQYMLDQLNDLQHKHYMQEHMLTAANKSLRERLMEGYEVNSLQLNLSAEDVGFSRQQAQPQGYGFFHPLECEPTLQIGYQPDSAITVVTSGPSMTAYMPGWLP

SEQ ID NO: 220 - protein, 108 aa, Arabidopsis thaliana
  misc_feature (1)..(108): Ceres CLONE ID no. 5132
  misc_feature (1)..(108): Pfam Name: UPF0041 Pfam Description: Uncharacterised protein family (UPF0041)
  misc_feature: Utility: ABA Useful for making plants with enhanced tolerance to drought
  misc_feature: Phenotype: WHOLE PLANT - ABA Useful for making plants with enhanced tolerance to drought
MATSKLQAIWNHPAGPKTIHFWAPTFKWGISIANIADFAKPPEKLSYPQQIAVTCTGVIWSRYSMVINPKNWNLFSVNVAMAGTGIYQLARKIKHDYATEAEPAVASE

SEQ ID NO: 221 - DNA, 327 bp, Populus balsamifera subsp. trichocarpa
  misc_feature (1)..(327): Ceres ANNOT ID no. 1465660
  misc_feature: Utility: ABA Useful for making plants with enhanced tolerance to drought
  misc_feature 24680:<222: Transcription Factor
  misc_feature: Phenotype: WHOLE PLANT - ABA Useful for making plants with enhanced tolerance to drought
atggcgacatcgaagctacaagctctgtggaatcacccagccggtcccaaaaccattcatttttgggcacctacttttaaatggggtattagcattgccaatattgctgacttcgctaaacctccggaaaaactgtcctaccctcagcaaatagcggtcacttgtactggagttatatggtcacgctacagtactgtaattacaccaaaaaattggaatctatttagtgtaaatgttgcgatggctgcaacaggcatctaccaactcagtcgcaaaatacagcacgattacttttctgaggaagaagctgctgttgcaaaggaataa

SEQ ID NO: 222 - protein, 108 aa, Populus balsamifera subsp. trichocarpa
  misc_feature (1)..(108): Ceres ANNOT ID no. 1465660
  misc_feature (1)..(97): Pfam Name: UPF0041 Pfam Description: Uncharacterised protein family (UPF0041)
  misc_feature: SWISSPROT Homolog: BR44_HUMAN Brain protein 44 with e-value of 2.4e-24 and BLAST sequence identity of 49.0
  misc_feature: SWISSPROT Homolog: BR44_RAT Brain protein 44 (0-44 protein) with e-value of 5.1e-24 and BLAST sequence identity of 53.3
  misc_feature: SWISSPROT Homolog: BR44_MOUSE Brain protein 44 with e-value of 8.3e-24 and BLAST sequence identity of 55.2
  misc_feature: SWISSPROT Homolog: BR44_PONPY Brain protein 44 with e-value of 7.5e-23 and BLAST sequence identity of 48.0
  misc_feature: SWISSPROT Homolog: YAI9_SCHPO Hypothetical UPF0041 protein C24B11.09 in chromosome I with e-value of 1.6e-20 and BLAST sequence identity of 45.1
  misc_feature: Utility: ABA Useful for making plants with enhanced tolerance to drought
  misc_feature 24765:<222: Transcription Factor
  misc_feature: Phenotype: WHOLE PLANT - ABA Useful for making plants with enhanced tolerance to drought
  misc_feature (1)..(108): Functional Homolog of  Ceres CLONE ID no. 5132 at SEQ ID NO. 232 with e-value of 4.20E-51 and BLAST sequence identity of 89.8
MATSKLQALWNHPAGPKTIHFWAPTFKWGISIANIADFAKPPEKLSYPQQIAVTCTGVIWSRYSTVITPKNWNLFSVNVAMAATGIYQLSRKIQHDYFSEEEAAVAKE

SEQ ID NO: 223 - protein, 251 aa, Arabidopsis thaliana
  misc_feature (1)..(251): Ceres CLONE ID no. 5167
  misc_feature (191)..(242): Pfam Name: Abhydrolase_1 Pfam Description: alpha/beta hydrolase fold
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
MVSFDRPGYAESDPDPNRTPKSLALDIEELADQLSLGSKFYVIGYSMGGQATWACLKYIPHRLAGVTLVAPVVNYWWKNFPSEISTEAFNQQGRNDQWAVRVAHYAPWLTHWWNSQSWFPGSSVVARNLGMLSKADKEIMFKLGAARSQHEAQIRQQGTHETLHRDMIVGFGREFDPMELENLFPNNEGSVHLWQGDDDVLVPVTLQRYIAKKLPWIHYHEIPGAGHLFPFAPGMVNNIVKTLLTNDGVKK

SEQ ID NO: 224 - DNA, 1137 bp, Populus balsamifera subsp. trichocarpa
  misc_feature (1)..(1137): Ceres ANNOT ID no. 1465422
  misc_feature 24923:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atgaaaaatcttggggataaattatggaagttcatcgtcaattttgtaacaatcaaatttctctgggctgtcatcaacgtgactaaatttttctctgggatgcagaaggaaattaaagcggctttgctttttgggttggtggtatgggtatatcaggcaaccaaccctccacctccaaagatttgcggtaccccaggcggcccgcctattacagcacctagaataaaattgagggatgggaggtatttggcctacaaggagcatggtgtctctagagaaactgccaaatataagatcatatatgttcatggctttgcctctatgagacataatacaatgagcgtggaaaaactctctccggaagttgttgaggagctgggattccaccttgtgtccttcgaccggccgggttatggagaaagtgatccacatccaaagcgaactccggagagtatagctttagatatagaagagcttgcggatcatttagaatttggatccagattttatgtcatggggttttctatgggaggtcaagtgatctggggctgcctcaagtacatccctcacaggctagcaggagcaacactaattgcgcctgttgtcaactactggtggcctggctttcctgccaacttatcaacagaagcctactacttacagctacctcaggaccagtggacattgcgtgttgctcaccatgctccatggctcacctattggtggaacactcagaaatggtttcctgcatcggcagttgcagcccgtaaacctgaagttttctcccgtcaggatttagaagtactcctttccatggttacagatggaagaatgaacatgccacaaacaatgcagcaaggaaaatttgaaaccatacatcgagacatgatgattgggtttgggaagtgggaattcgatcccatggatcttgaaaatccctttcctgacaacgaaggctcggttcatctatggcagggtgatgaagataagatggtgcctgttagcttgcaacgatatattacccaaagacttccctggataaactaccatgagatatctggctctggacacatgttcccttacatcccagagacatgcgaagcgattataaaggctcttttgctggaaaaaaactag

SEQ ID NO: 225 - protein, 271 aa, Populus balsamifera subsp. trichocarpa
  misc_feature (1)..(271): Ceres ANNOT ID no. 1465422
  misc_feature (21)..(264): Pfam Name: Abhydrolase_1 Pfam Description: alpha/beta hydrolase fold
  misc_feature 25020:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(271): Functional Homolog of  Ceres CLONE ID no. 5167 at SEQ ID NO. 235 with e-value of 8.79E-90 and BLAST sequence identity of 63.1
MRHNTMSVEKLSPEVVEELGFHLVSFDRPGYGESDPHPKRTPESIALDIEELADHLEFGSRFYVMGFSMGGQVIWGCLKYIPHRLAGATLIAPVVNYWWPGFPANLSTEAYYLQLPQDQWTLRVAHHAPWLTYWWNTQKWFPASAVAARKPEVFSRQDLEVLLSMVTDGRMNMPQTMQQGKFETIHRDMMIGFGKWEFDPMDLENPFPDNEGSVHLWQGDEDKMVPVSLQRYITQRLPWINYHEISGSGHMFPYIPETCEAIIKALLLEKN

SEQ ID NO: 226 - DNA, 1035 bp, Populus balsamifera subsp. trichocarpa
  misc_feature (1)..(1035): Ceres ANNOT ID no. 1457750
  misc_feature 25132:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atgatcaaggagattacagtggtcttgtgtctggggttggctgtatgggcatatcaggccacccaccctccacctccgaagctctgtggtgccccaggtggtcctcccgttacagcacctagaataaagctgagagatgggaggcatctatcctacaaggagaatggttttcctagagaaaaggccaaagctaagatcatacttgttcatggctttgcctgtacgaaacatgacataatgagtctgacagaccttgttccgcatgttgttgaggagcttgggttgtactttgtgtcctttgaccggccgggttatggagaaagtgatccagatccaaagcgaactccgaaaagtatagctttagatatagaggagcttgctgatcacttaggactaggatccaagttttatgtgatggggttctccatgggaggccaagtggtttggggctgcctcaagtacatacctcataggctcgcaggagcaacactaattgctcctgttgtcaactattggtggcctggctttcctgccaacttatcgacagaagcctactaccggcagataccacaggaacaatggatgttaagcgttgctcaccatgctccgtggctcacctactggtggaacactcagaaattgtttcctgcctcggctgttatcgccaggaagcctgagattttctcccgccaggatttagaactcgcctctatggctgcagagaaaagcgaggacaggccaccagcaacgccgcaaggagaatttgagtccttacatcgagactataatgttggattcgggaagtgggaatttgatcccatggagcttgaaaatccttttcctaacaatgaaggctcaattcatctatggcagggtgatgaagatgtactggtgccagttagcttgcagcgatatatagcccaaagaattccatggattaactaccatgaattgcctggtgctggacatctattcctcgctatcccacggaacttcgaacaaattgtaaaggctccttttccgggaaagaagtaa

SEQ ID NO: 227 - protein, 265 aa, Populus balsamifera subsp. trichocarpa
  misc_feature (1)..(265): Ceres ANNOT ID no. 1457750
  misc_feature (208)..(247): Pfam Name: Abhydrolase_1 Pfam Description: alpha/beta hydrolase fold
  misc_feature 25227:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(265): Functional Homolog of  Ceres CLONE ID no. 5167 at SEQ ID NO. 235 with e-value of 1.29E-88 and BLAST sequence identity of 66.1
MSLTDLVPHVVEELGLYFVSFDRPGYGESDPDPKRTPKSIALDIEELADHLGLGSKFYVMGFSMGGQVVWGCLKYIPHRLAGATLIAPVVNYWWPGFPANLSTEAYYRQIPQEQWMLSVAHHAPWLTYWWNTQKLFPASAVIARKPEIFSRQDLELASMAAEKSEDRPPATPQGEFESLHRDYNVGFGKWEFDPMELENPFPNNEGSIHLWQGDEDVLVPVSLQRYIAQRIPWINYHELPGAGHLFLAIPRNFEQIVKAPFPGKK

SEQ ID NO: 228 - DNA, 1035 bp, Populus balsamifera subsp. trichocarpa
  misc_feature (1)..(1035): Ceres ANNOT ID no. 1513544
  misc_feature 25339:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atgtttaccaaggcagtgattgtgttgttgattagtcttctggtatggacttatcagactataatacagcctccccctccgaatatttgtggacttccaggtggtcctcctgttacttctcctcgaatcaaactcagcgatggaaggtatctagcttacagagagagaggggttgccaaagagaaatctgaattcaaaatcatcatggttcatggctttgacaactccaaggacatggctcttgtagcctctcaggaactaattcttgagttgaggatatattttctctccttcgaccgcgcagggtatggagagagtgatccgaatccaaatcgctcggtaaagagtgacacatttgatattcaagagcttgcagacaaattacagctaggatcaaatttctatgtgcttggaatctccatgggaggctatcccacttggggatgcctcaaatatataccaaacaggctagcaggtgcagctcttgtggttccaattgtcaattactggtggccttccattccttgtcatctatccagggaggcctacaagagacaacttcagcgagaccaatggaaacttcggatagcccattacgttcctggactactatactggtggatgagccagaaatggttcccgtcatcttcttatgtggagatagtgccagaagtatatggcaatagagacaaacaaatcttgaagatgatgtcaggaacattgactcataatcagacaatgataagacaacaaggtgtttttgaatctcttcatcgagacctgatggtgggttttggaagttgggatttcgatcctatggaactaagtaatccattcccacacaatgagagttttattcacatctggcaaggttttgaggatccattagtgccagttaaactccagcgatatgtttgcaggaagctgcagtggattcgctatcatgaagtcactgatggaggacacctgatcatgtatgacactaatttgtttgaagccatcctgagggaactcttgcttccctccggtgtatga

SEQ ID NO: 229 - protein, 266 aa, Populus balsamifera subsp. trichocarpa
  misc_feature (1)..(266): Ceres ANNOT ID no. 1513544
  misc_feature 25428:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(266): Functional Homolog of  Ceres CLONE ID no. 5167 at SEQ ID NO. 235 with e-value of 2.59E-74 and BLAST sequence identity of 53.6
MALVASQELILELRIYFLSFDRAGYGESDPNPNRSVKSDTFDIQELADKLQLGSNFYVLGISMGGYPTWGCLKYIPNRLAGAALVVPIVNYWWPSIPCHLSREAYKRQLQRDQWKLRIAHYVPGLLYWWMSQKWFPSSSYVEIVPEVYGNRDKQILKMMSGTLTHNQTMIRQQGVFESLHRDLMVGFGSWDFDPMELSNPFPHNESFIHIWQGFEDPLVPVKLQRYVCRKLQWIRYHEVTDGGHLIMYDTNLFEAILRELLLPSGV

SEQ ID NO: 230 - protein, 125 aa, Arabidopsis thaliana
  misc_feature (1)..(125): Ceres CLONE ID no. 5198
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MAAKLRISSSSFSHRTNDSKTSSSSSYSSLLALPQFLCPPSPLGFPQFKLHAKLGGRDGEVKPKDKKKFITKEEEPEQYWQSVGEREGENPMKTPLPYIIIFGMSTPFVILAIAFANGWIKVPIR

SEQ ID NO: 231 - DNA, 357 bp, Populus balsamifera subsp. trichocarpa
  misc_feature (1)..(357): Ceres ANNOT ID no. 1472153
  misc_feature 25621:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggctgctaaggtggttctctcttcttctctcaacacccactttcccgtcccatccaagccatcatcgttctcttctgtggttttcactctcagttcaccaaagaaaagggttcatcatttcaaaatccatgcaaatttaggagagggggatggagaactcaagccgaaagggaagaagaaatttataaccagagaacaagaaccagaacagtattggcagagtgcaggggaaagggaaggagagaatcccatgaagacacctcttccttacatcattatatttggcatgtcaactccctttgtgatcttagccattgcttttgctaatggctggattaaggttcctgtaaggtga

SEQ ID NO: 232 - protein, 118 aa, Populus balsamifera subsp. trichocarpa
  misc_feature (1)..(118): Ceres ANNOT ID no. 1472153
  misc_feature 25693:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(118): Functional Homolog of  Ceres CLONE ID no. 5198 at SEQ ID NO. 242 with e-value of 2.00E-37 and BLAST sequence identity of 71.1
MAAKVVLSSSLNTHFPVPSKPSSFSSVVFTLSSPKKRVHHFKIHANLGEGDGELKPKGKKKFITREQEPEQYWQSAGEREGENPMKTPLPYIIIFGMSTPFVILAIAFANGWIKVPVR

SEQ ID NO: 233 - protein, 152 aa, Arabidopsis thaliana
  misc_feature (1)..(152): Ceres CLONE ID no. 5597
  misc_feature (23)..(143): Pfam Name: E1_DerP2_DerF2 Pfam Description: ML domain
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
MAISQAQPLLLLLLSVFFLPALHATSFTYCDKRLDPVKVTGVKISPDPVVSGAAATFKIFGSTGEDISGGKVVIRVLYVGIPVHTETHDLCDETACPVAPGSFVLSHSQTLPSITPPGTYTLKMTINDKNGGRLTCISFKFKITVGSAVFAS

SEQ ID NO: 234 - DNA, 459 bp, Populus balsamifera subsp. trichocarpa
  misc_feature (1)..(459): Ceres ANNOT ID no. 1507708
  misc_feature 25885:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
atggctcactgcatgatgattgttcctttgcttatctcgctttgtctgatcctacctttgattcaagcctccaaattccagtactgcgataataacaaggattatgacgttaaagttagcggagtgaagataagcccaaatccggtgaagaaagggaaaccagcgaccttcactatctctgcaacaacaagtgaatcaataactgatgggaaaatgagggtcgatgttagatacttcggatttcctgtgtatagtcaggatcatgatctttgcgaggaaacgccctgccctgtaaccagtggtaattttgtggtgtctcacactgaagagttgcctgggttcactccacctggttcatactctcttactatgaagatgattaatggagaaagtcgtgaacttacatgcatttcctttggttttcgcattggttctgcatcatccgtttctgacgtttag

SEQ ID NO: 235 - protein, 147 aa, Populus balsamifera subsp. trichocarpa
  misc_feature (1)..(147): Ceres ANNOT ID no. 1507708
  misc_feature (17)..(138): Pfam Name: E1_DerP2_DerF2 Pfam Description: ML domain
  misc_feature: SWISSPROT Homolog: NPC2_ASPOR Phosphatidylglycerol/phosphatidylinositol transfer (PG/PI-TP) with e-value of 2.6e-11 and BLAST sequence identity of 31.9
  misc_feature: SWISSPROT Homolog: NPC2_EMENI Phosphatidylglycerol/phosphatidylinositol transfer protein precursor (PG/PI-TP) with e-value of 2.4e-10 and BLAST sequence identity of 31.1
  misc_feature: SWISSPROT Homolog: NPC2_ASPFU Phosphatidylglycerol/phosphatidylinositol transfer protein precursor (PG/PI-TP) with e-value of 8.1e-10 and BLAST sequence identity of 28.8
  misc_feature: SWISSPROT Homolog: NPC2_USTMA Phosphatidylglycerol/phosphatidylinositol transfer protein precursor (PG/PI-TP) with e-value of 8.1e-10 and BLAST sequence identity of 25.6
  misc_feature: SWISSPROT Homolog: NPC2_SCHPO Phosphatidylglycerol/phosphatidylinositol transfer protein precursor (PG/PI-TP) with e-value of 1.3e-09 and BLAST sequence identity of 32.0
  misc_feature 26014:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature (1)..(147): Functional Homolog of  Ceres CLONE ID no. 5597 at SEQ ID NO. 245 with e-value of 5.49E-33 and BLAST sequence identity of 50.7
MIVPLLISLCLILPLIQASKFQYCDNNKDYDVKVSGVKISPNPVKKGKPATFTISATTSESITDGKMRVDVRYFGFPVYSQDHDLCEETPCPVTSGNFVVSHTEELPGFTPPGSYSLTMKMINGESRELTCISFGFRIGSASSVSDV

SEQ ID NO: 236 - DNA, 456 bp, Populus balsamifera subsp. trichocarpa
  misc_feature (1)..(456): Ceres ANNOT ID no. 1475094
  misc_feature 26119:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
atggctctgtacaagctgattgtaactttgcttatctcgctttgtctgatcctacctttgactcaagcctccaaattcgagtactgcggtagcaaggattatgccgttaaagttagcggggtgaagataagcccgaatccggtgaagaaagggaaaccagccaccttcatcatctctgcaaccacaagtgaaacaattactggagggaaattgagagttgatgttagatactttggatttcctgtgtatggagagtatcataatctttgtgaggagacatcgtgccctgtgagtggtggcgactttgtggtgtctcattcccaagagttgcctggattcacaccatctggttcatactctcttactatgaaaatggttgatggagaaggagatgaacttacttgcatttcctttggttttcacattggttctgcatcatctgttactgatatttag

SEQ ID NO: 237 - protein, 151 aa, Populus balsamifera subsp. trichocarpa
  misc_feature (1)..(151): Ceres ANNOT ID no. 1475094
  misc_feature (22)..(142): Pfam Name: E1_DerP2_DerF2 Pfam Description: ML domain
  misc_feature: SWISSPROT Homolog: NPC2_ASPOR Phosphatidylglycerol/phosphatidylinositol transfer protein precursor (PG/PI-TP) with e-value of 2.6e-11 and BLAST sequence identity of 31.9
  misc_feature: SWISSPROT Homolog: NPC2_EMENI Phosphatidylglycerol/phosphatidylinositol transfer protein precursor (PG/PI-TP) with e-value of 2.4e-10 and BLAST sequence identity of 31.1
  misc_feature: SWISSPROT Homolog: NPC2_ASPFU Phosphatidylglycerol/phosphatidylinositol transfer protein precursor (PG/PI-TP) with e-value of 8.1e-10 and BLAST sequence identity of 28.8
  misc_feature: SWISSPROT Homolog: NPC2_USTMA Phosphatidylglycerol/phosphatidylinositol transfer protein precursor (PG/PI-TP) with e-value of 8.1e-10 and BLAST sequence identity of 25.6
  misc_feature: SWISSPROT Homolog: NPC2_SCHPO Phosphatidylglycerol/phosphatidylinositol transfer protein precursor (PG/PI-TP) with e-value of 1.3e-09 and BLAST sequence identity of 32.0
  misc_feature 26248:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature (1)..(151): Functional Homolog of  Ceres CLONE ID no. 5597 at SEQ ID NO. 245 with e-value of 1.50E-32 and BLAST sequence identity of 51.0
MALYKLIVTLLISLCLILPLTQASKFEYCGSKDYAVKVSGVKISPNPVKKGKPATFIISATTSETITGGKLRVDVRYFGFPVYGEYHNLCEETSCPVSGGDFVVSHSQELPGFTPSGSYSLTMKMVDGEGDELTCISFGFHIGSASSVTDI

SEQ ID NO: 238 - protein, 90 aa, Arabidopsis thaliana
  misc_feature (1)..(90): Ceres CLONE ID no. 5605
  misc_feature (8)..(74): Pfam Name: Complex1_LYR Pfam Description: Complex 1 protein (LYR family)
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
MGASKLSGMQKQVLSLYRGFLRAARSRPIEDRKRIEMIVSTEFRHNSKEVDRKNFQYIEYLLRLGTKQLDQLKSPAIVSLSSIKVVTSKT

SEQ ID NO: 239 - DNA, 303 bp, Populus balsamifera subsp. trichocarpa
  misc_feature (1)..(303): Ceres ANNOT ID no. 1437939
  misc_feature 26413:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
atgggaccatcaacaggaggaagaacaagactctctggaatgcagaagcaagtgcttactctgtaccggggcttcttacgagcagctcgttcaaagtcccctgaagatcgacggcagattgaatcctttgtttcagctgagttccgccgcaactccaaacaagtagatcgcaagaatttcatctacattgagtacttgcttcgccgtggtaagaagcagcttgagcagctcaacagtcctgatactgttggattgtcatatatgaatgccactttctctgaaactgaaaatcccaaaaactaa

SEQ ID NO: 240 - protein, 100 aa, Populus balsamifera subsp. trichocarpa
  misc_feature (1)..(100): Ceres ANNOT ID no. 1437939
  misc_feature (13)..(79): Pfam Name: Complex1_LYR Pfam Description: Complex 1 protein (LYR family)
  misc_feature 26470:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature (1)..(100): Functional Homolog of  Ceres CLONE ID no. 5605 at SEQ ID NO. 250 with e-value of 5.39E-26 and BLAST sequence identity of 67.4
MGPSTGGRTRLSGMQKQVLTLYRGFLRAARSKSPEDRRQIESFVSAEFRRNSKQVDRKNFIYIEYLLRRGKKQLEQLNSPDTVGLSYMNATFSETENPKN

SEQ ID NO: 241 - protein, 113 aa, Arabidopsis thaliana
  misc_feature (1)..(113): Ceres CLONE ID no. 5710
  misc_feature (1)..(95): Pfam Name: Ferritin Pfam Description: Ferritin-like domain
  misc_feature: Phenotype: WHOLE PLANT - Small Useful for modulating plant size
MFMEYQNKRGGRVKLQSILMPVSEFDHEEKGDALHAMELALSLEKLTNEKLLKLQSVGVKNNDVQLVDFVESEFLGEQVEAIKKISEYVAQLRRIGKGHGVWHFDQMLLNDEV

SEQ ID NO: 242 - DNA, 795 bp, Populus balsamifera subsp. trichocarpa
  misc_feature (1)..(795): Ceres ANNOT ID no. 1464658
  misc_feature 26590:<222: Transcription Factor
  misc_feature: Phenotype: WHOLE PLANT - Small Useful for modulating plant size
atgttacttaaggcagcaccagccttttctctattgaacgcgacaggggataatctgggttccctgtttccatctgtttcttctctgtctaacaaaaatctttctgtttccccttcatttcttcgctcaaaaactgggtctggattcgttgtttgtgcctcaaagggggctaataatagacctttaactggtgtcgtctttgagccttttgaggaggttaagaaagaactgaatctcgtgcctaatgtgccacaagtttctcttgccaggcagaaatttaccgatgagagcgaagccgccatcaatgaacagatcaatgtggagtacaatgtctcatatgtgtaccatgcgatgtttgcctacttcgatagagataatgtggcactcaagggccttgccaagtttttcaaggaatctagtatcgaagaaagagagcatgctgagaaattgatggaataccagaataaacggggtggaaaagtgaagctgcagtctattttgatgcccctctctgagtttgatcatgcggagaagggagatgcactgtatgcaatggagcttgccttgtctttggaaaaactaacgaatgaaaagctcctgaacttgcatagtgtggccgagaagaacaaagacgtgcagttgacagatttcgttgaaagtgagtttttagctgagcaggtggatgctatcaaaaagatctcagaatatgttgctcagctgcgaagagtgggtaaaggacatggagtgtggcacttcgaccagatgctcctccatggggaagaagtagttgcataa

SEQ ID NO: 243 - protein, 147 aa, Populus balsamifera subsp. trichocarpa
  misc_feature (1)..(147): Ceres ANNOT ID no. 1464658
  misc_feature (1)..(126): Pfam Name: Ferritin Pfam Description: Ferritin-like domain
  misc_feature: SWISSPROT Homolog: FRI2_ARATH Ferritin-2, chloroplast precursor (EC 1.16.3.1) with e-value of 1.1e-55 and BLAST sequence identity of 100.0
  misc_feature: SWISSPROT Homolog: FRI3_SOYBN Ferritin-3, chloroplast precursor (EC 1.16.3.1) (SFerH-3) with e-value of 1.3e-48 and BLAST sequence identity of 88.2
  misc_feature: SWISSPROT Homolog: FRI2_VIGUN Ferritin-2, chloroplast precursor (EC 1.16.3.1) with e-value of 2.2e-46 and BLAST sequence identity of 84.4
  misc_feature: SWISSPROT Homolog: FRI2_TOBAC Ferritin-2, chloroplast precursor (EC 1.16.3.1) (NtFer2) with e-value of 2.9e-44 and BLAST sequence identity of 80.9
  misc_feature: SWISSPROT Homolog: FRI4_SOYBN Ferritin-4, chloroplast precursor (EC 1.16.3.1) (SFerH-4) with e-value of 4.8e-44 and BLAST sequence identity of 80.7
  misc_feature 26689:<222: Transcription Factor
  misc_feature: Phenotype: WHOLE PLANT - Small Useful for modulating plant size
  misc_feature (1)..(147): Functional Homolog of  Ceres CLONE ID no. 5710 at SEQ ID NO. 253 with e-value of 1.49E-46 and BLAST sequence identity of 86.3
MFAYFDRDNVALKGLAKFFKESSIEEREHAEKLMEYQNKRGGKVKLQSILMPLSEFDHAEKGDALYAMELALSLEKLTNEKLLNLHSVAEKNKDVQLTDFVESEFLAEQVDAIKKISEYVAQLRRVGKGHGVWHFDQMLLHGEEVVA

SEQ ID NO: 244 - DNA, 795 bp, Populus balsamifera subsp. trichocarpa
  misc_feature (1)..(795): Ceres ANNOT ID no. 1458337
  misc_feature 26752:<222: Transcription Factor
  misc_feature: Phenotype: WHOLE PLANT - Small Useful for modulating plant size
atgttacttaaggcggcaccagccttttctctgttgaatactagaggggaaagtttgggtcccctgttttcctccgcttcttctttgtctaacaataatcttgctgtttctccttcaattcttcgctcaaaaactgggtctggatttcttgtttgtgcttcaaaaggggctactaataagtctttaattggtgttgtctttaagccttttgaggaggttaagaaagaactcaatctcgtgcctactttgccacatgtttctcttgctagacagaagtttactgatgagagtgaagccgccatcaatcaacagatcaatgtggagtacaatgtctcatatgtgtaccatgccatgtttgcctactttgatagagataatgtggcactcaagggccttgccaattttttcaaggaatcaagtattgaagaaagagagcatgctgagaaattgatggaataccagaacaaaagaggtggaaaagtgaagctgcattctattttgatgcccctctctgagtttgatcatacggaaaaaggagatgcgctgtatgctatggagcttgccttgtgtttggagaaactaacaaatgaaaagctcctgaacttgcatggtgtggctgatcggaacaatgatgtgcagttggtagattttgttgaaagtgagtttttagccgagcaggtggaatctatcaaaaagatctcagaatatgttgctcagctgagaagggtgggcaaaggacatggagtatggcacttcgaccagatgctcctccgtgaggaagaagcggttgcataa

SEQ ID NO: 245 - protein, 147 aa, Populus balsamifera subsp. trichocarpa
  misc_feature (1)..(147): Ceres ANNOT ID no. 1458337
  misc_feature (1)..(126): Pfam Name: Ferritin Pfam Description: Ferritin-like domain
  misc_feature: SWISSPROT Homolog: FRI2_ARATH Ferritin-2, chloroplast precursor (EC 1.16.3.1) with e-value of 1.1e-55 and BLAST sequence identity of 100.0
  misc_feature: SWISSPROT Homolog: FRI3_SOYBN Ferritin-3, chloroplast precursor (EC 1.16.3.1) (SFerH-3) with e-value of 1.3e-48 and BLAST sequence identity of 88.2
  misc_feature: SWISSPROT Homolog: FRI2_VIGUN Ferritin-2, chloroplast precursor (EC 1.16.3.1) with e-value of 2.2e-46 and BLAST sequence identity of 84.4
  misc_feature: SWISSPROT Homolog: FRI2_TOBAC Ferritin-2, chloroplast precursor (EC 1.16.3.1) (NtFer2) with e-value of 2.9e-44 and BLAST sequence identity of 80.9
  misc_feature: SWISSPROT Homolog: FRI4_SOYBN Ferritin-4, chloroplast precursor (EC 1.16.3.1) (SFerH-4) with e-value of 4.8e-44 and BLAST sequence identity of 80.7
  misc_feature 26851:<222: Transcription Factor
  misc_feature: Phenotype: WHOLE PLANT - Small Useful for modulating plant size
  misc_feature (1)..(147): Functional Homolog of  Ceres CLONE ID no. 5710 at SEQ ID NO. 253 with e-value of 6.49E-46 and BLAST sequence identity of 84.5
MFAYFDRDNVALKGLANFFKESSIEEREHAEKLMEYQNKRGGKVKLHSILMPLSEFDHTEKGDALYAMELALCLEKLTNEKLLNLHGVADRNNDVQLVDFVESEFLAEQVESIKKISEYVAQLRRVGKGHGVWHFDQMLLREEEAVA

SEQ ID NO: 246 - DNA, 786 bp, Populus balsamifera subsp. trichocarpa
  misc_feature (1)..(786): Ceres ANNOT ID no. 1454234
  misc_feature 26914:<222: Transcription Factor
  misc_feature: Phenotype: WHOLE PLANT - Small Useful for modulating plant size
atggcagcaacgtttttgagccctgttccagccttttctcttgcagcaaagcaaggggatactgctcgtgtcctaatcactagtcctacaagtgatgggcatggcatttcttgttcttctgtttcagcctttccttcggcttcaagaaagaaaagaaacaccagtcttgtagtttctgccactggagaaactcttactggtgttgttttccagccatttgaagaggtgaagaaggaggtctttgttgtacctaattctcctcaagtttcttttgctcgtcagtactttgtggatgagtgtgaagctgccattaatgagcagatcaatgtggagtacacagcttcctatgtataccatgccatgtttgcctattttgacagggataacattgctctcaaaggcctagccaaattcttcaaggagtcaagtgaagaagaaagagaacatgctgaaaagctcatggaatatcagaatatacgaggagggaaagtagtacttcactctatactgacatccccttctgaatttgagcatgttgagaaaggagatgcattatatgcaatggaattagcattgtctttggagaagttgacaaatgagaaactgctgagcttgcacaaggtggcagacgagaacaatgatccacaaatggcagatttcgtcgagggcgaatttttaaccgaacaggttgaatccattaagaagatagctgaatatgtcgctcaactgcggatggttgggaaaggccatggagtatggcactttgatcagatgctcctcaattag

SEQ ID NO: 247 - protein, 141 aa, Populus balsamifera subsp. trichocarpa
  misc_feature (1)..(141): Ceres ANNOT ID no. 1454234
  misc_feature (1)..(126): Pfam Name: Ferritin Pfam Description: Ferritin-like domain
  misc_feature: SWISSPROT Homolog: FRI2_ARATH Ferritin-2, chloroplast precursor (EC 1.16.3.1) with e-value of 1.1e-55 and BLAST sequence identity of 100.0
  misc_feature: SWISSPROT Homolog: FRI3_SOYBN Ferritin-3, chloroplast precursor (EC 1.16.3.1) (SFerH-3) with e-value of 1.3e-48 and BLAST sequence identity of 88.2
  misc_feature: SWISSPROT Homolog: FRI2_VIGUN Ferritin-2, chloroplast precursor (EC 1.16.3.1) with e-value of 2.2e-46 and BLAST sequence identity of 84.4
  misc_feature: SWISSPROT Homolog: FRI2_TOBAC Ferritin-2, chloroplast precursor (EC 1.16.3.1) (NtFer2) with e-value of 2.9e-44 and BLAST sequence identity of 80.9
  misc_feature: SWISSPROT Homolog: FRI4_SOYBN Ferritin-4, chloroplast precursor (EC 1.16.3.1) (SFerH-4) with e-value of 4.8e-44 and BLAST sequence identity of 80.7
  misc_feature 27013:<222: Transcription Factor
  misc_feature: Phenotype: WHOLE PLANT - Small Useful for modulating plant size
  misc_feature (1)..(141): Functional Homolog of  Ceres CLONE ID no. 5710 at SEQ ID NO. 253 with e-value of 1.89E-39 and BLAST sequence identity of 76.8
MFAYFDRDNIALKGLAKFFKESSEEEREHAEKLMEYQNIRGGKVVLHSILTSPSEFEHVEKGDALYAMELALSLEKLTNEKLLSLHKVADENNDPQMADFVEGEFLTEQVESIKKIAEYVAQLRMVGKGHGVWHFDQMLLN

SEQ ID NO: 248 - DNA, 753 bp, Populus balsamifera subsp. trichocarpa
  misc_feature (1)..(753): Ceres ANNOT ID no. 1475996
  misc_feature 27073:<222: Transcription Factor
  misc_feature: Phenotype: WHOLE PLANT - Small Useful for modulating plant size
atggcttcaactttttcgagaagtgtttctgccttttctcttgcaacaaagcaaggggacgctgctagtggtgggcatggcatttcttccttgcctttgttttccagaaagaaaaggaacactagtcttgtagtttcttctgccagtggaactcttaccggtctagtgttccagccatttgaagaggtgaagagagaggaatttctcgttcctatttctcgtcaggtttctcttgctcgtcagttctatgtggatgagtgtgaagctgccattaacgagcagatcaatgtggagtattctgcttcctacgtgtaccatgccatgtttgcctattttgacagggataacattgctctcaaaggcctagccaaattcttcaaggaatcaagtgaagaagaaagagaacatgctgagaagctcatgaagtatcagaatatacgaggagggaaagtggtgcttcactctatactgacacccgtttctgaatttgagcatgttgagaaaggagatgcactatatgctatggaactggcattgtcattggagaagttgacaaatgagaaactactgagcctgcacaaggtggcagatgagaacaatgatccacaaatgcaagatttcatcgaaagcgagtttttggaagagcaggttgaatccattaagaagatagcagaatatgtcactcaattgcggatggttggaaaaggccatggagtatggcactttgatcagacgctcctccatgaggtgtga

SEQ ID NO: 249 - protein, 250 aa, Populus balsamifera subsp. trichocarpa
  misc_feature (1)..(250): Ceres ANNOT ID no. 1475996
  misc_feature (88)..(233): Pfam Name: Ferritin Pfam Description: Ferritin-like domain
  misc_feature: SWISSPROT Homolog: FRI2_ARATH Ferritin-2, chloroplast precursor (EC 1.16.3.1) with e-value of 1.1e-55 and BLAST sequence identity of 100.0
  misc_feature: SWISSPROT Homolog: FRI3_SOYBN Ferritin-3, chloroplast precursor (EC 1.16.3.1) (SFerH-3) with e-value of 1.3e-48 and BLAST sequence identity of 88.2
  misc_feature: SWISSPROT Homolog: FRI2_VIGUN Ferritin-2, chloroplast precursor (EC 1.16.3.1) with e-value of 2.2e-46 and BLAST sequence identity of 84.4
  misc_feature: SWISSPROT Homolog: FRI2_TOBAC Ferritin-2, chloroplast precursor (EC 1.16.3.1) (NtFer2) with e-value of 2.9e-44 and BLAST sequence identity of 80.9
  misc_feature: SWISSPROT Homolog: FRI4_SOYBN Ferritin-4, chloroplast precursor (EC 1.16.3.1) (SFerH-4) with e-value of 4.8e-44 and BLAST sequence identity of 80.7
  misc_feature 27170:<222: Transcription Factor
  misc_feature: Phenotype: WHOLE PLANT - Small Useful for modulating plant size
  misc_feature (1)..(250): Functional Homolog of  Ceres CLONE ID no. 5710 at SEQ ID NO. 253 with e-value of 3.09E-39 and BLAST sequence identity of 74.3
MASTFSRSVSAFSLATKQGDAASGGHGISSLPLFSRKKRNTSLVVSSASGTLTGLVFQPFEEVKREEFLVPISRQVSLARQFYVDECEAAINEQINVEYSASYVYHAMFAYFDRDNIALKGLAKFFKESSEEEREHAEKLMKYQNIRGGKVVLHSILTPVSEFEHVEKGDALYAMELALSLEKLTNEKLLSLHKVADENNDPQMQDFIESEFLEEQVESIKKIAEYVTQLRMVGKGHGVWHFDQTLLHEV

SEQ ID NO: 250 - protein, 181 aa, Arabidopsis thaliana
  misc_feature (1)..(181): Ceres CLONE ID no. 5968
  misc_feature (29)..(153): Pfam Name: PLAT Pfam Description: PLAT/LH2 domain
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
MARRDVLLPFLLLLATVSAVAFAEDDPDCVYTFYLRTGSIWKAGTDSIISARIYDKDGDYIGIKNLQAWAGLMGPDYNYFERGNLDIFSGRAPCLPSPICALNLTSDGSGDHHGWYVNYVEITTAGVHAQCSTQDFEIEQWLATDTSPYELTAVRNNCPVKLRDSVSRVGSEIRKKLSWVV

SEQ ID NO: 251 - DNA, 510 bp, Populus balsamifera subsp. trichocarpa
  misc_feature (1)..(510): Ceres ANNOT ID no. 1450891
  misc_feature 27329:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgtcactcaaccccctcctcctctctctcctcctcctctccgcctccaccatcgccttttctgatgaagattgtgtatacactctgtacataagaacagggttcatcatcaaaggtggcacggactctatcataagcgtgagactatatgacatgtatggtgactacgtgggcgtctccaatattgaagcatggggagggttaatggagccaggccacgactactttgagaggggcaatctggacattttcagtgggagagcaccatgtttgagttcacctgcgtgcgccttgaacttgacctctgatgggtcaggctctggccatggctggtacgttaactacgtggaggtgactaccactggggtccatgcgacttgttcacagatgaagtttactattgagcagtggctggctcttgatacttcaccttacgagttaactgctgttaggaattattgtgattattatcgggctaaaaaatctgctgctttaagttcttccatgtga

SEQ ID NO: 252 - protein, 169 aa, Populus balsamifera subsp. trichocarpa
  misc_feature (1)..(169): Ceres ANNOT ID no. 1450891
  misc_feature (25)..(149): Pfam Name: PLAT Pfam Description: PLAT/LH2 domain
  misc_feature 27392:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(169): Functional Homolog of  Ceres CLONE ID no. 5968 at SEQ ID NO. 262 with e-value of 4.90E-57 and BLAST sequence identity of 71.0
MSLNPLLLSLLLLSASTIAFSDEDCVYTLYIRTGFIIKGGTDSIISVRLYDMYGDYVGVSNIEAWGGLMEPGHDYFERGNLDIFSGRAPCLSSPACALNLTSDGSGSGHGWYVNYVEVTTTGVHATCSQMKFTIEQWLALDTSPYELTAVRNYCDYYRAKKSAALSSSM

SEQ ID NO: 253 - DNA, 519 bp, Populus balsamifera subsp. trichocarpa
  misc_feature (1)..(519): Ceres ANNOT ID no. 1456400
  misc_feature 27472:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgtccctaaacactttcctcctctgtctcctcctcctcttctccttttccgtcatcgccctttctgatgaagactgtgtgtacacactctacataagaacagggtccatcatcaaaggtggcacggactcgatcataagcgtgaggttctacgacaagtatggtgactccgtggggatctccaatattgaagcatggggagggttgatggagcctggtcacgactacttcgagaggggcgatttggacattttcagtgggagagcgccgtgcttgagttcaccggtgtgtgccctgaacttgacctccgatgggacagggtcaggtcatgggtggtatgttaactacgtggaggtgactaaaacaggagtccatgcgacttgttcacagatgaaatttactattgagcagtggctggctcttgatacttcaccttatgagttaactgctattaggaattattgtgattatcatgcggatgatcgagctaaaacatctgctggtttaagttcttcttag

SEQ ID NO: 254 - protein, 172 aa, Populus balsamifera subsp. trichocarpa
  misc_feature (1)..(172): Ceres ANNOT ID no. 1456400
  misc_feature (26)..(150): Pfam Name: PLAT Pfam Description: PLAT/LH2 domain
  misc_feature 27535:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(172): Functional Homolog of  Ceres CLONE ID no. 5968 at SEQ ID NO. 262 with e-value of 3.89E-55 and BLAST sequence identity of 71.2
MSLNTFLLCLLLLFSFSVIALSDEDCVYTLYIRTGSIIKGGTDSIISVRFYDKYGDSVGISNIEAWGGLMEPGHDYFERGDLDIFSGRAPCLSSPVCALNLTSDGTGSGHGWYVNYVEVTKTGVHATCSQMKFTIEQWLALDTSPYELTAIRNYCDYHADDRAKTSAGLSSS

SEQ ID NO: 255 - DNA, 516 bp, Populus balsamifera subsp. trichocarpa
  misc_feature (1)..(516): Ceres ANNOT ID no. 1450889
  misc_feature 27615:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgtctgtcaccactctccacctctctctcatccccttcctcttcctctccctcgccaccatagcattttctgatgaagactgtgtatacacagtgtacataagaacaggatccatcatcaaaggaggcacggactccatcataagcgttagactgtacgactcttatggtaagggcttggaggtcccagatcttgagagatggggagggctaatggagccaggtcacaactacttcgagaggggcaatttggacatttttagtggaagagcaccatgtttgagttcaccagtgtgtgcattgaacttgacatctgatgggtcaggttcaggccatggttggtacgttaactacgtggaggtgactacaactggggtccatgcggcttgttcacaaaagcagttcaccattgagcagtggctggctcttgatacttcgccttatgagttaactgctattaggaattattgtgattatcctgatgttaagaaatctgccggagcttcattcatgtga

SEQ ID NO: 256 - protein, 171 aa, Populus balsamifera subsp. trichocarpa
  misc_feature (1)..(171): Ceres ANNOT ID no. 1450889
  misc_feature (28)..(152): Pfam Name: PLAT Pfam Description: PLAT/LH2 domain
  misc_feature 27678:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(171): Functional Homolog of  Ceres CLONE ID no. 5968 at SEQ ID NO. 262 with e-value of 8.20E-55 and BLAST sequence identity of 70.2
MSVTTLHLSLIPFLFLSLATIAFSDEDCVYTVYIRTGSIIKGGTDSIISVRLYDSYGKGLEVPDLERWGGLMEPGHNYFERGNLDIFSGRAPCLSSPVCALNLTSDGSGSGHGWYVNYVEVTTTGVHAACSQKQFTIEQWLALDTSPYELTAIRNYCDYPDVKKSAGASFM

SEQ ID NO: 257 - DNA, 510 bp, Populus balsamifera subsp. trichocarpa
  misc_feature (1)..(510): Ceres ANNOT ID no. 1456395
  misc_feature 27758:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgtcattccgccctctcctcctccctctcctcctcctcctttccttctcctccatagtattttctgatgaagactgcgtatacacaatgtacgtaagaacaggatccattatcaaaggaggcacggactccatcataagcgcgacactgtacgacacttatggttatggcgtggaggtcccagatcttgagagatggggagggctaatggagccaggccacaactacttcgagaggggcaatttggacattttcagtgggagaggaccatgtttgaatgcacctgtgtgcgccttgaacttgacctctgatgggtcaggttcaggccatggttggtacgttaactacgtggaggtgacgacaacaggggtccatgcggcttgtgcacaaaagaagttcgagattgagcaatggctggcccttgatacttcgccttatagcttaattgcttttagggattattgtgattatcttgatgttaagaaatccgccggaagctcttctatgtaa

SEQ ID NO: 258 - protein, 169 aa, Populus balsamifera subsp. trichocarpa
  misc_feature (1)..(169): Ceres ANNOT ID no. 1456395
  misc_feature (26)..(150): Pfam Name: PLAT Pfam Description: PLAT/LH2 domain
  misc_feature 27821:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(169): Functional Homolog of  Ceres CLONE ID no. 5968 at SEQ ID NO. 262 with e-value of 6.60E-53 and BLAST sequence identity of 66.4
MSFRPLLLPLLLLLSFSSIVFSDEDCVYTMYVRTGSIIKGGTDSIISATLYDTYGYGVEVPDLERWGGLMEPGHNYFERGNLDIFSGRGPCLNAPVCALNLTSDGSGSGHGWYVNYVEVTTTGVHAACAQKKFEIEQWLALDTSPYSLIAFRDYCDYLDVKKSAGSSSM

SEQ ID NO: 259 - DNA, 555 bp, Populus balsamifera subsp. trichocarpa
  misc_feature (1)..(555): Ceres ANNOT ID no. 1447193
  misc_feature 27901:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgaaggcaactctctgcttatcaataattttcatcgctctcttcttctctgcagatgctaatggcttctatggcggcggcggcgattgtatatacgctctctacgtaaagactggatcaataatgaaggcaggaacagattcaaaaatcagcctgacactaggagacgcacaaggccgatcagtctgggttccagaccttcaatcatggggtttaatggagcccaaacacgactactacgagcgtgctaaccttgacatctttagtggccgcggtccgtgcatcagtgcacccatatgccgcctaaacttgacctctgatggccaagggtctcaccatggctggtactgtgactacgtggaagtcacctccacaggaccacacaaggagtgtagccagactatcttttatgttgatcaatggctggctgctgatgttccaccctttaagctaactgccttgcttgatggatgcagaatcggggatgatgccttgaagaagggaaaaaatgggaagtttgctgtggagaatgttagaggatctgctttttcttga

SEQ ID NO: 260 - protein, 184 aa, Populus balsamifera subsp. trichocarpa
  misc_feature (1)..(184): Ceres ANNOT ID no. 1447193
  misc_feature (30)..(153): Pfam Name: PLAT Pfam Description: PLAT/LH2 domain
  misc_feature 27966:<222: Transcription Factor
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(184): Functional Homolog of  Ceres CLONE ID no. 5968 at SEQ ID NO. 262 with e-value of 2.29E-41 and BLAST sequence identity of 51.3
MKATLCLSIIFIALFFSADANGFYGGGGDCIYALYVKTGSIMKAGTDSKISLTLGDAQGRSVWVPDLQSWGLMEPKHDYYERANLDIFSGRGPCISAPICRLNLTSDGQGSHHGWYCDYVEVTSTGPHKECSQTIFYVDQWLAADVPPFKLTALLDGCRIGDDALKKGKNGKFAVENVRGSAFS

SEQ ID NO: 261 - protein, 332 aa, Arabidopsis thaliana
  misc_feature (1)..(332): Ceres CLONE ID no. 6066
  misc_feature (1)..(332): Also Known As Ceres CDNA ID no. 23366207
  misc_feature (1)..(332): Also Known As Ceres GEMINI ID 555A11
  misc_feature (198)..(316): Pfam Name: SNase Pfam Description: Staphylococcal nuclease homologue
  misc_feature 28069:<222: Transcription Factor
  misc_feature: Phenotype: Activates expression of the gene endogenous to the AtDXPR (SEQ ID NO 4143) regalutory region Useful for modulating Terpenoid Biosynthesis
MGNALTFLYGKCCKPTTTDDSLGPHGVSAATVGVSALAHDLFNFEITSQVPEGLGRYVQSSRKAQANWYRKILEAWKQAKPPPQTAEEASRLVTDILKRNQKADVEGLLSFYGLPLSHTLVEVTVEAPVSLPEGILFEFQTLPVDPKAVADGDTITVYVSTSEPVVSSSVPREVNLAAVQRAKAREKRNYPKADELHQKIIDSGYRVLNIENEEVLARKFRIRLRGIDAPESQMPFGKEAQEGLLKIVGRKSLKVLVYGEDQYGRCVGDLYCNGIFVQEAMLKKGLAWHYLAYDKRPVLAKWEKEARQKRIGLWASSNPEKPWDWRKNNRRE

SEQ ID NO: 262 - DNA, 981 bp, Populus balsamifera subsp. trichocarpa
  misc_feature (1)..(981): Ceres ANNOT ID no. 1458359
  misc_feature 28157:<222: Transcription Factor
  misc_feature: Phenotype: Activates expression of the gene endogenous to the AtDXPR (SEQ ID NO 4143) regalutory region Useful for modulating Terpenoid Biosynthesis
atgggaaatgccctgagattcctgtgtgggcattgttgcaaaccaacagaagcaggggactcttattcattgggaccacacggtgtatcagcggccacagttggtgtttcagctcttgcccgtgacttgttacactttgaaatcacatctcaggtcccagaaggacttggcaagcatgtggtttcatccaagaaggctcaagctaactggtatagaaagttgttggaggcctggaaagaagcaaaaccgccaccaaaaactcctgaagaagctgctaggctggttattcagaccttgaagagacaccaaaaggcagatgttgagggtttattggctttctatggtctcccacttcctcacacgcttattcaagtttctactgggatcccagcatcattgcctgaaggggtggatgcaaaagccgtagctgatggagacaccattacagtttatgttagcacgaccgaccccagggagtcagcttatgttccaagggaggttcaaacggctactgttcagagatctaaagctcgtgcagagaggaactatgggaaggcagatgcgcttcataaaaaaattgttgaagcaggatatcgggtattaaatattcaaaatcaggagattcttgctcgaaagtatcgcattcgattaaggggcatagatgcacctgagagtgcaatgccatatgggaaagaggcgaaagaggagcttgctaatcttgttcagggcaagtgtttgagaatctttgtttatggagaagatcgttatggccgctgtgtaggtgatatatattgcaatggaatatttgtacaggaaataatgctcaagaaggggctcgcatggcattatactgcttatgatcaacgctgggaactagaaacatgggaaaaggaggctcgagcaaagcgagtagggttatgggcttcaccaaatcctgagaagccatgggaatggagaaaggacagacgcgaaggcagatag

SEQ ID NO: 263 - protein, 326 aa, Populus balsamifera subsp. trichocarpa
  misc_feature (1)..(326): Ceres ANNOT ID no. 1458359
  misc_feature (191)..(309): Pfam Name: SNase Pfam Description: Staphylococcal nuclease homologue
  misc_feature: SWISSPROT Homolog: Y38K_CORSE Hypothetical 38.1 kDa protein with e-value of 1.2e-118 and BLAST sequence identity of 66.0
  misc_feature: SWISSPROT Homolog: YFI3_ECO57 Putative endonuclease precursor (EC 3.1.-.-) with e-value of 3.3e-20 and BLAST sequence identity of 37.0
  misc_feature: SWISSPROT Homolog: YFI3_ECOLI Putative endonuclease precursor (EC 3.1.-.-) (ORFA) with e-value of 3.3e-20 and BLAST sequence identity of 37.0
  misc_feature: SWISSPROT Homolog: NUC_SHIFL Micrococcal nuclease precursor (EC 3.1.31.1) with e-value of 5.9e-17 and BLAST sequence identity of 35.3
  misc_feature: SWISSPROT Homolog: PAB4_ECOLI Protein parB with e-value of 5.9e-17 and BLAST sequence identity of 35.2
  misc_feature 28260:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(326): Functional Homolog of  Ceres CLONE ID no. 6066 at SEQ ID NO. 273 with e-value of 8.00E-128 and BLAST sequence identity of 74.8
MGNALRFLCGHCCKPTEAGDSYSLGPHGVSAATVGVSALARDLLHFEITSQVPEGLGKHVVSSKKAQANWYRKLLEAWKEAKPPPKTPEEAARLVIQTLKRHQKADVEGLLAFYGLPLPHTLIQVSTGIPASLPEGVDAKAVADGDTITVYVSTTDPRESAYVPREVQTATVQRSKARAERNYGKADALHKKIVEAGYRVLNIQNQEILARKYRIRLRGIDAPESAMPYGKEAKEELANLVQGKCLRIFVYGEDRYGRCVGDIYCNGIFVQEIMLKKGLAWHYTAYDQRWELETWEKEARAKRVGLWASPNPEKPWEWRKDRREGR

SEQ ID NO: 264 - DNA, 981 bp, Populus balsamifera subsp. trichocarpa
  misc_feature (1)..(981): Ceres ANNOT ID no. 1517940
  misc_feature 28356:<222: Transcription Factor
  misc_feature: Phenotype: Activates expression of the gene endogenous to the AtDXPR (SEQ ID NO 4143) regalutory region Useful for modulating Terpenoid Biosynthesis
atgggaaatgccttgaggttcctctatgggcattgctgcaaaccaacaacagctggggactctgattcattgggacccgacggtgtatcagccgcaacagttggtgtttcggctctttcccttgatttgtttcactttgaaatcacctcccaagtcccagaaggacttgataagcatgtggtctcgtccaagaaggctcaagctaattggtttagaaagttgttggaggcatggaaagaagcaaaacccccaccagaaacacccgaagaagttgctaggcttgttattcagaccttgaagagacaccagaaggcagatgttgagggtttattggctttctacggtctccaacttccgcatactcttgctcaagtttctgctgggggaccaacatcattgcctcaaggggtggatccaaaagctgtagctgatggagataccataacagtttatgttagcacgaccgacaccagggagtcatcttctgttccaggggaagttcatatggccgctgttcaaagatcaaaagctcgtgcggagaggaactatgggaaggcagatgcacttcaaaaaaaaattgttgaagcaggatatcgggtgattaatgttcaaaatgaggagattcttgctcgaaagtatcgcattcgattaaggggcatagatgcacctgagagttcaatgccatacgggaaagaggcgaaagaggagctagctaatcttgttcagggcaagtgtttgagagtctttgtctatggagaagatcgttatcgccgctgtgtaggtgatatatattgcaatggaatgtttgtacaggaagtaatgctcaagaagggtcttgcatggcattatactgcatatgataaacgccgggaactagaaacatgggaaaaggaggctcgagcaaagcgtgtagggttatgggcttcatcaaaccctgagatgccatgggaatggagaaaggacagacgtgaaggcagatag

SEQ ID NO: 265 - protein, 326 aa, Populus balsamifera subsp. trichocarpa
  misc_feature (1)..(326): Ceres ANNOT ID no. 1517940
  misc_feature (191)..(309): Pfam Name: SNase Pfam Description: Staphylococcal nuclease homologue
  misc_feature: SWISSPROT Homolog: Y38K_CORSE Hypothetical 38.1 kDa protein with e-value of 1.2e-118 and BLAST sequence identity of 66.0
  misc_feature: SWISSPROT Homolog: YFI3_ECO57 Putative endonuclease precursor (EC 3.1.-.-) with e-value of 3.3e-20 and BLAST sequence identity of 37.0
  misc_feature: SWISSPROT Homolog: YFI3_ECOLI Putative endonuclease precursor (EC 3.1.-.-) (ORFA) with e-value of 3.3e-20 and BLAST sequence identity of 37.0
  misc_feature: SWISSPROT Homolog: NUC_SHIFL Micrococcal nuclease precursor (EC 3.1.31.1) with e-value of 5.9e-17 and BLAST sequence identity of 35.3
  misc_feature: SWISSPROT Homolog: PAB4_ECOLI Protein parB with e-value of 5.9e-17 and BLAST sequence identity of 35.2
  misc_feature 28459:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(326): Functional Homolog of  Ceres CLONE ID no. 6066 at SEQ ID NO. 273 with e-value of 1.30E-125 and BLAST sequence identity of 73.6
MGNALRFLYGHCCKPTTAGDSDSLGPDGVSAATVGVSALSLDLFHFEITSQVPEGLDKHVVSSKKAQANWFRKLLEAWKEAKPPPETPEEVARLVIQTLKRHQKADVEGLLAFYGLQLPHTLAQVSAGGPTSLPQGVDPKAVADGDTITVYVSTTDTRESSSVPGEVHMAAVQRSKARAERNYGKADALQKKIVEAGYRVINVQNEEILARKYRIRLRGIDAPESSMPYGKEAKEELANLVQGKCLRVFVYGEDRYRRCVGDIYCNGMFVQEVMLKKGLAWHYTAYDKRRELETWEKEARAKRVGLWASSNPEMPWEWRKDRREGR

SEQ ID NO: 266 - DNA, 945 bp, Populus balsamifera subsp. trichocarpa
  misc_feature (1)..(945): Ceres ANNOT ID no. 1464628
  misc_feature 28555:<222: Transcription Factor
  misc_feature: Phenotype: Activates expression of the gene endogenous to the AtDXPR (SEQ ID NO 4143) regalutory region Useful for modulating Terpenoid Biosynthesis
atgggaaatgccttgaggttcctctatgggcattgctgcaaaccaacaacagctggggactctgattcattgggacccgacggtgtatcagccgcaacagttggtgtttcggctctttcccttgatttgtttcactttgaaatcacctcccaagtcccagaaggacttgataagcatgtggtctcgtccaagaaggctcaagctaattggtttagaaagttgttggaggcatggaaagaagcaaaacccccaccagaaacacccgaagaagttgctaggcttgttattcagaccttgaagagacaccagaaggcagatgttgagggtttattggctttctacggtctccaacttccgcatactcttgctcaagtttctgctgggggaccaacatcattgcctcaaggggtggatccaaaagctgtagctgatggagataccataacagtttatgttagcacgaccgacaccagggagtcatcttctgttccaggggaagttcatatggccgctgttcaaagatcaaaagctcgtgcggagaggaactatgggaaggcagatgcacttcaaaaaaaaattgttgaagcaggatatcgggtgattaatgttcaaaatgaggagattcttgctcgaaagtatcgcattcgattaaggggcatagatgcacctgagagttcaatgccatacgggaaagaggcgaaagaggagctagctaatcttgttcagggcaagtgtttgagagtctttgtctatggagaagatcgttatcgccgctgtgaagtaatgctcaagaagggtcttgcatggcattatactgcatatgataaacgccgggaactagaaacatgggaaaaggaggctcgagcaaagcgtgtagggttatgggcttcatcaaaccctgagatgccatgggaatggagaaaggacagacgtgaaggcagatag

SEQ ID NO: 267 - protein, 314 aa, Populus balsamifera subsp. trichocarpa
  misc_feature (1)..(314): Ceres ANNOT ID no. 1464628
  misc_feature (191)..(297): Pfam Name: SNase Pfam Description: Staphylococcal nuclease homologue
  misc_feature: SWISSPROT Homolog: Y38K_CORSE Hypothetical 38.1 kDa protein with e-value of 1.2e-118 and BLAST sequence identity of 66.0
  misc_feature: SWISSPROT Homolog: YFI3_ECO57 Putative endonuclease precursor (EC 3.1.-.-) with e-value of 3.3e-20 and BLAST sequence identity of 37.0
  misc_feature: SWISSPROT Homolog: YFI3_ECOLI Putative endonuclease precursor (EC 3.1.-.-) (ORFA) with e-value of 3.3e-20 and BLAST sequence identity of 37.0
  misc_feature: SWISSPROT Homolog: NUC_SHIFL Micrococcal nuclease precursor (EC 3.1.31.1) with e-value of 5.9e-17 and BLAST sequence identity of 35.3
  misc_feature: SWISSPROT Homolog: PAB4_ECOLI Protein parB with e-value of 5.9e-17 and BLAST sequence identity of 35.2
  misc_feature 28656:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(314): Functional Homolog of  Ceres CLONE ID no. 6066 at SEQ ID NO. 273 with e-value of 9.59E-116 and BLAST sequence identity of 73.2
MGNALRFLYGHCCKPTTAGDSDSLGPDGVSAATVGVSALSLDLFHFEITSQVPEGLDKHVVSSKKAQANWFRKLLEAWKEAKPPPETPEEVARLVIQTLKRHQKADVEGLLAFYGLQLPHTLAQVSAGGPTSLPQGVDPKAVADGDTITVYVSTTDTRESSSVPGEVHMAAVQRSKARAERNYGKADALQKKIVEAGYRVINVQNEEILARKYRIRLRGIDAPESSMPYGKEAKEELANLVQGKCLRVFVYGEDRYRRCEVMLKKGLAWHYTAYDKRRELETWEKEARAKRVGLWASSNPEMPWEWRKDRREGR

SEQ ID NO: 268 - protein, 162 aa, Arabidopsis thaliana
  misc_feature (1)..(162): Ceres CLONE ID no. 6082
  misc_feature (74)..(132): Pfam Name: DUF581 Pfam Description: Protein of unknown function (DUF581)
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
MLLGKRQRPPINRTTSLSEIKFDLNLPSESEPSNQQKPTVASPYGSNGQAVTAAVDQNRGFLDQRLLSMVTPRGNLRRHSGDFSDARHFLRSCALCERLLVPGRDIYMYRGDKAFCSSECRQEQMAQDERKEKGKSAAPAKEPAVTAPARAKPGKGRAAAAV

SEQ ID NO: 269 - DNA, 453 bp, Populus balsamifera subsp. trichocarpa
  misc_feature (1)..(453): Ceres ANNOT ID no. 1443416
  misc_feature 28838:<222: Transcription Factor
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
atgttgctgggcaagagaccacgtaatccaatgaagagaacaacaagcttctcagagatcacctttgatctaaacactgctactagtgaagcagccccaccaccgtctgatcatcatcaaaaacaggcgggatatggtggcctgatagatcaacggttcttgtctgacgctggatcaccaagaactacctatagaagggcttctgctgatttcttggagactgctcacttcttgagggcttgctctctttgcaagcgccggttgatccctggccgtgacatctacatgtacaggggtgacagtgctttttgcagcctagaatgcaggcaacaacaaatgagcttagatgagaggaaagagaagtgctcattagcatccaagaaagaatcgatatccaccaccaccgcaacagaagtctccgctaaaggagagagcaccgttgccgccttgtag

SEQ ID NO: 270 - protein, 150 aa, Populus balsamifera subsp. trichocarpa
  misc_feature (1)..(150): Ceres ANNOT ID no. 1443416
  misc_feature (62)..(120): Pfam Name: DUF581 Pfam Description: Protein of unknown function (DUF581)
  misc_feature 28913:<222: Transcription Factor
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
  misc_feature (1)..(150): Functional Homolog of  Ceres CLONE ID no. 6082 at SEQ ID NO. 280 with e-value of 1.30E-31 and BLAST sequence identity of 56.1
MLLGKRPRNPMKRTTSFSEITFDLNTATSEAAPPPSDHHQKQAGYGGLIDQRFLSDAGSPRTTYRRASADFLETAHFLRACSLCKRRLIPGRDIYMYRGDSAFCSLECRQQQMSLDERKEKCSLASKKESISTTTATEVSAKGESTVAAL

SEQ ID NO: 271 - DNA, 447 bp, Populus balsamifera subsp. trichocarpa
  misc_feature (1)..(447): Ceres ANNOT ID no. 1505047
  misc_feature 29004:<222: Transcription Factor
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
atgttgctgggcaagagacctcgtaatccaatgaaaaggacgacaagcttgacagagatcaaatttgatctaaacactgctagtagtgaggcagccccaccgtcagatcatcctcaaaaacaggtgggatatggtggaatgatagatcaacggtcctcggctgccactggatcaccaagaaccagccatagaagggcttctgctgatttcttggagactcccaacttcttgagggcttgctctctttgcaagcgccggttgatccctggccgtgacatctatatgtacaagggtgatagtgctttttgcagtcaagaatgcaggcaacaacaaatgagcttagatgagcgaaaagagaaatgctcattagcatccaagaaagaggctgtatcctccaccaccgcaacagaagtttccgctaaaggcgagaccgttgccgccttgtag

SEQ ID NO: 272 - protein, 148 aa, Populus balsamifera subsp. trichocarpa
  misc_feature (1)..(148): Ceres ANNOT ID no. 1505047
  misc_feature (61)..(119): Pfam Name: DUF581 Pfam Description: Protein of unknown function (DUF581)
  misc_feature 29079:<222: Transcription Factor
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
  misc_feature (1)..(148): Functional Homolog of  Ceres CLONE ID no. 6082 at SEQ ID NO. 280 with e-value of 1.50E-30 and BLAST sequence identity of 53.0
MLLGKRPRNPMKRTTSLTEIKFDLNTASSEAAPPSDHPQKQVGYGGMIDQRSSAATGSPRTSHRRASADFLETPNFLRACSLCKRRLIPGRDIYMYKGDSAFCSQECRQQQMSLDERKEKCSLASKKEAVSSTTATEVSAKGETVAAL

SEQ ID NO: 273 - DNA, 432 bp, Populus balsamifera subsp. trichocarpa
  misc_feature (1)..(432): Ceres ANNOT ID no. 1496339
  misc_feature 29170:<222: Transcription Factor
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
atgttgctgggcaagagaccacgtaatccaatgaagagaacaacaagcttctcagagatcacctttgatctaaacactgctactagtgaagcagccccaccaccgtctgatcatcatcaaaaacaggcgggatatggtggcctgatagatcaacggttcttgtctgacgctggatcaccaagaactacctatagaagggcttctgctgatttcttggagactgctcacttcttgagggcttgctctctttgcaagcgccggttgatccctggccgtgacatctacatgtacagcctagaatgcaggcaacaacaaatgagcttagatgagaggaaagagaagtgctcattagcatccaagaaagaatcgatatccaccaccaccgcaacagaagtctccgctaaaggagagagcaccgttgccgccttgtag

SEQ ID NO: 274 - protein, 143 aa, Populus balsamifera subsp. trichocarpa
  misc_feature (1)..(143): Ceres ANNOT ID no. 1496339
  misc_feature (62)..(113): Pfam Name: DUF581 Pfam Description: Protein of unknown function (DUF581)
  misc_feature 29245:<222: Transcription Factor
  misc_feature: Phenotype: ROSETTE LEAVES - Curled 2 Useful for making ornamental plants with altered leaf shape
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
  misc_feature (1)..(143): Functional Homolog of  Ceres CLONE ID no. 6082 at SEQ ID NO. 280 with e-value of 1.40E-25 and BLAST sequence identity of 54.6
MLLGKRPRNPMKRTTSFSEITFDLNTATSEAAPPPSDHHQKQAGYGGLIDQRFLSDAGSPRTTYRRASADFLETAHFLRACSLCKRRLIPGRDIYMYSLECRQQQMSLDERKEKCSLASKKESISTTTATEVSAKGESTVAAL

SEQ ID NO: 275 - protein, 355 aa, Arabidopsis thaliana
  misc_feature (1)..(355): Ceres CLONE ID no. 6220
  misc_feature (37)..(222): Pfam Name: CN_hydrolase Pfam Description: Carbon-nitrogen hydrolase
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Yellow-Green Viable 2 Useful for making lethal plants for genetic confinement systems
  misc_feature: Phenotype: WHOLE PLANT - Other Useful for making bigger plants
  misc_feature: Phenotype: ROSETTE LEAVES - Serrate Margins Useful for making plants with increased biomass and foliage
MSMQQETSHMTAAPQTNGHQIFPEIDMSAGDSSSIVRATVVQASTVFYDTPATLDKAERLLSEAAENGSQLVVFPEAFIGGYPRGSTFELAIGSRTAKGRDDFRKYHASAIDVPGPEVERLALMAKKYKVYLVMGVIEREGYTLYCTVLFFDSQGLFLGKHRKLMPTALERCIWGFGDGSTIPVFDTPIGKIGAAICWENRMPSLRTAMYAKGIEIYCAPTADSRETWLASMTHIALEGGCFVLSANQFCRRKDYPSPPEYMFSGSEESLTPDSVVCAGGSSIISPLGIVLAGPNYRGEALITADLDLGDIARAKFDFDVVGHYSRPEVFSLNIREHPRKAVSFKTSKVMEDESV

SEQ ID NO: 276 - DNA, 1134 bp, Populus balsamifera subsp. trichocarpa
  misc_feature (1)..(1134): Ceres ANNOT ID no. 1488463
  misc_feature 29458:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Yellow-Green Viable 2 Useful for making lethal plants for genetic confinement systems
  misc_feature: Phenotype: WHOLE PLANT - Other Useful for making bigger plants
  misc_feature: Phenotype: ROSETTE LEAVES - Serrate Margins Useful for making plants with increased biomass and foliage
atgcaagcaactgtaccagtttcatcatcacttcatacaacaagtacagcagcagacccaacagcgctctccacacagaccaacaacatggctcttgtccctgccccaccatcagaaaccccactttttgcagaagtagacatgtgttccgattcttcagcaacgactgtccgtgccactgttatccaagcctccactgtcttctatgacactcctgccactctagataaggctgagagatttctggctgaagcagctggatatgggtctcaattggttgtgtttcctgaagcatttattggtggttatcctagaggatcaagttttggtgctaccattggtagtcgtacagctaaaggtagagaggatttcagaaagtatcatgcttcagccattgatgttcctggtccagaagttgaccgtttggctgcaatggctgggaagtataaggtgtatttggtgatgggtgtgattgagagggagggatatacactctactgtaccgtgttgttttttgattctcaaggtcattacatggggaagcataggaaagttatgccgacggcggtggagcgtatagtatggggttttggagatggatcaacgattccggtttttgggactccgattgggaaaattggtgccgctatctgttgggaaaatagaatgccactcctaaggactgcaatgtatggtaaaggtattgaaatatattgtgcaccaacagctgattccagggatacttggcaagcaacgatgacccacattgctcttgagggaggatgttttgtactatctgccaaccagttttgccggaggaaggattacccacctcccccagagtatgtctttttgggcgtggaagaagacctcacacccgattctgttgtctgtgctggaggcagtgttattatatcaccattgggaactgttttggctggacccaattatgatggggaggcactgatttctgcagatctagatcttggagaaatagctagggcaaaatttgactttgatgtggttggacattactcaagacctgaagttctcagcttgactgtgagggaccatccaacaaatgcagttatgttcacatcagaatcagcaaaaactgaagcctctcgtaaatag

SEQ ID NO: 277 - protein, 377 aa, Populus balsamifera subsp. trichocarpa
  misc_feature (1)..(377): Ceres ANNOT ID no. 1488463
  misc_feature (58)..(243): Pfam Name: CN_hydrolase Pfam Description: Carbon-nitrogen hydrolase
  misc_feature: SWISSPROT Homolog: NRL4_ARATH Nitrilase 4 (EC 3.5.5.1) with e-value of 8.2e-191 and BLAST sequence identity of 100.0
  misc_feature: SWISSPROT Homolog: NRL4_TOBAC Nitrilase 4 (EC 3.5.5.1) with e-value of 1.4e-147 and BLAST sequence identity of 79.4
  misc_feature: SWISSPROT Homolog: NRL2_ARATH Nitrilase 2 (EC 3.5.5.1) with e-value of 1.8e-122 and BLAST sequence identity of 70.2
  misc_feature: SWISSPROT Homolog: NRL3_ARATH Nitrilase 3 (EC 3.5.5.1) with e-value of 7.9e-122 and BLAST sequence identity of 68.9
  misc_feature: SWISSPROT Homolog: NRL1_ARATH Nitrilase 1 (EC 3.5.5.1) with e-value of 1.0e-119 and BLAST sequence identity of 68.1
  misc_feature 29595:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Yellow-Green Viable 2 Useful for making lethal plants for genetic confinement systems
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(377): Functional Homolog of  Ceres CLONE ID no. 6220 at SEQ ID NO. 287 with e-value of 2.49E-149 and BLAST sequence identity of 78.6
MQATVPVSSSLHTTSTAADPTALSTQTNNMALVPAPPSETPLFAEVDMCSDSSATTVRATVIQASTVFYDTPATLDKAERFLAEAAGYGSQLVVFPEAFIGGYPRGSSFGATIGSRTAKGREDFRKYHASAIDVPGPEVDRLAAMAGKYKVYLVMGVIEREGYTLYCTVLFFDSQGHYMGKHRKVMPTAVERIVWGFGDGSTIPVFGTPIGKIGAAICWENRMPLLRTAMYGKGIEIYCAPTADSRDTWQATMTHIALEGGCFVLSANQFCRRKDYPPPPEYVFLGVEEDLTPDSVVCAGGSVIISPLGTVLAGPNYDGEALISADLDLGEIARAKFDFDVVGHYSRPEVLSLTVRDHPTNAVMFTSESAKTEASRK

SEQ ID NO: 278 - DNA, 1017 bp, Populus balsamifera subsp. trichocarpa
  misc_feature (1)..(1017): Ceres ANNOT ID no. 1541879
  misc_feature 29728:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Yellow-Green Viable 2 Useful for making lethal plants for genetic confinement systems
  misc_feature: Phenotype: WHOLE PLANT - Other Useful for making bigger plants
  misc_feature: Phenotype: ROSETTE LEAVES - Serrate Margins Useful for making plants with increased biomass and foliage
atggctcttgtccctgccccaccatcagaaaccccactttttgcagaagtagacatgtgttccgattcttcagcaacgactgtccgtgccactgttatccaagcctccactgtcttctatgacactcctgccactctagctggatatgggtctcaattggttgtgtttcctgaagcatttattggtggttatcctagaggatcaagttttggtgctaccattggtagtcgtacagctaaaggtagagaggatttcagaaagtatcatgcttcagccattgatgttcctggtccagaagttgaccgtttggctgcaatggctgggaagtataaggtgtatttggtgatgggtgtgattgagagggagggatatacactctactgtaccgtgttgttttttgattctcaaggtcattacatggggaagcataggaaagttatgccgacggcggtggagcgtatagtatggggttttggagatggatcaacgattccggtttttgggactccgattgggaaaattggtgccgctatctgttgggaaaatagaatgccactcctaaggactgcaatgtatggtaaaggtattgaaatatattgtgcaccaacagctgattccagggatacttggcaagcaacgatgacccacattgctcttgagggaggatgttttgtactatctgccaaccagttttgccggaggaaggattacccacctcccccagagtatgtctttttgggcgtggaagaagacctcacacccgattctgttgtctgtgctggaggcagtgttattatatcaccattgggaactgttttggctggacccaattatgatggggaggcactgatttctgcagatctagatcttggagaaatagctagggcaaaatttgactttgatgtggttggacattactcaagacctgaagttctcagcttgactgtgagggaccatccaacaaatgcagttatgttcacatcagaatcagcaaaaactgaagcctctcgtaaatag

SEQ ID NO: 279 - protein, 338 aa, Populus balsamifera subsp. trichocarpa
  misc_feature (1)..(338): Ceres ANNOT ID no. 1541879
  misc_feature (29)..(47): Pfam Name: CN_hydrolase Pfam Description: Carbon-nitrogen hydrolase
  misc_feature: SWISSPROT Homolog: NRL4_ARATH Nitrilase 4 (EC 3.5.5.1) with e-value of 8.2e-191 and BLAST sequence identity of 100.0
  misc_feature: SWISSPROT Homolog: NRL4_TOBAC Nitrilase 4 (EC 3.5.5.1) with e-value of 1.4e-147 and BLAST sequence identity of 79.4
  misc_feature: SWISSPROT Homolog: NRL2_ARATH Nitrilase 2 (EC 3.5.5.1) with e-value of 1.8e-122 and BLAST sequence identity of 70.2
  misc_feature: SWISSPROT Homolog: NRL3_ARATH Nitrilase 3 (EC 3.5.5.1) with e-value of 7.9e-122 and BLAST sequence identity of 68.9
  misc_feature: SWISSPROT Homolog: NRL1_ARATH Nitrilase 1 (EC 3.5.5.1) with e-value of 1.0e-119 and BLAST sequence identity of 68.1
  misc_feature 29861:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Yellow-Green Viable 2 Useful for making lethal plants for genetic confinement systems
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(338): Functional Homolog of  Ceres CLONE ID no. 6220 at SEQ ID NO. 287 with e-value of 1.70E-141 and BLAST sequence identity of 82.3
MALVPAPPSETPLFAEVDMCSDSSATTVRATVIQASTVFYDTPATLAGYGSQLVVFPEAFIGGYPRGSSFGATIGSRTAKGREDFRKYHASAIDVPGPEVDRLAAMAGKYKVYLVMGVIEREGYTLYCTVLFFDSQGHYMGKHRKVMPTAVERIVWGFGDGSTIPVFGTPIGKIGAAICWENRMPLLRTAMYGKGIEIYCAPTADSRDTWQATMTHIALEGGCFVLSANQFCRRKDYPPPPEYVFLGVEEDLTPDSVVCAGGSVIISPLGTVLAGPNYDGEALISADLDLGEIARAKFDFDVVGHYSRPEVLSLTVRDHPTNAVMFTSESAKTEASRK

SEQ ID NO: 280 - protein, 235 aa, Arabidopsis thaliana
  misc_feature (1)..(235): Ceres CLONE ID no. 6288
  misc_feature: Utility: MSX Useful for making plants tolerant to low nitrogen
  misc_feature: Phenotype: WHOLE PLANT - MSX Useful for making plants tolerant to low nitrogen
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETVELKEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 281 - DNA, 690 bp, Populus balsamifera subsp. trichocarpa
  misc_feature (1)..(690): Ceres ANNOT ID no. 1442129
  misc_feature: Utility: MSX Useful for making plants tolerant to low nitrogen
  misc_feature 30067:<222: Transcription Factor
  misc_feature: Phenotype: WHOLE PLANT - MSX Useful for making plants tolerant to low nitrogen
atgcctaagtctaagcgtaacaggccagttacattatcaaaaacaaagaagaaggggagggagcataaagagtctatagtgaattccataagggatgctgtggagaagtacaattctatatatgtgttcagttttgaaaacatgaggaatctcaaattcaaggagttcagagaacagcacaagttgaccagcagattcttccttggatcaaacaaagtaatgcaggtttctcttggtcgatctgctgctgatgaaatcaggccaggtcttcacaaagtttctaagcttctatgtggtgatgctggactttttcttaccaacttgccaagagaagaagttgaaaggttgtttaatgaatacgaggaatacgactttgcaaggacaggaaccactgcaacagaaacagtggaactcaaggaaggacctctcgaacagtttactcatgagatggaaccctttttgcgcaagcaagggatgcctgttcggttgaacaagggtgtgatcgaacttgtttcagactttgttgtcagtgaagaggggaagcctctgtcccctgagtgtgctcgcattctgcgcttgttaggaaccaagacggccaccttcaagcttcacttaatttgcagatggagccctgaggattttgagctttatagggaaggtctagatgattcagatgttgaatctgcctaa

SEQ ID NO: 282 - protein, 229 aa, Populus balsamifera subsp. trichocarpa
  misc_feature (1)..(229): Ceres ANNOT ID no. 1442129
  misc_feature: SWISSPROT Homolog: MRT4_HUMAN mRNA turnover protein 4 homolog with e-value of 1.0e-50 and BLAST sequence identity of 44.5
  misc_feature: SWISSPROT Homolog: MRT4_MOUSE mRNA turnover protein 4 homolog with e-value of 1.3e-50 and BLAST sequence identity of 46.0
  misc_feature: SWISSPROT Homolog: MRT4_NEUCR mRNA turnover protein 4 homolog with e-value of 1.4e-37 and BLAST sequence identity of 37.2
  misc_feature: SWISSPROT Homolog: MRT4_SCHPO mRNA turnover protein 4 homolog with e-value of 1.3e-34 and BLAST sequence identity of 35.6
  misc_feature: SWISSPROT Homolog: MRT4_CANGA mRNA turnover protein 4 homolog with e-value of 1.5e-31 and BLAST sequence identity of 37.0
  misc_feature: Utility: MSX Useful for making plants tolerant to low nitrogen
  misc_feature 30157:<222: Transcription Factor
  misc_feature: Phenotype: WHOLE PLANT - MSX Useful for making plants tolerant to low nitrogen
  misc_feature (1)..(229): Functional Homolog of  Ceres CLONE ID no. 6288 at SEQ ID NO. 292 with e-value of 2.09E-88 and BLAST sequence identity of 75.1
MPKSKRNRPVTLSKTKKKGREHKESIVNSIRDAVEKYNSIYVFSFENMRNLKFKEFREQHKLTSRFFLGSNKVMQVSLGRSAADEIRPGLHKVSKLLCGDAGLFLTNLPREEVERLFNEYEEYDFARTGTTATETVELKEGPLEQFTHEMEPFLRKQGMPVRLNKGVIELVSDFVVSEEGKPLSPECARILRLLGTKTATFKLHLICRWSPEDFELYREGLDDSDVESA

SEQ ID NO: 283 - DNA, 690 bp, Populus balsamifera subsp. trichocarpa
  misc_feature (1)..(690): Ceres ANNOT ID no. 1467192
  misc_feature: Utility: MSX Useful for making plants tolerant to low nitrogen
  misc_feature 30241:<222: Transcription Factor
  misc_feature: Phenotype: WHOLE PLANT - MSX Useful for making plants tolerant to low nitrogen
atgcctaagtctaagcgtaacaggccagttacattatcaaaaacaaagaagaaggggagggagcataaagagtctatagtgaattcgataagggatgctgtggagaaatacaattctatttatgtgtttagttttgaaaacatgaggaatctcaaattcaaggagttcagagaacagcataaattaaccagcagattcttccttgggtcaaacaaagtgatgcaggtttctctgggccgatctgctgctgatgaaatcaggccgggtcttcacaaagtttctaagcttctatgtggtgattctggactttttcttaccaacttgtcaagagaagaagttgaaaggttgtttaatgagtatgaagaatacgactttgcaaggacaggaaccactgcaacagaaatggtggaacttaaggaaggtcccctggaacagtttactcatgagatggagccctttttgcgcaagcaagggatgcctgttcggttgaataagggtgtgatagaccttgtttcaaactttgttgtctgtgaagaggggaagcctctctcgcctgagtcttctcgcatactgcgcttgttaggcaccaagatggccaccttccgacttcacttaatttgccgatggagccctgaggattttgagctttatagagaaggtctagatgaatcagatgttgaatcagcataa

SEQ ID NO: 284 - protein, 229 aa, Populus balsamifera subsp. trichocarpa
  misc_feature (1)..(229): Ceres ANNOT ID no. 1467192
  misc_feature: SWISSPROT Homolog: MRT4_HUMAN mRNA turnover protein 4 homolog with e-value of 1.0e-50 and BLAST sequence identity of 44.5
  misc_feature: SWISSPROT Homolog: MRT4_MOUSE mRNA turnover protein 4 homolog with e-value of 1.3e-50 and BLAST sequence identity of 46.0
  misc_feature: SWISSPROT Homolog: MRT4_NEUCR mRNA turnover protein 4 homolog with e-value of 1.4e-37 and BLAST sequence identity of 37.2
  misc_feature: SWISSPROT Homolog: MRT4_SCHPO mRNA turnover protein 4 homolog with e-value of 1.3e-34 and BLAST sequence identity of 35.6
  misc_feature: SWISSPROT Homolog: MRT4_CANGA mRNA turnover protein 4 homolog with e-value of 1.5e-31 and BLAST sequence identity of 37.0
  misc_feature: Utility: MSX Useful for making plants tolerant to low nitrogen
  misc_feature 30331:<222: Transcription Factor
  misc_feature: Phenotype: WHOLE PLANT - MSX Useful for making plants tolerant to low nitrogen
  misc_feature (1)..(229): Functional Homolog of  Ceres CLONE ID no. 6288 at SEQ ID NO. 292 with e-value of 4.39E-88 and BLAST sequence identity of 74.2
MPKSKRNRPVTLSKTKKKGREHKESIVNSIRDAVEKYNSIYVFSFENMRNLKFKEFREQHKLTSRFFLGSNKVMQVSLGRSAADEIRPGLHKVSKLLCGDSGLFLTNLSREEVERLFNEYEEYDFARTGTTATEMVELKEGPLEQFTHEMEPFLRKQGMPVRLNKGVIDLVSNFVVCEEGKPLSPESSRILRLLGTKMATFRLHLICRWSPEDFELYREGLDESDVESA

SEQ ID NO: 285 - protein, 286 aa, Arabidopsis thaliana
  misc_feature (1)..(286): Ceres CLONE ID no. 6387
  misc_feature (34)..(225): Pfam Name: Band_7 Pfam Description: SPFH domain / Band 7 family
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MNFKNVKVPKGPGGGVIAAVVIGGLSLYGATHTLYNVDGGHRAIVFNRLVGIKDKVYPEGTHLMIPWFERPIIYDVRAKPYLVESTSGSRDLQMVKIGLRVLTRPMADQLPEVYRSLGENYRERVLPSIIHETLKAVVAQYNASQLITQRESVSREIRKILTLRAANFHIALDDVSITGLTFGKEFTAAIEGKQVAAQEAERAKFIVEKAEQDKRSAVIRAEGEAKSAQLIGQAIANNQAFLTLRKIEAAREIAQTISRSANKVYLSSNDLLLNLQAMDLDVKPKK

SEQ ID NO: 286 - DNA, 873 bp, Populus balsamifera subsp. trichocarpa
  misc_feature (1)..(873): Ceres ANNOT ID no. 1509111
  misc_feature 30533:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgaatttcaagaatgtgaaagtacccaatttgccgggtggtggtgccattggaactctgattaagcttggagttattggtgggcttggtttgtatggagctgccaacagtctttacaacgttgatggtggacatagagcaatcatgttcaaccgtatagttggtgtcaaagacaaggtttatcctgaggggacacactttatggttccatggtttgaaaggcccgtcatttatgatgttcgtgcacgaccccatctggtagagagtacttcagggagccgtgatctccaaatggtcaagattgggcttcgagttcttactcgtcctgtggcagaccagctacctgaaatttatagaacccttggtgagaattataatgaaagagttttgccttctatcattcatgaaacactgaaagctgtggttgcacaatacaatgccagtcagctcatcactcagagagaggctgttagtagagaaataaggaagattttgacagaaagagcggtcaattttaacattgcacttgatgacgtgtccattacaagcttgacatttgggaaagaatttaccgctgccatcgaagccaaacaagtggccgcacaagaagctgaaagagctaaatttattgtggaaaaagctgaacaagacaagaaaagtgctgttatcagagctgagggagaggccaccagtgctcagctcattggtcaagctattgccaacaatcctgcatttatcactctaaggaagattgaagccgcaagagaaattgcacataccatctcaaattcagccaacaaggttttccttgattctggtgatttgctgttgaaccttcagaagatggagttagagaccactgggaagaaatag

SEQ ID NO: 287 - protein, 290 aa, Populus balsamifera subsp. trichocarpa
  misc_feature (1)..(290): Ceres ANNOT ID no. 1509111
  misc_feature (38)..(229): Pfam Name: Band_7 Pfam Description: SPFH domain / Band 7 family
  misc_feature: SWISSPROT Homolog: PHB2_RAT Prohibitin-2 (B-cell receptor-associated protein BAP37) (BAP-37) with e-value of 6.1e-76 and BLAST sequence identity of 52.5
  misc_feature: SWISSPROT Homolog: PHB2_HUMAN Prohibitin-2 (B-cell receptor-associated protein BAP37) (Repressor of estrogen receptor activity) (D-prohibitin) with e-value of 7.7e-76 and BLAST sequence identity of 52.5
  misc_feature: SWISSPROT Homolog: PHB2_MOUSE Prohibitin-2 (B-cell receptor-associated protein BAP37) (Repressor of estrogen receptor activity) with e-value of 7.7e-76 and BLAST sequence identity of 52.5
  misc_feature: SWISSPROT Homolog: PHB2_CAEEL Mitochondrial prohibitin complex protein 2 (Prohibitin-2) with e-value of 1.6e-75 and BLAST sequence identity of 52.1
  misc_feature: SWISSPROT Homolog: PHB2_YEAST Prohibitin-2 with e-value of 5.5e-75 and BLAST sequence identity of 54.6
  misc_feature 30675:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(290): Functional Homolog of  Ceres CLONE ID no. 6387 at SEQ ID NO. 297 with e-value of 8.50E-124 and BLAST sequence identity of 84.9
MNFKNVKVPNLPGGGAIGTLIKLGVIGGLGLYGAANSLYNVDGGHRAIMFNRIVGVKDKVYPEGTHFMVPWFERPVIYDVRARPHLVESTSGSRDLQMVKIGLRVLTRPVADQLPEIYRTLGENYNERVLPSIIHETLKAVVAQYNASQLITQREAVSREIRKILTERAVNFNIALDDVSITSLTFGKEFTAAIEAKQVAAQEAERAKFIVEKAEQDKKSAVIRAEGEATSAQLIGQAIANNPAFITLRKIEAAREIAHTISNSANKVFLDSGDLLLNLQKMELETTGKK

SEQ ID NO: 288 - DNA, 873 bp, Populus balsamifera subsp. trichocarpa
  misc_feature (1)..(873): Ceres ANNOT ID no. 1541620
  misc_feature 30807:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgaatttcaacaatgtgagagtacccaaggtgccaggtggtggtgccattgggactctgattaagataggagttcttggtgggcttggtttgtatggagctactaacagtctttacaatgttgatggtggacatcgagctataatgttcaaccgcatagctggtatcaaagagaaggtttatcctgaggggacacactttatgattccatggtttgagcgtcccatcatatatgatgttcgtgcacgaccccatctggtagagagtacttcaggaagtcgcgatctccaaatggtgaagattgggcttcgagttctgactcgtcctgtggcagaccagctccctgaaatttatcgaacccttggtgaaaattataatgacagagtcttgccttctatcattcatgaaacattgaaatctgtggttgctcagtataatgccagccagcttattactcagagagaggctgttagtcgagaaataaggaaggttttgacagcaagagcatccaattttcacattgcactggatgatgtgtccattacaagcctgacttttgggaaagaatttactgctgcaatcgaagctaaacaggtggctgctcaagatgctgagagagctaaatttattgtggaaaaagctgaacaagataagaagagtgctgttatcagagccgagggagaggccaccagtgctcagctcattggtcaagccattgccaacaatcctgcatttatcactctaaggaagattgaagctgcaagagaaattgcacatacaatctcaaattcagccaacaaagttttcctcgattccagtgatttgctactcaaccttcagaagatggagttggagaaccctaggaataaatag

SEQ ID NO: 289 - protein, 290 aa, Populus balsamifera subsp. trichocarpa
  misc_feature (1)..(290): Ceres ANNOT ID no. 1541620
  misc_feature (38)..(229): Pfam Name: Band_7 Pfam Description: SPFH domain / Band 7 family
  misc_feature: SWISSPROT Homolog: PHB2_RAT Prohibitin-2 (B-cell receptor-associated protein BAP37) (BAP-37) with e-value of 6.1e-76 and BLAST sequence identity of 52.5
  misc_feature: SWISSPROT Homolog: PHB2_HUMAN Prohibitin-2 (B-cell receptor-associated protein BAP37) (Repressor of estrogen receptor activity) (D-prohibitin) with e-value of 7.7e-76 and BLAST sequence identity of 52.5
  misc_feature: SWISSPROT Homolog: PHB2_MOUSE Prohibitin-2 (B-cell receptor-associated protein BAP37) (Repressor of estrogen receptor activity) with e-value of 7.7e-76 and BLAST sequence identity of 52.5
  misc_feature: SWISSPROT Homolog: PHB2_CAEEL Mitochondrial prohibitin complex protein 2 (Prohibitin-2) with e-value of 1.6e-75 and BLAST sequence identity of 52.1
  misc_feature: SWISSPROT Homolog: PHB2_YEAST Prohibitin-2 with e-value of 5.5e-75 and BLAST sequence identity of 54.6
  misc_feature 30949:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(290): Functional Homolog of  Ceres CLONE ID no. 6387 at SEQ ID NO. 297 with e-value of 9.70E-123 and BLAST sequence identity of 84.6
MNFNNVRVPKVPGGGAIGTLIKIGVLGGLGLYGATNSLYNVDGGHRAIMFNRIAGIKEKVYPEGTHFMIPWFERPIIYDVRARPHLVESTSGSRDLQMVKIGLRVLTRPVADQLPEIYRTLGENYNDRVLPSIIHETLKSVVAQYNASQLITQREAVSREIRKVLTARASNFHIALDDVSITSLTFGKEFTAAIEAKQVAAQDAERAKFIVEKAEQDKKSAVIRAEGEATSAQLIGQAIANNPAFITLRKIEAAREIAHTISNSANKVFLDSSDLLLNLQKMELENPRNK

SEQ ID NO: 290 - protein, 226 aa, Arabidopsis thaliana
  misc_feature (1)..(226): Ceres CLONE ID no. 6397
  misc_feature (1)..(226): Also Known As Ceres CDNA ID no. 23373703
  misc_feature (1)..(226): Also Known As Ceres GEMINI ID 531A4
  misc_feature (90)..(154): Pfam Name: AP2 Pfam Description: AP2 domain
  misc_feature 31101:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: FLOWER - Reduced fertility Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 291 - DNA, 681 bp, Populus balsamifera subsp. trichocarpa
  misc_feature (1)..(681): Ceres ANNOT ID no. 1486285
  misc_feature 31192:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: FLOWER - Reduced fertility Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
atgtttggagagaagagcttggaatcaggctttgatgttcttgaatgcaatattaatactgttgccagtaccagtaatgttaacgcaccaacattttacaagagcctcagctttagtaatatttattcaacagaaagctggggtgatttgccattaaaacaagatgattcagaggatatgatcgtttacaatgctctccgagatgctgttaacttcggatggcttccatcaatattgtcgttgcaatctaatatgaccacgacgacagaagagtttccacaaacagctgttccattggaagtggcaccgcgcgagtctggaccacaaccgctgaaggaaaagggattgcagtataagggtgtgagaaggaggccatggggaaaatatgcggcagagattagggatcctaagaagaatggagcgaggatgtggctcgggacttatgagacgcctgaggatgctgcactagcttacgatcgagctgcttttaaaatgcgtggctcgaaggctaagcttaatttccctcatctgatcggatccaacaataactgggaaccaactagggtgacttctaagaagcggagttcaccagagccttcatcttctatatctatttcagattatgactcaccacgttggacgaagcaaagcaagatcagttctgggatttgtttccactga

SEQ ID NO: 292 - protein, 226 aa, Populus balsamifera subsp. trichocarpa
  misc_feature (1)..(226): Ceres ANNOT ID no. 1486285
  misc_feature (116)..(180): Pfam Name: AP2 Pfam Description: AP2 domain
  misc_feature: SWISSPROT Homolog: ERF13_ARATH Ethylene-responsive transcription factor 13 EREBP-13 (AtERF13) with e-value of 5.0e-120 and BLAST sequence identity of 98.7
  misc_feature: SWISSPROT Homolog: ERF1_TOBAC Ethylene-responsive transcription factor 1 EREBP-1 (NtERF1) with e-value of 1.2e-47 and BLAST sequence identity of 53.9
  misc_feature: SWISSPROT Homolog: ERF2_NICSY Ethylene-responsive transcription factor 2 EREBP-2 (NsERF2) with e-value of 7.5e-46 and BLAST sequence identity of 55.7
  misc_feature: SWISSPROT Homolog: ERF2_TOBAC Ethylene-responsive transcription factor 2 EREBP-2 (NtERF2) with e-value of 1.1e-44 and BLAST sequence identity of 52.3
  misc_feature: SWISSPROT Homolog: ERF1_LYCES Ethylene-responsive transcription factor 1 EREBP-1 (ERF1-like protein) (LeERF1) with e-value of 2.1e-41 and BLAST sequence identity of 53.3
  misc_feature 31308:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: FLOWER - Reduced fertility Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(226): Functional Homolog of  Ceres CLONE ID no. 6397 at SEQ ID NO. 302 with e-value of 6.80E-51 and BLAST sequence identity of 58.6
MFGEKSLESGFDVLECNINTVASTSNVNAPTFYKSLSFSNIYSTESWGDLPLKQDDSEDMIVYNALRDAVNFGWLPSILSLQSNMTTTTEEFPQTAVPLEVAPRESGPQPLKEKGLQYKGVRRRPWGKYAAEIRDPKKNGARMWLGTYETPEDAALAYDRAAFKMRGSKAKLNFPHLIGSNNNWEPTRVTSKKRSSPEPSSSISISDYDSPRWTKQSKISSGICFH

SEQ ID NO: 293 - protein, 247 aa, Arabidopsis thaliana
  misc_feature (1)..(247): Ceres CLONE ID no. 6411
  misc_feature (6)..(95): Pfam Name: MtN3_slv Pfam Description: MtN3/saliva family
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
MNIAHTIFGVFGNATALFLFLAPSITFKRIIKNKSTEQFSGIPYPMTLLNCLLSAWYGLPFVSKDNTLVSTINGTGAVIETVYVLIFLFYAPKKEKIKIFGIFSCVLAVFATVALVSLFALQGNGRKLFCGLAATVFSIIMYASPLSIMRLVVKTKSVEFMPFFLSLFVFLCGTSWFVYGLIGRDPFVAIPNGFGCALGTLQLILYFIYCGNKGEKSADAQKDEKSVEMKDDEKKQNVVNGKQDLQV

SEQ ID NO: 294 - DNA, 747 bp, Populus balsamifera subsp. trichocarpa
  misc_feature (1)..(747): Ceres ANNOT ID no. 1505322
  misc_feature 31497:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
atggatgtcctgcatttcttgtttggagtttttggaaatgccactgctttgtttctcttcttggctccaacgataactttcaagaggatcataagaagcaaatccatagagcagttctctggcattccgtatgtgatgaccttgctcaactgcctcctttccgcttggtatggactgcctttcgtgtccaagaacaatgttttggtgtcaacaatcaatggagctggctcagcaattgaaaccatctatgtgttgatcttcatcatctatgcaccaaagaaagagaaggctaaagtccttggcctcctcactcttgtgatcaccatctttactggcgtggccttggtgtccctttttgctcttcatggcaacgccaggaagctattctgtggctgtgctgctgctgttttctctattatcatgtatggctccccactgtctatcatgaggacagtgattaaaactaagagcgtcgagtacatgccattcttcctgtcactgtttgtcttcttatgcggcacttcctggtttgtctatggtctacttggtagagaccctttcgttgccgtcccaaatggagttggctgtggtctaggggcattacagctgatattgtacttcatctaccgtaacaacaagggcgaggccaagaagcccatctctactcattcactagagattggtcccggaaaagtccaccaagagaagaaattggttgccaatggatcccatgatgaacgagtgtag

SEQ ID NO: 295 - protein, 248 aa, Populus balsamifera subsp. trichocarpa
  misc_feature (1)..(248): Ceres ANNOT ID no. 1505322
  misc_feature (128)..(214): Pfam Name: MtN3_slv Pfam Description: MtN3/saliva family
  misc_feature 31568:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
  misc_feature (1)..(248): Functional Homolog of  Ceres CLONE ID no. 6411 at SEQ ID NO. 305 with e-value of 5.79E-93 and BLAST sequence identity of 73.4
MDVLHFLFGVFGNATALFLFLAPTITFKRIIRSKSIEQFSGIPYVMTLLNCLLSAWYGLPFVSKNNVLVSTINGAGSAIETIYVLIFIIYAPKKEKAKVLGLLTLVITIFTGVALVSLFALHGNARKLFCGCAAAVFSIIMYGSPLSIMRTVIKTKSVEYMPFFLSLFVFLCGTSWFVYGLLGRDPFVAVPNGVGCGLGALQLILYFIYRNNKGEAKKPISTHSLEIGPGKVHQEKKLVANGSHDERV

SEQ ID NO: 296 - DNA, 753 bp, Populus balsamifera subsp. trichocarpa
  misc_feature (1)..(753): Ceres ANNOT ID no. 1496110
  misc_feature 31663:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
atggagatcgcgcatttcttatttggaatttttggaaatgccactgcattgtttctcttcttggctccaacgatcacgttcaggaggatcataagaagcaagtctacagagctgttttctggcattccatatgtaatgaccatgctcaactgcctcctttctgcttggtatggaatgccctttgtgtctaagaacaacattctggtgtcaacaatcaatggaactggtgcagtaattgaggcagtttatgtcttgaccttcatcatctatgcaccaaagaaggagaaggctaaattcattggcctcctcacgcttgtgctcaccacttttgctggcgtggccttggtgtcccttgtcgttcttcatggcaaacccagggagatattctgtggctttgctgctgctattttctcaatcatcatgtatggctcccctctgtctattatgaggacagtggttaaaacgaagagcgtggagtacatgccattcttcttgtctctttttgtcttcttatgtggcacttcctggtttgtctttgggctacttggtggtgacctttttgttgctgtcccgaatggagttggctgtggtcttggggcattgcagctgatcttgtacttcatctaccggaacaacaagggagaagacaagaagcccgccctccctgttaagtcaatgcagatgggtatcgcaaaactccaccaacagaaggagttggttgccaatggatcccatgttgctgataaggtgtaa

SEQ ID NO: 297 - protein, 250 aa, Populus balsamifera subsp. trichocarpa
  misc_feature (1)..(250): Ceres ANNOT ID no. 1496110
  misc_feature (128)..(214): Pfam Name: MtN3_slv Pfam Description: MtN3/saliva family
  misc_feature 31734:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
  misc_feature (1)..(250): Functional Homolog of  Ceres CLONE ID no. 6411 at SEQ ID NO. 305 with e-value of 5.59E-88 and BLAST sequence identity of 72.0
MEIAHFLFGIFGNATALFLFLAPTITFRRIIRSKSTELFSGIPYVMTMLNCLLSAWYGMPFVSKNNILVSTINGTGAVIEAVYVLTFIIYAPKKEKAKFIGLLTLVLTTFAGVALVSLVVLHGKPREIFCGFAAAIFSIIMYGSPLSIMRTVVKTKSVEYMPFFLSLFVFLCGTSWFVFGLLGGDLFVAVPNGVGCGLGALQLILYFIYRNNKGEDKKPALPVKSMQMGIAKLHQQKELVANGSHVADKV

SEQ ID NO: 298 - DNA, 789 bp, Populus balsamifera subsp. trichocarpa
  misc_feature (1)..(789): Ceres ANNOT ID no. 1496111
  misc_feature 31829:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
atggagatcgcgcatttcttatttggaatttttggaaatgccactgcattgtttctcttcttggctccaacgatcacgttcaggaggatcataagaagcaagtctacagagctgttttctggcattccatatgtaatgaccatgctcaactgcctcctttctgcttggtatggaatgccctttgtgtctaagaacaacattctggtgtcaacaatcaatggaactggtgcagtaattgaggcagtttatgtcttgaccttcatcatctatgcaccaaagaaggagaaggctaaattcattggcctcctcacgcttgtgctcaccacttttgctggcgtggccttggtgtcccttgtcgttcttcatggcaaacccagggagatattctgtggctttgctgctgctattttctcaatcatcatgtatggctcccctctgtctattatgaggacagtggttaaaacgaagagcgtggagtacatgccattcttcttgtctctttttgtcttcttatgtggcacttcctggtttgtctttgggctacttggtggtgacctttttgttgctgtcccgaatggagttggctgtggtcttggggcattgcagctgatcttgtacttcatctaccggaacaacaagggagaagacaagaagcccgccctccctgttaagtcaatgcagatgggtatcgcaaaactccaccaagagaaggagttggttgccaatggatcccatgttgctgataagaggtttttttttttagtgttttgttttgtatttaatttttga

SEQ ID NO: 299 - protein, 262 aa, Populus balsamifera subsp. trichocarpa
  misc_feature (1)..(262): Ceres ANNOT ID no. 1496111
  misc_feature (128)..(214): Pfam Name: MtN3_slv Pfam Description: MtN3/saliva family
  misc_feature 31902:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: SILIQUES - Short Useful for increasing seed/fruit yield or modifying fruit content
  misc_feature (1)..(262): Functional Homolog of  Ceres CLONE ID no. 6411 at SEQ ID NO. 305 with e-value of 5.59E-88 and BLAST sequence identity of 72.0
MEIAHFLFGIFGNATALFLFLAPTITFRRIIRSKSTELFSGIPYVMTMLNCLLSAWYGMPFVSKNNILVSTINGTGAVIEAVYVLTFIIYAPKKEKAKFIGLLTLVLTTFAGVALVSLVVLHGKPREIFCGFAAAIFSIIMYGSPLSIMRTVVKTKSVEYMPFFLSLFVFLCGTSWFVFGLLGGDLFVAVPNGVGCGLGALQLILYFIYRNNKGEDKKPALPVKSMQMGIAKLHQEKELVANGSHVADKRFFFLVFCFVFNF

SEQ ID NO: 300 - protein, 267 aa, Arabidopsis thaliana
  misc_feature (1)..(267): Ceres CLONE ID no. 6493
  misc_feature (1)..(267): Also Known As Ceres CDNA ID no. 23371818
  misc_feature (1)..(267): Also Known As Ceres GEMINI ID 531G3
  misc_feature (211)..(250): Pfam Name: AUX_IAA Pfam Description: AUX/IAA family
  misc_feature 32020:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MEGYSRNGEISPKLLDLMIPQERRNSFHDEKNSVFKTEEKKLELKLGPPGEEDDDESIIRHMKKEPKDKSILSLAGKHFSPSSTKTTSHKRTAPGPVVGWPPVRSFRKNLASGSSSKLGNDSTTSNGVTLKNQKCDDAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 301 - DNA, 1107 bp, Populus balsamifera subsp. trichocarpa
  misc_feature (1)..(1107): Ceres ANNOT ID no. 1446643
  misc_feature 32097:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaaggttgttcgaagaacgtcgaggcatgtcctcagttactggatttgattcccaaagaaagagagtggcttggtaagggagaagatgaaagatcctcctcggaagacagaaagcttgaactaaggcttggtccacctggtgaagactggtctctcaaaagcaccagcaatagagaaagacgagaaagacacaagtctcaacttctctcttttgggtatttcaccaatggaaaccaacaaactcacaagtttccttcttcggctgagaattcacatgtttggtttaataaaaaacaacagggaaaggttcctccttcgtatctcaattttccatcatcatccacaccaccaacagcaactgcaacccaacagagcctgcctgttatggacaaggaatcctcacagccctgttgcactaaagtggtagtagagttgccgcagtgtgcagaaaagaaggcattttcaacaccagctcctgccaatacagctgttcccaacagctctcagaaaagaattgcacctggtccagtagttggttggcctccaattcggtctttcaggaagaatcttgcaaccagcagcggcagcaattcaaaaccaacctttgagtctcaaaataaaccagctggaacttgcaagaaggggttatttgtcaagatcaatatggaaggtgtccccataggaaggaaagtggacctcaaagcctatgatagctatgaaaaactctcaactgctgttgatgaactctttagaggccttcttgcagctcaaagagattcctcttgtaatggaatcatgaacaagcaagagggagagaaagcaattatgggtgtattggacggaagtggggaatataagcttgtttatgaggataatgaaggagacaggatgcttgttggggatgtcccatggcacatgtttgtttccacagtgaagaggctgcgtgtattaaagagctctgaagtttctgcactgaaccgtgagtataaatttattatgcttaatcccatattggaagcagcaagcacgagaaggtgcccgtgtgaatcaagtgaacaaattgagatgagttttgctgtgaagattttccactcgtgtgactaa

SEQ ID NO: 302 - protein, 368 aa, Populus balsamifera subsp. trichocarpa
  misc_feature (1)..(368): Ceres ANNOT ID no. 1446643
  misc_feature (178)..(329): Pfam Name: AUX_IAA Pfam Description: AUX/IAA family
  misc_feature: SWISSPROT Homolog: IAA18_ARATH Auxin-responsive protein IAA18 (Indoleacetic acid-induced protein 18) with e-value of 3.3e-139 and BLAST sequence identity of 98.5
  misc_feature: SWISSPROT Homolog: IAA26_ARATH Auxin-responsive protein IAA26 with e-value of 6.6e-86 and BLAST sequence identity of 68.2
  misc_feature: SWISSPROT Homolog: IAA26_ARATH Indoleacetic acid-induced protein 26 Phytochrome-associated protein 1
  misc_feature: SWISSPROT Homolog: IAA6_ORYSA Auxin-responsive protein IAA6 (Indoleacetic acid-induced protein 6) with e-value of 5.8e-50 and BLAST sequence identity of 49.7
  misc_feature: SWISSPROT Homolog: IAA7_ORYSA Auxin-responsive protein IAA7 (Indoleacetic acid-induced protein 7) with e-value of 6.4e-47 and BLAST sequence identity of 55.2
  misc_feature: SWISSPROT Homolog: IAA2_ORYSA Auxin-responsive protein IAA2 (Indoleacetic acid-induced protein 2) with e-value of 2.1e-41 and BLAST sequence identity of 47.2
  misc_feature 32214:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(368): Functional Homolog of  Ceres CLONE ID no. 6493 at SEQ ID NO. 312 with e-value of 1.50E-58 and BLAST sequence identity of 66.25
MEGCSKNVEACPQLLDLIPKEREWLGKGEDERSSSEDRKLELRLGPPGEDWSLKSTSNRERRERHKSQLLSFGYFTNGNQQTHKFPSSAENSHVWFNKKQQGKVPPSYLNFPSSSTPPTATATQQSLPVMDKESSQPCCTKVVVELPQCAEKKAFSTPAPANTAVPNSSQKRIAPGPVVGWPPIRSFRKNLATSSGSNSKPTFESQNKPAGTCKKGLFVKINMEGVPIGRKVDLKAYDSYEKLSTAVDELFRGLLAAQRDSSCNGIMNKQEGEKAIMGVLDGSGEYKLVYEDNEGDRMLVGDVPWHMFVSTVKRLRVLKSSEVSALNREYKFIMLNPILEAASTRRCPCESSEQIEMSFAVKIFHSCD

SEQ ID NO: 303 - DNA, 912 bp, Populus balsamifera subsp. trichocarpa
  misc_feature (1)..(912): Ceres ANNOT ID no. 1492373
  misc_feature 32320:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaaggttgttcgaagaatgttgaggcatgtcctcggttgctggatttgattcccaaggaaagagaatggcttggtaagagagaagatgaaagatcttcctcagaggagaaaaagcttgaactaaggcttggtcctcctggtgaagactggtctctcaaaaacaccagtaatagagaaagacatgaatctcaacttaactcttttggttacttcaccaatggaaatcaacaaactcacaagtttccatcttccgctgagaattcacatgtctggttcaatcaacaacaacagggacagccctgctgcactaaagcggtggtagagttgcagcagtgtgccgaaaagaaggcattttcacctccggctcctgccaatacagctgtgcccaacagctctcagaaaagaactgctcctggtccagttgttggttggcctccaattcgttctttcaggaagaatcttgcaagcagtagcggcagctattcaaaaccaaccgttgagtctcaaaacaaaccagttgaaacttgcaagaaagggttatttgtcaagatcaatatggaaggtgtccccataggaaggaaagttgacctgaaagcctatgatacctacgaaaaactctccattgctgttgatgaactctttagaggccttcttgcagctcaaagagattcctcttccaatggaatcatggacaagcaagaggaagctaaggcaataacgggtgtattggacggaagtggagaatatacccttgtttatgaggataatgaaggagacatgatgcttgttggggatgtcccatggcacatgtttgtgtccacagtgaagaggctgcgtgtattgaagagctctgaagtttctgcgttgagccttggaagcatcaagcaagagaaggtggccgtgaattaa

SEQ ID NO: 304 - protein, 303 aa, Populus balsamifera subsp. trichocarpa
  misc_feature (1)..(303): Ceres ANNOT ID no. 1492373
  misc_feature (142)..(294): Pfam Name: AUX_IAA Pfam Description: AUX/IAA family
  misc_feature: SWISSPROT Homolog: IAA18_ARATH Auxin-responsive protein IAA18 (Indoleacetic acid-induced protein 18) with e-value of 3.3e-139 and BLAST sequence identity of 98.5
  misc_feature: SWISSPROT Homolog: IAA26_ARATH Auxin-responsive protein ;Indoleacetic acid-induced protein 26 (Phytochrome-associated protein 1) with e-value of 6.6e-86 and BLAST sequence identity of 68.2
  misc_feature: SWISSPROT Homolog: IAA6_ORYSA Auxin-responsive protein IAA6 (Indoleacetic acid-induced protein 6) with e-value of 5.8e-50 and BLAST sequence identity of 49.7
  misc_feature: SWISSPROT Homolog: IAA7_ORYSA Auxin-responsive protein IAA7 (Indoleacetic acid-induced protein 7) with e-value of 6.4e-47 and BLAST sequence identity of 55.2
  misc_feature: SWISSPROT Homolog: IAA2_ORYSA Auxin-responsive protein IAA2 (Indoleacetic acid-induced protein 2) with e-value of 2.1e-41 and BLAST sequence identity of 47.2
  misc_feature 32424:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(303): Functional Homolog of  Ceres CLONE ID no. 6493 at SEQ ID NO. 312 with e-value of 3.89E-55 and BLAST sequence identity of 63.8
MEGCSKNVEACPRLLDLIPKEREWLGKREDERSSSEEKKLELRLGPPGEDWSLKNTSNRERHESQLNSFGYFTNGNQQTHKFPSSAENSHVWFNQQQQGQPCCTKAVVELQQCAEKKAFSPPAPANTAVPNSSQKRTAPGPVVGWPPIRSFRKNLASSSGSYSKPTVESQNKPVETCKKGLFVKINMEGVPIGRKVDLKAYDTYEKLSIAVDELFRGLLAAQRDSSSNGIMDKQEEAKAITGVLDGSGEYTLVYEDNEGDMMLVGDVPWHMFVSTVKRLRVLKSSEVSALSLGSIKQEKVAVN

SEQ ID NO: 305 - protein, 311 aa, Arabidopsis thaliana
  misc_feature (1)..(311): Ceres CLONE ID no. 6630
  misc_feature (10)..(283): Pfam Name: Aldo_ket_red Pfam Description: Aldo/keto reductase family
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQEKFCRATEFAHETHGFYKTIEELWDGEI

SEQ ID NO: 306 - DNA, 957 bp, Populus balsamifera subsp. trichocarpa
  misc_feature (1)..(957): Ceres ANNOT ID no. 1529141
  misc_feature 32617:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
atggccaaagccattccattttttgagctcaacactggagctaaaatcccttcagttggtttgggcacagggggcgctgaccctggtgctgtcgctgatgctgtcactgctgccattaaggctggatatagacacattgactgcgctcgactttactgcaacgagaaagaggttggttgtgcattgaagaaattatttgacaatggggtagtaaagcgtggcgaagtgtggatcacttcaaaactctggtgtaatgatcatgcaccggaagatgtaccggagtcattagggaagactttgcaggacttgcagcttgactatgtagatctgtatctgattcattggcccgtcagcatgaagaagggttcagagggctataagcctgaaaaccttactcaaaccaacataccagcaacgtggagagccatggaggcactttacgattctggcaaggctcgtgctattggagttagtaatttctcatcaaagaagcttggggatttgctagccgcggctcgtgtacctccagctgttaaccaagtcgaatgtcaccccgtgtggcagcagccaaagcttcatgaattttgtcaatccaggggtgtccatttatctgggtattcaccgctaggttccccagatgcaggaacgatcaagacccaggttctcaagaattcaattcttaatacgattgctgagaaattaggcaaatctcctgcgcaagtagctcttaggtggggactacagatgggccacagtgtgcttcctaagagcacaaatgaggcaaggatcaaggaaaaccttgacatttttgactggtctattcctgaagatttgtttgccaagttatctggaattgaacaggagaggctggttaagggcactgtgtttgtgcacgagacttatggttcatacaagacactcgacgaactatgggatggtgaaacatcagatgcctga

SEQ ID NO: 307 - protein, 318 aa, Populus balsamifera subsp. trichocarpa
  misc_feature (1)..(318): Ceres ANNOT ID no. 1529141
  misc_feature (10)..(287): Pfam Name: Aldo_ket_red Pfam Description: Aldo/keto reductase family
  misc_feature: SWISSPROT Homolog: ALDR_HORVU Aldose reductase (EC 1.1.1.21) (AR) (Aldehyde reductase) with e-value of 1.0e-64 and BLAST sequence identity of 44.7
  misc_feature: SWISSPROT Homolog: AK1A1_RAT Alcohol dehydrogenase [NADP+] (EC 1.1.1.2) (Aldehyde reductase) (Aldo-keto reductase family 1 member A1) (3-DG-reducing enzyme) with e-value of 4.6e-62 and BLAST sequence identity of 46.6
  misc_feature: SWISSPROT Homolog: AK1A1_PIG Alcohol dehydrogenase [NADP+] (EC 1.1.1.2) (Aldehyde reductase) (Aldo-keto reductase family 1 member A1) with e-value of 2.5e-61 and BLAST sequence identity of 46.6
  misc_feature: SWISSPROT Homolog: NADO1_ORYSA Probable NAD(P)H-dependent oxidoreductase 1 (EC 1.1.1.-) with e-value of 3.3e-61 and BLAST sequence identity of 42.5
  misc_feature: SWISSPROT Homolog: AK1A1_MOUSE Alcohol dehydrogenase [NADP+] (EC 1.1.1.2) (Aldehyde reductase) (Aldo-keto reductase family 1 member A1) with e-value of 5.3e-61 and BLAST sequence identity of 45.9
  misc_feature 32734:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature (1)..(318): Functional Homolog of  Ceres CLONE ID no. 6630 at SEQ ID NO. 317 with e-value of 1.59E-115 and BLAST sequence identity of 70.3
MAKAIPFFELNTGAKIPSVGLGTGGADPGAVADAVTAAIKAGYRHIDCARLYCNEKEVGCALKKLFDNGVVKRGEVWITSKLWCNDHAPEDVPESLGKTLQDLQLDYVDLYLIHWPVSMKKGSEGYKPENLTQTNIPATWRAMEALYDSGKARAIGVSNFSSKKLGDLLAAARVPPAVNQVECHPVWQQPKLHEFCQSRGVHLSGYSPLGSPDAGTIKTQVLKNSILNTIAEKLGKSPAQVALRWGLQMGHSVLPKSTNEARIKENLDIFDWSIPEDLFAKLSGIEQERLVKGTVFVHETYGSYKTLDELWDGETSDA

SEQ ID NO: 308 - DNA, 996 bp, Populus balsamifera subsp. trichocarpa
  misc_feature (1)..(996): Ceres ANNOT ID no. 1475689
  misc_feature 32841:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
atggccaaagccattccattttttgagctcaacactggagctaaaatcccttcagttggtttgggcacagggggcgctgaccctggtgctgtcgctgatgctgtcactgctgccattaaggctggatatagacacattgactgcgctcgactttactgcaacgagaaagaggttggttgtgcattgaagaaattatttgacaatggggtagtaaagcgtggcgaagtgtggatcacttcaaaactctggtgtaatgatcatgcaccggaagatgtaccggagtcattagggaagactttgcaggacttgcagcttgactatgtagatctgtatctgattcattggcccgtcagcatgaagaagggttcagagggctataagcctgaaaaccttactcaaaccaacataccagcaacgtggagagccatggaggcactttacgattctggcaaggctcgtgctattggagttagtaatttctcatcaaagaagcttggggatttgctagccgcggctcgtgtacctccagctgttaaccaagtcgaatgtcaccccgtgtggcagcagccaaagcttcatgaattttgtcaatccaggggtgtccatttatctgggtattcaccgctaggttccccagatgcaggaacgatcaagacccaggttctcaagaattcaattcttaatacgattgctgagaaattaggcaaatctcctgcgcaagtagctcttaggtggggactacagatgggccacagtgtgcttcctaagagcacaaatgaggcaaggatcaaggaaaaccttgacatttttgactggtctattcctgaagatttgtttgccaagttatctggaattgaacaggcaagtcagtggttatttcttcctcaacgttttatgcctgagaggctggttaagggcactgtgtttgtgcacgagacttatggttcatacaagacactcgacgaactatgggatggtgaaacatcagatgcctga

SEQ ID NO: 309 - protein, 331 aa, Populus balsamifera subsp. trichocarpa
  misc_feature (1)..(331): Ceres ANNOT ID no. 1475689
  misc_feature (10)..(287): Pfam Name: Aldo_ket_red Pfam Description: Aldo/keto reductase family
  misc_feature: SWISSPROT Homolog: ALDR_HORVU Aldose reductase (EC 1.1.1.21) (AR) (Aldehyde reductase) with e-value of 1.0e-64 and BLAST sequence identity of 44.7
  misc_feature: SWISSPROT Homolog: AK1A1_RAT Alcohol dehydrogenase [NADP+] (EC 1.1.1.2) (Aldehyde reductase) (Aldo-keto reductase family 1 member A1) (3-DG-reducing enzyme) with e-value of 4.6e-62 and BLAST sequence identity of 46.6
  misc_feature: SWISSPROT Homolog: AK1A1_PIG Alcohol dehydrogenase [NADP+] (EC 1.1.1.2) (Aldehyde reductase) (Aldo-keto reductase family 1 member A1) with e-value of 2.5e-61 and BLAST sequence identity of 46.6
  misc_feature: SWISSPROT Homolog: NADO1_ORYSA Probable NAD(P)H-dependent oxidoreductase 1 (EC 1.1.1.-) with e-value of 3.3e-61 and BLAST sequence identity of 42.5
  misc_feature: SWISSPROT Homolog: AK1A1_MOUSE Alcohol dehydrogenase [NADP+] (EC 1.1.1.2) (Aldehyde reductase) (Aldo-keto reductase family 1 member A1) with e-value of 5.3e-61 and BLAST sequence identity of 45.9
  misc_feature 32960:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature (1)..(331): Functional Homolog of  Ceres CLONE ID no. 6630 at SEQ ID NO. 317 with e-value of 3.79E-112 and BLAST sequence identity of 70.6
MAKAIPFFELNTGAKIPSVGLGTGGADPGAVADAVTAAIKAGYRHIDCARLYCNEKEVGCALKKLFDNGVVKRGEVWITSKLWCNDHAPEDVPESLGKTLQDLQLDYVDLYLIHWPVSMKKGSEGYKPENLTQTNIPATWRAMEALYDSGKARAIGVSNFSSKKLGDLLAAARVPPAVNQVECHPVWQQPKLHEFCQSRGVHLSGYSPLGSPDAGTIKTQVLKNSILNTIAEKLGKSPAQVALRWGLQMGHSVLPKSTNEARIKENLDIFDWSIPEDLFAKLSGIEQASQWLFLPQRFMPERLVKGTVFVHETYGSYKTLDELWDGETSDA

SEQ ID NO: 310 - DNA, 960 bp, Populus balsamifera subsp. trichocarpa
  misc_feature (1)..(960): Ceres ANNOT ID no. 1476577
  misc_feature 33070:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
atggggaaatcaattcacagttttgagctgaagaatggagcaagaatcccttcagttgggttaggaacatggagggctgcccctggtgtgattggtgatgttgtcactactgctgttaaggtgggttatagacatattgactgtgcgctactttactgcaacgagatagaggatagttgtgcattgaagaagttattcgatgatggtgtagtgaagcgtgaagaattgtggatcacctccaaactctgttgcaatgaacaagcaccggaagatgtgtcaggggcattagatagaactttgcatgagttgcagcttgattatgtaaatctatatctaatccactggccagtaagcatgaagaaggattccgttggctatgaacctgaaaaccttacccaacctgacatactggcttcttggagagaaatggaggcactttatgaatctggcaaggctcgtgctattggagtcagcaacttctcatcaaagaagcttggagatcttctagcagcagcacgtgttcgtcctgctgtgaaccaagtggaatgtcaccctgtatggcagcagccaaagcttcatgcattttgtcaatccgagggagttcacttatctgggtatgcaccattaggttccgcaggttcacagaagatcaagattgaggttctcaagaatccaattcttaaaatgatagcagagaaattaggcaaatctccagcacaagtggctcttcggtggggactccaaatgggccacagtgtgctacctaaaagcataaacaaggcaagaatcatagaaaacattgacattttttactggtctattcctgaaggcttattttccaagctttcagaaattgagcaggcaagtgacagggagaggcttgttacaggaactactcttgtgcatgggacttatggtgcatacaggacattggatgaactctgggatggtgaaatgtga

SEQ ID NO: 311 - protein, 319 aa, Populus balsamifera subsp. trichocarpa
  misc_feature (1)..(319): Ceres ANNOT ID no. 1476577
  misc_feature (10)..(287): Pfam Name: Aldo_ket_red Pfam Description: Aldo/keto reductase family
  misc_feature: SWISSPROT Homolog: ALDR_HORVU Aldose reductase (EC 1.1.1.21) (AR) (Aldehyde reductase) with e-value of 1.0e-64 and BLAST sequence identity of 44.7
  misc_feature: SWISSPROT Homolog: AK1A1_RAT Alcohol dehydrogenase [NADP+] (EC 1.1.1.2) (Aldehyde reductase) (Aldo-keto reductase family 1 member A1) (3-DG-reducing enzyme) with e-value of 4.6e-62 and BLAST sequence identity of 46.6
  misc_feature: SWISSPROT Homolog: AK1A1_PIG Alcohol dehydrogenase [NADP+] (EC 1.1.1.2) (Aldehyde reductase) (Aldo-keto reductase family 1 member A1) with e-value of 2.5e-61 and BLAST sequence identity of 46.6
  misc_feature: SWISSPROT Homolog: NADO1_ORYSA Probable NAD(P)H-dependent oxidoreductase 1 (EC 1.1.1.-) with e-value of 3.3e-61 and BLAST sequence identity of 42.5
  misc_feature: SWISSPROT Homolog: AK1A1_MOUSE Alcohol dehydrogenase [NADP+] (EC 1.1.1.2) (Aldehyde reductase) (Aldo-keto reductase family 1 member A1) with e-value of 5.3e-61 and BLAST sequence identity of 45.9
  misc_feature 33189:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature (1)..(319): Functional Homolog of  Ceres CLONE ID no. 6630 at SEQ ID NO. 317 with e-value of 1.90E-101 and BLAST sequence identity of 62.0
MGKSIHSFELKNGARIPSVGLGTWRAAPGVIGDVVTTAVKVGYRHIDCALLYCNEIEDSCALKKLFDDGVVKREELWITSKLCCNEQAPEDVSGALDRTLHELQLDYVNLYLIHWPVSMKKDSVGYEPENLTQPDILASWREMEALYESGKARAIGVSNFSSKKLGDLLAAARVRPAVNQVECHPVWQQPKLHAFCQSEGVHLSGYAPLGSAGSQKIKIEVLKNPILKMIAEKLGKSPAQVALRWGLQMGHSVLPKSINKARIIENIDIFYWSIPEGLFSKLSEIEQASDRERLVTGTTLVHGTYGAYRTLDELWDGEM

SEQ ID NO: 312 - protein, 269 aa, Arabidopsis thaliana
  misc_feature (1)..(269): Ceres CLONE ID no. 6637
  misc_feature (7)..(132): Pfam Name: NAM Pfam Description: No apical meristem (NAM) protein
  misc_feature: Utility: ABA Useful for making plants with enhanced tolerance to drought
  misc_feature: Phenotype: WHOLE PLANT - ABA Useful for making plants with enhanced tolerance to drought
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 313 - DNA, 915 bp, Populus balsamifera subsp. trichocarpa
  misc_feature (1)..(915): Ceres ANNOT ID no. 1456291
  misc_feature: Utility: ABA Useful for making plants with enhanced tolerance to drought
  misc_feature 33387:<222: Transcription Factor
  misc_feature: Phenotype: WHOLE PLANT - ABA Useful for making plants with enhanced tolerance to drought
atgaaaggaaatagatcagcagatcagttggagttaccagctggatttagatttcatccaacagatgatgagttggtgaatcattacttgcttaagaaatgtggaggccaatcaatttctgctcctattattgctgagattgatctttataagtatgatccttggcagcttccagaaatggcactatatggtgaaaaggaatggtacttcttttctccaagggatagaaaatatccaaacggttcaaggccgaaccgggcggctggaaccgggtattggaaagcaaccggagcagataaacccattggtcggcccaaaccactaggcataaaaaaagctcttgtattttatgctggtaaagctcctaaaggaatcaaaaccaattggatcatgcatgaatatcgccttgctaatgttgacaggactgccggcaagaaaaataacctcaggcttgatgattgggtattatgtagaatatacaacaagaaaggaagcgtagagaagcattttcctgctgaaagaaaatcaatagcaaagtatccagagatggaagagcagaagcccaacatcagtgaaatgtctggctatcataatggaatgtcacaaattgcagcaccgacaatgatgatgagtaatagcaatgacttcttatatatggacacatctgattcaattccaaggttgaatacagactcaagtagttcagagcacgtgctgtcacctgaggtcacatgcgagaaggaggttcagagtcagccaaaatggaatgatcagctagataatgccttcgatttcaacttcaattacattgatgatggcttccaagattacccttttgcttcacaagatcagttccaattggaccagctctcacctttgcaggacatgttcatgtatttacagaagccattttga

SEQ ID NO: 314 - protein, 304 aa, Populus balsamifera subsp. trichocarpa
  misc_feature (1)..(304): Ceres ANNOT ID no. 1456291
  misc_feature (12)..(137): Pfam Name: NAM Pfam Description: No apical meristem (NAM) protein
  misc_feature: SWISSPROT Homolog: NAC48_ORYSA NAC domain-containing protein 48 (ONAC048) with e-value of 2.7e-80 and BLAST sequence identity of 82.7
  misc_feature: SWISSPROT Homolog: NAC2_ARATH NAC domain-containing protein 2 (ANAC002) with e-value of 3.4e-80 and BLAST sequence identity of 79.8
  misc_feature: SWISSPROT Homolog: NAC71_ORYSA NAC domain-containing protein 71 (ONAC071) with e-value of 3.1e-73 and BLAST sequence identity of 75.4
  misc_feature: SWISSPROT Homolog: NAC68_ORYSA NAC domain-containing protein 68 (ONAC068) with e-value of 5.5e-66 and BLAST sequence identity of 71.3
  misc_feature: SWISSPROT Homolog: NAC67_ORYSA NAC domain-containing protein 67 (ONAC067) with e-value of 3.6e-62 and BLAST sequence identity of 54.4
  misc_feature: Utility: ABA Useful for making plants with enhanced tolerance to drought
  misc_feature 33496:<222: Transcription Factor
  misc_feature: Phenotype: WHOLE PLANT - ABA Useful for making plants with enhanced tolerance to drought
  misc_feature (1)..(304): Functional Homolog of  Ceres CLONE ID no. 6637 at SEQ ID NO. 324 with e-value of 3.50E-79 and BLAST sequence identity of 71.2
MKGNRSADQLELPAGFRFHPTDDELVNHYLLKKCGGQSISAPIIAEIDLYKYDPWQLPEMALYGEKEWYFFSPRDRKYPNGSRPNRAAGTGYWKATGADKPIGRPKPLGIKKALVFYAGKAPKGIKTNWIMHEYRLANVDRTAGKKNNLRLDDWVLCRIYNKKGSVEKHFPAERKSIAKYPEMEEQKPNISEMSGYHNGMSQIAAPTMMMSNSNDFLYMDTSDSIPRLNTDSSSSEHVLSPEVTCEKEVQSQPKWNDQLDNAFDFNFNYIDDGFQDYPFASQDQFQLDQLSPLQDMFMYLQKPF

SEQ ID NO: 315 - DNA, 924 bp, Populus balsamifera subsp. trichocarpa
  misc_feature (1)..(924): Ceres ANNOT ID no. 1450794
  misc_feature: Utility: ABA Useful for making plants with enhanced tolerance to drought
  misc_feature 33595:<222: Transcription Factor
  misc_feature: Phenotype: WHOLE PLANT - ABA Useful for making plants with enhanced tolerance to drought
atgaaggtaaatggatcagcagcagcagatcagttggagttaccagctggatttagatttcatccaacagatgatgagttggtgaatcattacttgattaagaaatgtggaggccaatcaatttctgttcctattattgctgagattgatctttacaagtatgatccttggcagcttccagaaatggcactgtatggtgaaaaggaatggtacttcttttctccaagggatagaaaatatccaaacggttcaaggccgaaccgggcggctggaaccgggtattggaaagcaaccggagcagataaacccattggtcggcccaaaccacttggcataaaaaaagcccttgtattttacgccggcaaagctcccagaggaatcaaaaccaattggatcatgcacgaataccgccttgctaatgttgataggtctgctggcaagaaaaataacctaaggctagatgattgggtattgtgcagaatatacaacaagaaaggaagcatagagaagcattttcctgcagatagaaaatcaataacaaagtatgctgaaatggaagagcaaaagcccaacataaatgaaatgtctggttacaagaatggagggtcaacaatgggagcaccaacgatgatgatgagtaatagcaatgacttgttaaatatggacacgtccgattcaacaccaaggttgcatacagactcaagttgttcggagcaggtgctgtcacctgagctcacttgcgagagggaggttcagagccagccaaaatcatggaatgatcagctagatagtgcatttgatttcaacttcaattacattgatgatggcttccaagacgacccttttgcctcacaagttcagttccaaatggaccagctctcacctctgcaggacatgttcatgtatttacagaggccgctttga

SEQ ID NO: 316 - protein, 307 aa, Populus balsamifera subsp. trichocarpa
  misc_feature (1)..(307): Ceres ANNOT ID no. 1450794
  misc_feature (14)..(139): Pfam Name: NAM Pfam Description: No apical meristem (NAM) protein
  misc_feature: SWISSPROT Homolog: NAC48_ORYSA NAC domain-containing protein 48 (ONAC048) with e-value of 2.7e-80 and BLAST sequence identity of 82.7
  misc_feature: SWISSPROT Homolog: NAC2_ARATH NAC domain-containing protein 2 (ANAC002) with e-value of 3.4e-80 and BLAST sequence identity of 79.8
  misc_feature: SWISSPROT Homolog: NAC71_ORYSA NAC domain-containing protein 71 (ONAC071) with e-value of 3.1e-73 and BLAST sequence identity of 75.4
  misc_feature: SWISSPROT Homolog: NAC68_ORYSA NAC domain-containing protein 68 (ONAC068) with e-value of 5.5e-66 and BLAST sequence identity of 71.3
  misc_feature: SWISSPROT Homolog: NAC67_ORYSA NAC domain-containing protein 67 (ONAC067) with e-value of 3.6e-62 and BLAST sequence identity of 54.4
  misc_feature: Utility: ABA Useful for making plants with enhanced tolerance to drought
  misc_feature 33704:<222: Transcription Factor
  misc_feature: Phenotype: WHOLE PLANT - ABA Useful for making plants with enhanced tolerance to drought
  misc_feature (1)..(307): Functional Homolog of  Ceres CLONE ID no. 6637 at SEQ ID NO. 324 with e-value of 4.40E-79 and BLAST sequence identity of 70.9
MKVNGSAAADQLELPAGFRFHPTDDELVNHYLIKKCGGQSISVPIIAEIDLYKYDPWQLPEMALYGEKEWYFFSPRDRKYPNGSRPNRAAGTGYWKATGADKPIGRPKPLGIKKALVFYAGKAPRGIKTNWIMHEYRLANVDRSAGKKNNLRLDDWVLCRIYNKKGSIEKHFPADRKSITKYAEMEEQKPNINEMSGYKNGGSTMGAPTMMMSNSNDLLNMDTSDSTPRLHTDSSCSEQVLSPELTCEREVQSQPKSWNDQLDSAFDFNFNYIDDGFQDDPFASQVQFQMDQLSPLQDMFMYLQRPL

SEQ ID NO: 317 - protein, 150 aa, Arabidopsis thaliana
  misc_feature (1)..(150): Ceres CLONE ID no. 7191
  misc_feature (37)..(108): Pfam Name: RRM_1 Pfam Description: RNA recognition motif. (a.k.a. RRM RBD, or RNP domain)
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MAFCNKLGGLLRQNISSNGNVPVTSMLGSLRLMSTKLFIGGLSWGTDDASLRDAFAHFGDVVDAKVIVDKETGRSRGFGFVNFNDEGAATAAISEMDGKELNGRHIRVNPANDRPSAPRAYGGGGGYSGGGGGGYGGGGGSYGGGDGGGY

SEQ ID NO: 318 - DNA, 438 bp, Populus balsamifera subsp. trichocarpa
  misc_feature (1)..(438): Ceres ANNOT ID no. 1493787
  misc_feature 33863:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atggcattctttaacaagctcgggagcctagcgaggcagtcaatttcccagaaggggcaagttccaatggtgtccatgttgaacactattcgctgcatgtcgtcatccaagcttttcattggagggcttccatggtcagctgatgaccaaacccttaaagatgcattttctggctttggggaagtgacagaggcaagggttatcatggatagagagaccgggaggtctcgtggatttgggtttgttcattacgacagcgttgaaaatgccagcgaagcactttcagcaatggatggccagaatttgggaggaagaactgttcgagtgagctttgccgaggaaaggagaccaccacaatcctacaatgacaatcaccaagggagtccaccacaatcctacaatgacaatcaccaagggagtcgaggttttgataattaa

SEQ ID NO: 319 - protein, 145 aa, Populus balsamifera subsp. trichocarpa
  misc_feature (1)..(145): Ceres ANNOT ID no. 1493787
  misc_feature (38)..(109): Pfam Name: RRM_1 Pfam Description: RNA recognition motif. (a.k.a. RRM RBD, or RNP domain)
  misc_feature: SWISSPROT Homolog: GRP2_ARATH Glycine-rich RNA-binding protein 2, (AtGRP2) with e-value of 7.7e-76 and BLAST sequence identity of 97.3
  misc_feature: SWISSPROT Homolog: GRP7_ARATH Glycine-rich RNA-binding protein 7 with e-value of 1.2e-33 and BLAST sequence identity of 58.5
  misc_feature: SWISSPROT Homolog: GRP8_ARATH Glycine-rich RNA-binding protein 8 (CCR1 protein) with e-value of 3.9e-33 and BLAST sequence identity of 58.8
  misc_feature: SWISSPROT Homolog: GRP10_BRANA Glycine-rich RNA-binding protein 10 with e-value of 6.4e-33 and BLAST sequence identity of 58.8
  misc_feature: SWISSPROT Homolog: GRP1_SINAL Glycine-rich RNA-binding protein GRP1A with e-value of 8.2e-33 and BLAST sequence identity of 57.6
  misc_feature 33955:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(145): Functional Homolog of  Ceres CLONE ID no. 7191 at SEQ ID NO. 329 with e-value of 2.10E-31 and BLAST sequence identity of 56.6
MAFFNKLGSLARQSISQKGQVPMVSMLNTIRCMSSSKLFIGGLPWSADDQTLKDAFSGFGEVTEARVIMDRETGRSRGFGFVHYDSVENASEALSAMDGQNLGGRTVRVSFAEERRPPQSYNDNHQGSPPQSYNDNHQGSRGFDN

SEQ ID NO: 320 - protein, 196 aa, Arabidopsis thaliana
  misc_feature (1)..(196): Ceres CLONE ID no. 7201
  misc_feature (1)..(196): Also Known As Ceres CDNA ID no. 23383956
  misc_feature (1)..(196): Also Known As Ceres GEMINI ID 532G1
  misc_feature (150)..(190): Pfam Name: zf-C3HC4 Pfam Description: Zinc finger, C3HC4 type (RING finger)
  misc_feature 34045:<222: Transcription Factor
  misc_feature: Phenotype: Activates expression of the gene endogenous to the AtPES (SEQ ID NO 4142) regalutory region Useful for modulating Terpenoid Biosynthesis
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTRQNGKDKGNKLEQGKGKPLGDLPTEVVGLKKSRGRLMEWFKRRVREQQDCAICLDRFKKGETLVHLPCAHKFHSICLLPWLDTNVYCPYCRTDIWN

SEQ ID NO: 321 - DNA, 594 bp, Populus balsamifera subsp. trichocarpa
  misc_feature (1)..(594): Ceres ANNOT ID no. 1531932
  misc_feature 34109:<222: Transcription Factor
  misc_feature: Phenotype: Activates expression of the gene endogenous to the AtPES (SEQ ID NO 4142) regalutory region Useful for modulating Terpenoid Biosynthesis
atggctggtatgttgcctggtgttgaatgtgctcgaaggaggaggttccatcaaagcggagattcacttggtgccccagcacacggctggtccagaaagccatctttttgtttgtacacaagcagccatgaaagttatcatggctccgtctcttctctgcaaaagcaaaagcaaaggagcgtatcaagccaggcatacgaggatgagaagctgggaggagtggcaagagaagccaaggaaagattagatgagaggctaagattgcaaaagaagaagacagcagaaaccacaaggcacaaaagcacaggaaacctgagagatgtagatggcagatcaatggtactaggggagttacagatggaggtgtatggtacaaagaggagtgggtctaagaggttcaattgggccaaactgagctggaaagctgctgaccaagacgagtgcaccatctgcctcgatcggttcaagtctggtgagaccctggtgcaccttccctgtgcacacaggtaccaccccaggtgtttggtgccatggctagaaaacaatggccattgtccttgttgcaggatggaaatacgtgttgaactctcctag

SEQ ID NO: 322 - protein, 197 aa, Populus balsamifera subsp. trichocarpa
  misc_feature (1)..(197): Ceres ANNOT ID no. 1531932
  misc_feature (148)..(188): Pfam Name: zf-C3HC4 Pfam Description: Zinc finger, C3HC4 type (RING finger)
  misc_feature: SWISSPROT Homolog: ATL5M_ARATH RING-H2 finger protein ATL5M precursor with e-value of 9.3e-09 and BLAST sequence identity of 45.1
  misc_feature: SWISSPROT Homolog: ATL3D_ARATH Probable RING-H2 finger protein ATL3D with e-value of 3.1e-08 and BLAST sequence identity of 44.0
  misc_feature: SWISSPROT Homolog: RNF24_HUMAN RING finger protein 24 with e-value of 4.0e-08 and BLAST sequence identity of 38.6
  misc_feature: SWISSPROT Homolog: RNF24_MOUSE RING finger protein 24 with e-value of 5.1e-08 and BLAST sequence identity of 38.6
  misc_feature: SWISSPROT Homolog: RHA2A_ARATH RING-H2 zinc finger protein RHA2a with e-value of 1.1e-07 and BLAST sequence identity of 46.7
  misc_feature 34195:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(197): Functional Homolog of  Ceres CLONE ID no. 7201 at SEQ ID NO. 332 with e-value of 2.00E-44 and BLAST sequence identity of 54.9
MAGMLPGVECARRRRFHQSGDSLGAPAHGWSRKPSFCLYTSSHESYHGSVSSLQKQKQRSVSSQAYEDEKLGGVAREAKERLDERLRLQKKKTAETTRHKSTGNLRDVDGRSMVLGELQMEVYGTKRSGSKRFNWAKLSWKAADQDECTICLDRFKSGETLVHLPCAHRYHPRCLVPWLENNGHCPCCRMEIRVELS

SEQ ID NO: 323 - DNA, 759 bp, Populus balsamifera subsp. trichocarpa
  misc_feature (1)..(759): Ceres ANNOT ID no. 1454684
  misc_feature 34267:<222: Transcription Factor
  misc_feature: Phenotype: Activates expression of the gene endogenous to the AtPES (SEQ ID NO 4142) regalutory region Useful for modulating Terpenoid Biosynthesis
atggtcttaccaacggctcctagttgtgctgctagttgctttgccgaatcaaggcagcttggaaaaggcagacatactacaagtctgttttttctccgagggaaatttagttcttggggtggtttagcaatggccggtgtgttgcctggtgttgaatgtgctcgaaggaggaggttccatcgaagtggagattcactaggagccccagcacatggctggacaagaaggccatctttttgtttgtacacaagcagccatgaaaatcatcatggttcaatctcttccctgaattggattgagaagcaaaagcaaagaagcatattaaatcaggcatacgaggatgagaagctgggaggagtggcaaaagaagcaaaggaaagattagatgagaggctaagaatgcaaaagaagaaaccagaaatcacaaggaaaacaatggcttcagcacaattcatatggcacaaaagcacaggaaatctaagaggtgtggatggcagatcaatggtaccaggggaattgcaaatggaggtgtatggtccaaagaggagtgggtctaagagatacaagtgggccaaattgagctggaaagctgctgaccaagacgagtgcaccatctgccttgatcggttcaagtctggtgagaccttggtgcaccttccttgtgcacataggtaccaccccaagtgtttggtgccatggctagaaaacaatggccaatgcccttgttgcagaatggaaatacatgttgaactttcctag

SEQ ID NO: 324 - protein, 209 aa, Populus balsamifera subsp. trichocarpa
  misc_feature (1)..(209): Ceres ANNOT ID no. 1454684
  misc_feature (160)..(200): Pfam Name: zf-C3HC4 Pfam Description: Zinc finger, C3HC4 type (RING finger)
  misc_feature: SWISSPROT Homolog: ATL5M_ARATH RING-H2 finger protein ATL5M precursor with e-value of 9.3e-09 and BLAST sequence identity of 45.1
  misc_feature: SWISSPROT Homolog: ATL3D_ARATH Probable RING-H2 finger protein ATL3D with e-value of 3.1e-08 and BLAST sequence identity of 44.0
  misc_feature: SWISSPROT Homolog: RNF24_HUMAN RING finger protein 24 with e-value of 4.0e-08 and BLAST sequence identity of 38.6
  misc_feature: SWISSPROT Homolog: RNF24_MOUSE RING finger protein 24 with e-value of 5.1e-08 and BLAST sequence identity of 38.6
  misc_feature: SWISSPROT Homolog: RHA2A_ARATH RING-H2 zinc finger protein RHA2a with e-value of 1.1e-07 and BLAST sequence identity of 46.7
  misc_feature 34359:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(209): Functional Homolog of  Ceres CLONE ID no. 7201 at SEQ ID NO. 332 with e-value of 6.90E-42 and BLAST sequence identity of 56.0
MAGVLPGVECARRRRFHRSGDSLGAPAHGWTRRPSFCLYTSSHENHHGSISSLNWIEKQKQRSILNQAYEDEKLGGVAKEAKERLDERLRMQKKKPEITRKTMASAQFIWHKSTGNLRGVDGRSMVPGELQMEVYGPKRSGSKRYKWAKLSWKAADQDECTICLDRFKSGETLVHLPCAHRYHPKCLVPWLENNGQCPCCRMEIHVELS

SEQ ID NO: 325 - protein, 270 aa, Arabidopsis thaliana
  misc_feature (1)..(270): Ceres CLONE ID no. 7559
  misc_feature (1)..(270): Also Known As Ceres CDNA ID no. 23380615
  misc_feature (1)..(270): Also Known As Ceres GEMINI ID 531D4
  misc_feature (9)..(77): Pfam Name: RRM_1 Pfam Description: RNA recognition motif. (a.k.a. RRM RBD, or RNP domain)
  misc_feature 34455:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (255)..(255): Xaa is any aa, unknown, or other
  misc_feature (256)..(256): Xaa is any aa, unknown, or other
  misc_feature (257)..(257): Xaa is any aa, unknown, or other
MSSRWNRTIYVGNLPGDIRKCEVEDLFYKYGPIVDIDLKIPPRPPGYAFVEFEDPRDADDAIYGRDGYDFDGCRLRVEIAHGGRRFSPSVDRYSSSYSASRAPSRRSDYRVLVTGLPPSASWQDLKDHMRKAGDVCFSEVFPDRKGMSGVVDYSNYDDMKYAIRKLDATEFRNAFSSAYIRVREYESRSVSRSPDDSKSYRSRSRSRGPSCSYSSKSRSVSPARSISPRSRPLSRSRSPYSSVSRSQSRSKSRSXXXSRSNSPVSPVISG

SEQ ID NO: 326 - DNA, 1146 bp, Populus balsamifera subsp. trichocarpa
  misc_feature (1)..(1146): Ceres ANNOT ID no. 1469241
  misc_feature 34554:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atgagccgagcaagtcgaacactttacgtcggaaatcttcctggtgatattcgcctgagggaagttgaagatttgttttataagtatgggcccattgtcgacattgatttgaaaatcccgccaaggcctccaggctatgcttttgttgagtttgaagaagctcgtgatgctgaagatgcaattcgtggccgggatggatataattttgatgggtgtagattacgggttgagcttgcccatggtgggcgaagacattcatcaccagtggatcattatagcagttacagtggtagcagtggtagccgtgggccttccaagcgctctgactatcgtgtgttagtgactggattgccttcttctgcttcatggcaagacctaaaggatcatatgcgtcgagctggtgatgtctgcttttctcaagtctttcgtgatcgtggtggcatgacaggaattgtggactacacaaactatgatgacatgaaatatgctatcaagaagcttgatgactctgagttccggaatgcattttcaagggcatatattcgggtgagggagtatgattctagacggagttactctaggagccccagtctcagttcatatgtgtcaagaagccggagtcgaagtcgcagtggaggctatagtgacaggagctggagcaagtctcccagggcaaaacattcacggcgttctcgatctgtatctgtttcttctcgctctcgtgcaggatcatctccacgatctttttcaaggtccctttcaagatcaagatctcctcttgcttctcctcctcgcagaaaacatggccacagaaccccaagcataagccctggtcgtgtatcccgttcgccttctatcgttgatgagatcttgttcgcttggtcatggaacgtttccatgttcttggtgaacttgacgacacctataaagctagacatgactcatgtatacagttatatttggactattgaccatgagattattctcaacttatcaatctttagatcgagatttaacggcattcgcaagtgctttgtatcttttagactacaggatgtgcctgtggtacttattcccccggttttagatcacgatcacggacctgatgctgttgctgttgctgtagagcaggatgctaaacggtaa

SEQ ID NO: 327 - protein, 381 aa, Populus balsamifera subsp. trichocarpa
  misc_feature (1)..(381): Ceres ANNOT ID no. 1469241
  misc_feature (112)..(179): Pfam Name: RRM_1 Pfam Description: RNA recognition motif. (a.k.a. RRM RBD, or RNP domain)
  misc_feature: SWISSPROT Homolog: SFRS1_ARATH Pre-mRNA-splicing factor SF2 (SR1 protein) with e-value of 1.4e-85 and BLAST sequence identity of 64.0
  misc_feature: SWISSPROT Homolog: SFRS1_XENTR Splicing factor, arginine/serine-rich 1 with e-value of 8.4e-59 and BLAST sequence identity of 59.0
  misc_feature: SWISSPROT Homolog: SFRS1_BRARE Splicing factor, arginine/serine-rich 1 with e-value of 1.7e-57 and BLAST sequence identity of 58.1
  misc_feature: SWISSPROT Homolog: SFRS1_HUMAN Splicing factor, arginine/serine-rich 1 with e-value of 3.1e-56 and BLAST sequence identity of 56.8
  misc_feature: SWISSPROT Homolog: SFRS1_HUMAN pre-mRNA-splicing factor SF2, P33 subunit Alternative splicing factor ASF-1
  misc_feature: SWISSPROT Homolog: SFRS1_MOUSE Splicing factor, arginine/serine-rich 1 with e-value of 3.1e-56 and BLAST sequence identity of 56.8
  misc_feature 34678:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(381): Functional Homolog of  Ceres CLONE ID no. 7559 at SEQ ID NO. 337 with e-value of 1.20E-92 and BLAST sequence identity of 76.0
MSRASRTLYVGNLPGDIRLREVEDLFYKYGPIVDIDLKIPPRPPGYAFVEFEEARDAEDAIRGRDGYNFDGCRLRVELAHGGRRHSSPVDHYSSYSGSSGSRGPSKRSDYRVLVTGLPSSASWQDLKDHMRRAGDVCFSQVFRDRGGMTGIVDYTNYDDMKYAIKKLDDSEFRNAFSRAYIRVREYDSRRSYSRSPSLSSYVSRSRSRSRSGGYSDRSWSKSPRAKHSRRSRSVSVSSRSRAGSSPRSFSRSLSRSRSPLASPPRRKHGHRTPSISPGRVSRSPSIVDEILFAWSWNVSMFLVNLTTPIKLDMTHVYSYIWTIDHEIILNLSIFRSRFNGIRKCFVSFRLQDVPVVLIPPVLDHDHGPDAVAVAVEQDAKR

SEQ ID NO: 328 - protein, 169 aa, Arabidopsis thaliana
  misc_feature (1)..(169): Ceres CLONE ID no. 7713
  misc_feature: Utility: ABA Useful for making plants with enhanced tolerance to drought
  misc_feature: Phenotype: WHOLE PLANT - ABA Useful for making plants with enhanced tolerance to drought
MGNSLRCCLACVLPCGALDLIRIVHLNGYVEEITRSITAGEILQANPNHVLSKPCSQGVVRKILILSPESELKRGSIYFLIPDSSLPEKKRRRKDTPRRKKNLQNPSADAAGREIKGDEECVKLCEKYLEEVVSSASTGKEHRHRRRHSRSASVSTWRPLLDSISEDLN

SEQ ID NO: 329 - DNA, 471 bp, Populus balsamifera subsp. trichocarpa
  misc_feature (1)..(471): Ceres ANNOT ID no. 1470658
  misc_feature: Utility: ABA Useful for making plants with enhanced tolerance to drought
  misc_feature 34858:<222: Transcription Factor
  misc_feature: Phenotype: WHOLE PLANT - ABA Useful for making plants with enhanced tolerance to drought
atgggcaatagtttaaggtgttgtttggcttgtgttcttccttgtggtgccctagacttgatccgtatagttcatttgaatggctacgtggaagaaataacaggtccaatcacagctgctgaggtccttaaagcaaaccctaatcatgttcttagcaaaccttcttctcaaggtgttgtccgtaaaatcttgattctttcgccggaatccgagctcaaaagaggcagcatatatttcttgatcccatcttcttcattgcctggtgacaagaaaaaaagtggtaataattgtggccaccagatgaaatcctcgtcaaagaagagcaaaagatactgtaacaataaagatgcacgagattgtgatcgttacttaaccgatatagtctccgaaaagaaatcctctcgtcgtgatcgacggaccggtcgtgtcggagtatggcggcctcatttacaaagcatctccgaggactaa

SEQ ID NO: 330 - protein, 156 aa, Populus balsamifera subsp. trichocarpa
  misc_feature (1)..(156): Ceres ANNOT ID no. 1470658
  misc_feature: Utility: ABA Useful for making plants with enhanced tolerance to drought
  misc_feature 34905:<222: Transcription Factor
  misc_feature: Phenotype: WHOLE PLANT - ABA Useful for making plants with enhanced tolerance to drought
  misc_feature (1)..(156): Functional Homolog of  Ceres CLONE ID no. 7713 at SEQ ID NO. 340 with e-value of 6.49E-46 and BLAST sequence identity of 67.0
MGNSLRCCLACVLPCGALDLIRIVHLNGYVEEITGPITAAEVLKANPNHVLSKPSSQGVVRKILILSPESELKRGSIYFLIPSSSLPGDKKKSGNNCGHQMKSSSKKSKRYCNNKDARDCDRYLTDIVSEKKSSRRDRRTGRVGVWRPHLQSISED

SEQ ID NO: 331 - DNA, 501 bp, Populus balsamifera subsp. trichocarpa
  misc_feature (1)..(501): Ceres ANNOT ID no. 1480027
  misc_feature: Utility: ABA Useful for making plants with enhanced tolerance to drought
  misc_feature 34974:<222: Transcription Factor
  misc_feature: Phenotype: WHOLE PLANT - ABA Useful for making plants with enhanced tolerance to drought
atgggcaatagcttaaggtgttgtttggcttgtgttcttccttgtggagccctagacttgatccgtgtagttcatttgaatggccacgtagaagaaattacaggtccaatcacagctgctgaggtccttaaggcaaacccaaatcatgttctaagcaaaccttcttctcaaagtgttgttcgaaaaatcttgattctctccccggaatccgagctcaaaagaggcagcatatatttcttgattccatcttcttcattgcctggcgagaagaaaaaaggtggtaataattgtagccacaagagcaagtcttcatcaaagaaaagcaaaaaatattgcaacattaataaggatgtacaagattgtgatcgtcacctaaacgacttagtctcggaaaagaaaccctctcgtcgtgatcgccggaccagtcgtgtcagagtatggcggcctcatttacaaagcatctccgaggactatcaagttttgtccggttctgggatttga

SEQ ID NO: 332 - protein, 166 aa, Populus balsamifera subsp. trichocarpa
  misc_feature (1)..(166): Ceres ANNOT ID no. 1480027
  misc_feature: Utility: ABA Useful for making plants with enhanced tolerance to drought
  misc_feature 35023:<222: Transcription Factor
  misc_feature: Phenotype: WHOLE PLANT - ABA Useful for making plants with enhanced tolerance to drought
  misc_feature (1)..(166): Functional Homolog of  Ceres CLONE ID no. 7713 at SEQ ID NO. 340 with e-value of 7.49E-45 and BLAST sequence identity of 66.0
MGNSLRCCLACVLPCGALDLIRVVHLNGHVEEITGPITAAEVLKANPNHVLSKPSSQSVVRKILILSPESELKRGSIYFLIPSSSLPGEKKKGGNNCSHKSKSSSKKSKKYCNINKDVQDCDRHLNDLVSEKKPSRRDRRTSRVRVWRPHLQSISEDYQVLSGSGI

SEQ ID NO: 333 - protein, 141 aa, Arabidopsis thaliana
  misc_feature (1)..(141): Ceres CLONE ID no. 7805
  misc_feature (1)..(141): Also Known As Ceres CDNA ID no. 23366147
  misc_feature (1)..(141): Also Known As Ceres GEMINI ID 531D8
  misc_feature (24)..(89): Pfam Name: CBFD_NFYB_HMF Pfam Description: Histone-like transcription factor CBF/NF-Y) and archaeal histone
  misc_feature 35110:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 334 - DNA, 480 bp, Populus balsamifera subsp. trichocarpa
  misc_feature (1)..(480): Ceres ANNOT ID no. 1518351
  misc_feature 35184:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggcggataatccgacgagtccggcggcggggagccacgagagtggtggtgaacagagcccgcggtcaggggtgagagagcaggatagatacctgccaattgctaatataagtaggatcatgaagaaggcgttgccagctaatggaaaaattgccaaggatgctaaggatactgttcaggaatgtgtttctgagtttattagcttcgttaccagcgaggcgagtgataagtgtcagaaggagaagagaaagacaatcaacggggatgatttgttgtgggcaatggcaacattaggattcgaggactatattgatccacttaaggtgtacctggctaggtaccgggagggtgatgcaaagggatctgctagaggtggagatggatcttctaaaagggaagcagttggaggtctgcctgctcaaaatgcacagggacagggacagcatatgatccttccttccatgcaaggcaatgagtag

SEQ ID NO: 335 - protein, 159 aa, Populus balsamifera subsp. trichocarpa
  misc_feature (1)..(159): Ceres ANNOT ID no. 1518351
  misc_feature (30)..(95): Pfam Name: CBFD_NFYB_HMF Pfam Description: Histone-like transcription factor CBF/NF-Y) and archaeal histone
  misc_feature: SWISSPROT Homolog: NFYB1_ARATH Nuclear transcription factor Y subunit B-1 (AtNF-YB-1) (Transcriptional activator HAP3A) with e-value of 1.7e-73 and BLAST sequence identity of 100.0
  misc_feature: SWISSPROT Homolog: NFYB3_ORYSA Nuclear transcription factor Y subunit B-3 (OsNF-YB-3) (Transcriptional activator HAP3B) with e-value of 1.2e-53 and BLAST sequence identity of 77.2
  misc_feature: SWISSPROT Homolog: NFYB_MAIZE Nuclear transcription factor Y subunit B (NF-YB) (CAAT-box DNA-binding protein subunit B) with e-value of 3.8e-51 and BLAST sequence identity of 74.3
  misc_feature: SWISSPROT Homolog: NFYB8_ARATH Nuclear transcription factor Y subunit B-8 (AtNF-YB-8) with e-value of 7.3e-48 and BLAST sequence identity of 68.5
  misc_feature: SWISSPROT Homolog: NFYBA_ARATH Nuclear transcription factor Y subunit B-10 (AtNF-YB-10) with e-value of 7.3e-48 and BLAST sequence identity of 71.5
  misc_feature 35296:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(159): Functional Homolog of  Ceres CLONE ID no. 7805 at SEQ ID NO. 345 with e-value of 1.10E-52 and BLAST sequence identity of 81.3
MADNPTSPAAGSHESGGEQSPRSGVREQDRYLPIANISRIMKKALPANGKIAKDAKDTVQECVSEFISFVTSEASDKCQKEKRKTINGDDLLWAMATLGFEDYIDPLKVYLARYREGDAKGSARGGDGSSKREAVGGLPAQNAQGQGQHMILPSMQGNE

SEQ ID NO: 336 - DNA, 441 bp, Populus balsamifera subsp. trichocarpa
  misc_feature (1)..(441): Ceres ANNOT ID no. 1475331
  misc_feature 35381:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggcggcagaggcaccggcgagtccagggggaggaagccatgagagcggagaccaaagtcctcgctctaattctaatgtacgtgaacaagacaggttcttaccgatcgcaaatatcagtaggattatgaagaaagcgctacctgctaatggaaagattgctaaggatgctaaagagactgttcaagaatgtgtttctgagttcattagctttatcactagcgaagcaagtgataagtgtcagcgagaaaagaggaagacgataaatggtgatgatttgctttgggctatggctacgttagggtttgaggattatattgatcctcttaagatttacctgtctcgatacagagagatggagggtgataccaagggatctgcgaagactggagatacatctgctaaaaaggatattcaccctggtccaaatgcgcagtgctaa

SEQ ID NO: 337 - protein, 146 aa, Populus balsamifera subsp. trichocarpa
  misc_feature (1)..(146): Ceres ANNOT ID no. 1475331
  misc_feature (32)..(97): Pfam Name: CBFD_NFYB_HMF Pfam Description: Histone-like transcription factor CBF/NF-Y) and archaeal histone
  misc_feature: SWISSPROT Homolog: NFYB1_ARATH Nuclear transcription factor Y subunit B-1 (AtNF-YB-1) (Transcriptional activator HAP3A) with e-value of 1.7e-73 and BLAST sequence identity of 100.0
  misc_feature: SWISSPROT Homolog: NFYB3_ORYSA Nuclear transcription factor Y subunit B-3 (OsNF-YB-3) (Transcriptional activator HAP3B) with e-value of 1.2e-53 and BLAST sequence identity of 77.2
  misc_feature: SWISSPROT Homolog: NFYB_MAIZE Nuclear transcription factor Y subunit B (NF-YB) (CAAT-box DNA-binding protein subunit B) with e-value of 3.8e-51 and BLAST sequence identity of 74.3
  misc_feature: SWISSPROT Homolog: NFYB8_ARATH Nuclear transcription factor Y subunit B-8 (AtNF-YB-8) with e-value of 7.3e-48 and BLAST sequence identity of 68.5
  misc_feature: SWISSPROT Homolog: NFYBA_ARATH Nuclear transcription factor Y subunit B-10 (AtNF-YB-10) with e-value of 7.3e-48 and BLAST sequence identity of 71.5
  misc_feature 35491:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(146): Functional Homolog of  Ceres CLONE ID no. 7805 at SEQ ID NO. 345 with e-value of 2.89E-50 and BLAST sequence identity of 76.2
MAAEAPASPGGGSHESGDQSPRSNSNVREQDRFLPIANISRIMKKALPANGKIAKDAKETVQECVSEFISFITSEASDKCQREKRKTINGDDLLWAMATLGFEDYIDPLKIYLSRYREMEGDTKGSAKTGDTSAKKDIHPGPNAQC

SEQ ID NO: 338 - protein, 130 aa, Arabidopsis thaliana
  misc_feature (1)..(130): Ceres CLONE ID no. 7822
  misc_feature (5)..(130): Pfam Name: Ribosomal_S8 Pfam Description: Ribosomal protein S8
  misc_feature: Utility: Cold Growth Useful for making plants with increased tolerance to cold stress
  misc_feature: Phenotype: WHOLE PLANT - Cold Growth Useful for making plants with increased tolerance to cold stress
MVRISVLNDGLKSMYNAEKRGKRQVMIRPSSKVIIKFLIVMQKHGYIGEFEYVDDHRSGKIVVELNGRLNKCGVISPRFDVGVKEIEGWTARLLPSRQFGFIVLTTSAGIMDHEEARRKNVGGKVLGFFY

SEQ ID NO: 339 - DNA, 393 bp, Populus balsamifera subsp. trichocarpa
  misc_feature (1)..(393): Ceres ANNOT ID no. 1464929
  misc_feature: Utility: Cold Growth Useful for making plants with increased tolerance to cold stress
  misc_feature 35643:<222: Transcription Factor
  misc_feature: Phenotype: WHOLE PLANT - Cold Growth Useful for making plants with increased tolerance to cold stress
atggtgcgagttagtgttttgaatgatgctctgaagagcatgtacaatgcagagaaacgtgggaagcggcaagtcatgatcaggccttcctcaaaggtgatcatcaaatttctgttggtgatgcaaaagcatggttatattggtgagtttgagttcgttgatgatcacagggctggtaaaatcgttgtcgaactaaatggaaggttgaacaaatgtggggttatcagtcctcgttttgatgttggtgttaaggagattgaaacctggactgcaaggttgctcccctcaagacagtttggatacatcgtgctcacaacttctgctggtattatggaccatgaggaagctagaaggaagaatgttggtgggaaagtgcttggtttcttctactaa

SEQ ID NO: 340 - protein, 130 aa, Populus balsamifera subsp. trichocarpa
  misc_feature (1)..(130): Ceres ANNOT ID no. 1464929
  misc_feature (5)..(130): Pfam Name: Ribosomal_S8 Pfam Description: Ribosomal protein S8
  misc_feature: SWISSPROT Homolog: RS15A_ARATH 40S ribosomal protein S15a with e-value of 2.2e-64 and BLAST sequence identity of 98.4
  misc_feature: SWISSPROT Homolog: RS15A_BRANA 40S ribosomal protein S15a (PPCB8) with e-value of 5.7e-64 and BLAST sequence identity of 97.7
  misc_feature: SWISSPROT Homolog: RS15A_DAUCA 40S ribosomal protein S15a with e-value of 1.4e-62 and BLAST sequence identity of 94.6
  misc_feature: SWISSPROT Homolog: RS22_NEUCR 40S ribosomal protein S22 with e-value of 8.8e-52 and BLAST sequence identity of 76.9
  misc_feature: SWISSPROT Homolog: RS22A_YEAST 40S ribosomal protein S22-A (S24) (YS22) (RP50) (YP58) with e-value of 1.1e-51 and BLAST sequence identity of 78.9
  misc_feature: Utility: Cold Growth Useful for making plants with increased tolerance to cold stress
  misc_feature 35731:<222: Transcription Factor
  misc_feature: Phenotype: WHOLE PLANT - Cold Growth Useful for making plants with increased tolerance to cold stress
  misc_feature (1)..(130): Functional Homolog of  Ceres CLONE ID no. 7822 at SEQ ID NO. 350 with e-value of 4.39E-63 and BLAST sequence identity of 94.6
MVRVSVLNDALKSMYNAEKRGKRQVMIRPSSKVIIKFLLVMQKHGYIGEFEFVDDHRAGKIVVELNGRLNKCGVISPRFDVGVKEIETWTARLLPSRQFGYIVLTTSAGIMDHEEARRKNVGGKVLGFFY

SEQ ID NO: 341 - DNA, 393 bp, Populus balsamifera subsp. trichocarpa
  misc_feature (1)..(393): Ceres ANNOT ID no. 1500283
  misc_feature: Utility: Cold Growth Useful for making plants with increased tolerance to cold stress
  misc_feature 35797:<222: Transcription Factor
  misc_feature: Phenotype: WHOLE PLANT - Cold Growth Useful for making plants with increased tolerance to cold stress
atggtgcgagttagtgttttgaatgatgctctgaagagcatgtacaatgctgagaaacgtgggaagcgtcaggtcatgatcaggccctcctcaaaggtgatcatcaaatttctgttggtgatgcaaaagcatggatacattggtgaatttgagtttgtggatgatcacagggctggtaaaattgtggttgaattgaatggaagattgaacaaatgtggagtaattagtcctcgttttgatgtgggtgtcaaggagattgaaacttggactgcaaggttgctcccttcaagacagtttggatatattgtcttgacaacttctgcgggcattatggaccatgaggaggccagaagaaagaatgttggtggcaaagtgcttggtttcttttactag

SEQ ID NO: 342 - protein, 130 aa, Populus balsamifera subsp. trichocarpa; identical to SEQ ID NO: 340
  misc_feature (1)..(130): Ceres ANNOT ID no. 1500283
  misc_feature (5)..(130): Pfam Name: Ribosomal_S8 Pfam Description: Ribosomal protein S8
  misc_feature: SWISSPROT Homolog: RS15A_ARATH 40S ribosomal protein S15a with e-value of 2.2e-64 and BLAST sequence identity of 98.4
  misc_feature: SWISSPROT Homolog: RS15A_BRANA 40S ribosomal protein S15a (PPCB8) with e-value of 5.7e-64 and BLAST sequence identity of 97.7
  misc_feature: SWISSPROT Homolog: RS15A_DAUCA 40S ribosomal protein S15a with e-value of 1.4e-62 and BLAST sequence identity of 94.6
  misc_feature: SWISSPROT Homolog: RS22_NEUCR 40S ribosomal protein S22 with e-value of 8.8e-52 and BLAST sequence identity of 76.9
  misc_feature: SWISSPROT Homolog: RS22A_YEAST 40S ribosomal protein S22-A (S24) (YS22) (RP50) (YP58) with e-value of 1.1e-51 and BLAST sequence identity of 78.9
  misc_feature: Utility: Cold Growth Useful for making plants with increased tolerance to cold stress
  misc_feature 35885:<222: Transcription Factor
  misc_feature: Phenotype: WHOLE PLANT - Cold Growth Useful for making plants with increased tolerance to cold stress
  misc_feature (1)..(130): Functional Homolog of  Ceres CLONE ID no. 7822 at SEQ ID NO. 350 with e-value of 4.39E-63 and BLAST sequence identity of 94.6

SEQ ID NO: 343 - DNA, 393 bp, Populus balsamifera subsp. trichocarpa
  misc_feature (1)..(393): Ceres ANNOT ID no. 1511303
  misc_feature: Utility: Cold Growth Useful for making plants with increased tolerance to cold stress
  misc_feature 35951:<222: Transcription Factor
  misc_feature: Phenotype: WHOLE PLANT - Cold Growth Useful for making plants with increased tolerance to cold stress
atggtgcgagttagtgttttgaatgatgctctgaagagcatgtacaatgcagagaaacgtgggaagcgccaagttatgatcaggccatcctcaaaagtaatcatcaagtttctgatggtgatgcagaagcacggttacattggtgagttcgagtttgttgatgatcacaggtctggtaaaattgtggttgaactaaatggaaggttgaacaaatgtggggttatcagtcctcgttttgatgttggtgttaaggagatggaaacctggactgctaggttgctcccctcaagacagtttggatatatcgtactcacaacttctgctggcattatggaccatgaggaggctagaaggaagaatgttggtggcaaagtgcttggtttcttctactaa

SEQ ID NO: 344 - protein, 130 aa, Populus balsamifera subsp. trichocarpa
  misc_feature (1)..(130): Ceres ANNOT ID no. 1511303
  misc_feature (5)..(130): Pfam Name: Ribosomal_S8 Pfam Description: Ribosomal protein S8
  misc_feature: SWISSPROT Homolog: RS15A_ARATH 40S ribosomal protein S15a with e-value of 2.2e-64 and BLAST sequence identity of 98.4
  misc_feature: SWISSPROT Homolog: RS15A_BRANA 40S ribosomal protein S15a (PPCB8) with e-value of 5.7e-64 and BLAST sequence identity of 97.7
  misc_feature: SWISSPROT Homolog: RS15A_DAUCA 40S ribosomal protein S15a with e-value of 1.4e-62 and BLAST sequence identity of 94.6
  misc_feature: SWISSPROT Homolog: RS22_NEUCR 40S ribosomal protein S22 with e-value of 8.8e-52 and BLAST sequence identity of 76.9
  misc_feature: SWISSPROT Homolog: RS22A_YEAST 40S ribosomal protein S22-A (S24) (YS22) (RP50) (YP58) with e-value of 1.1e-51 and BLAST sequence identity of 78.9
  misc_feature: Utility: Cold Growth Useful for making plants with increased tolerance to cold stress
  misc_feature 36039:<222: Transcription Factor
  misc_feature: Phenotype: WHOLE PLANT - Cold Growth Useful for making plants with increased tolerance to cold stress
  misc_feature (1)..(130): Functional Homolog of  Ceres CLONE ID no. 7822 at SEQ ID NO. 350 with e-value of 5.70E-63 and BLAST sequence identity of 94.6
MVRVSVLNDALKSMYNAEKRGKRQVMIRPSSKVIIKFLMVMQKHGYIGEFEFVDDHRSGKIVVELNGRLNKCGVISPRFDVGVKEMETWTARLLPSRQFGYIVLTTSAGIMDHEEARRKNVGGKVLGFFY

SEQ ID NO: 345 - protein, 218 aa, Arabidopsis thaliana
  misc_feature (1)..(218): Ceres CLONE ID no. 8068
  misc_feature (56)..(210): Pfam Name: Pyrophosphatase Pfam Description: Inorganic pyrophosphatase
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
MAEIKDEGSAKAYAFPLRNPNVTLNERNFAAFTHRSSAAHPWHDLEIGPEAPTVFNCVVEISKGGKVKYELDKNSGLIKVDRVLYSSIVYPHNYGFIPRTICEDSDPMDVLVLMQEPVLTGSFLRARAIGLMPMIDQGEKDDKIIAVCADDPEFRHYRDIKELPPHRLAEIRRFFEDYKKNENKKVDVEAFLPAQAAIDAIKDSMDLYAAYIKAGLQR

SEQ ID NO: 346 - DNA, 621 bp, Populus balsamifera subsp. trichocarpa
  misc_feature (1)..(621): Ceres ANNOT ID no. 1510462
  misc_feature 36177:<222: Transcription Factor
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
atggctaacaacgatggggaagtgaccgggaaacgtgcaggatggcctcctgttctcaatgaaaggattctttcttcaatgtcccggagatctattgctgcgcatccctggcatgacttggagattggacctggtgctccaagtgttttcaattgtgtgattgagatcagcaagggcagcaaggttaagtatgagcttgacaaggcaagtggccttataaaggttgatcgtgttctctactcatcagttgtttacccacacaactatggtttcatcccacgaactctctgtgaggacagtgatcctatggatgttctggtactgatgcaggagcctgtgctacccggttctttccttcgtgctcgtgcaattggtttaatgccaatgattgatcagggtgaaaaggatgacaaaatcattgcagtgtgtgctgatgaccctgagttcgtccattacaaggacatcaaggaacttcctccgcatcgcctggctgaaattcgccgctttttcgaggactgtatccatattcatacaaataagaagaatgagaacaagaaagttgatgttgaagacttcttgccagctgcctctgcaattgatgccatcaagtattccatgtga

SEQ ID NO: 347 - protein, 206 aa, Populus balsamifera subsp. trichocarpa
  misc_feature (1)..(206): Ceres ANNOT ID no. 1510462
  misc_feature (51)..(207): Pfam Name: Pyrophosphatase Pfam Description: Inorganic pyrophosphatase
  misc_feature: SWISSPROT Homolog: IPYR_ARATH Soluble inorganic pyrophosphatase (EC 3.6.1.1) (Pyrophosphate phospho-hydrolase) (PPase) with e-value of 2.9e-115 and BLAST sequence identity of 99.1
  misc_feature: SWISSPROT Homolog: IPYR_MAIZE Soluble inorganic pyrophosphatase (EC 3.6.1.1) (Pyrophosphate phospho-hydrolase) (PPase) with e-value of 1.3e-82 and BLAST sequence identity of 73.9
  misc_feature: SWISSPROT Homolog: IPYR_SOLTU Soluble inorganic pyrophosphatase (EC 3.6.1.1) (Pyrophosphate phospho-hydrolase) (PPase) with e-value of 2.1e-82 and BLAST sequence identity of 79.0
  misc_feature: SWISSPROT Homolog: IPYR_HORVD Soluble inorganic pyrophosphatase (EC 3.6.1.1) (Pyrophosphate phospho-hydrolase) (PPase) with e-value of 3.7e-76 and BLAST sequence identity of 71.0
  misc_feature: SWISSPROT Homolog: IPYR_ORYSA Soluble inorganic pyrophosphatase (EC 3.6.1.1) (Pyrophosphate phospho-hydrolase) (PPase) with e-value of 5.0e-65 and BLAST sequence identity of 66.2
  misc_feature 36277:<222: Transcription Factor
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
  misc_feature (1)..(206): Functional Homolog of  Ceres CLONE ID no. 8068 at SEQ ID NO. 367 with e-value of 1.59E-81 and BLAST sequence identity of 87.3
MANNDGEVTGKRAGWPPVLNERILSSMSRRSIAAHPWHDLEIGPGAPSVFNCVIEISKGSKVKYELDKASGLIKVDRVLYSSVVYPHNYGFIPRTLCEDSDPMDVLVLMQEPVLPGSFLRARAIGLMPMIDQGEKDDKIIAVCADDPEFVHYKDIKELPPHRLAEIRRFFEDCIHIHTNKKNENKKVDVEDFLPAASAIDAIKYSM

SEQ ID NO: 348 - DNA, 651 bp, Populus balsamifera subsp. trichocarpa
  misc_feature (1)..(651): Ceres ANNOT ID no. 1471422
  misc_feature 36356:<222: Transcription Factor
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
atgagtgatgaaacgaaaacacaagaaaatgaagttgttgaagctaagcgccaagcaccccgtctgaacgagagaatcctttcatccttgtcaaggagaactgttgctgcacatccttggcatgatcttgaaattgggcctggagctccccacattttcaatgttgtggttgagataacaaaaggaagtaaggtcaaatacgaactggacaagaagacaggactaatcaaggtcgatcggattttatattcctcggtggtctatccccacaactatggtttcatccctcgcacattatgcgaagacaatgatcccttggatgttttggtactcatgcaggagcctgtccttcctggctgttttctgcgagccagggctattggacttatgcccatgattgaccagggagagaaagacgacaagattattgcggtttgtgctgatgatccagagtacaagcactacactgacatcagggagctggcccctcatcgtctttctgagatccgccgtttctttgaagattacaagaaaaatgagaacaaggaggttgcagttaatgactttttaccttcaaattctgctgttgaagctatccagtactcaatggacctttatgctgagtacattctgcacacgctgcggcggtag

SEQ ID NO: 349 - protein, 216 aa, Populus balsamifera subsp. trichocarpa
  misc_feature (1)..(216): Ceres ANNOT ID no. 1471422
  misc_feature (54)..(208): Pfam Name: Pyrophosphatase Pfam Description: Inorganic pyrophosphatase
  misc_feature: SWISSPROT Homolog: IPYR_ARATH Soluble inorganic pyrophosphatase (EC 3.6.1.1) (Pyrophosphate phospho-hydrolase) (PPase) with e-value of 2.9e-115 and BLAST sequence identity of 99.1
  misc_feature: SWISSPROT Homolog: IPYR_MAIZE Soluble inorganic pyrophosphatase (EC 3.6.1.1) (Pyrophosphate phospho-hydrolase) (PPase) with e-value of 1.3e-82 and BLAST sequence identity of 73.9
  misc_feature: SWISSPROT Homolog: IPYR_SOLTU Soluble inorganic pyrophosphatase (EC 3.6.1.1) (Pyrophosphate phospho-hydrolase) (PPase) with e-value of 2.1e-82 and BLAST sequence identity of 79.0
  misc_feature: SWISSPROT Homolog: IPYR_HORVD Soluble inorganic pyrophosphatase (EC 3.6.1.1) (Pyrophosphate phospho-hydrolase) (PPase) with e-value of 3.7e-76 and BLAST sequence identity of 71.0
  misc_feature: SWISSPROT Homolog: IPYR_ORYSA Soluble inorganic pyrophosphatase (EC 3.6.1.1) (Pyrophosphate phospho-hydrolase) (PPase) with e-value of 5.0e-65 and BLAST sequence identity of 66.2
  misc_feature 36456:<222: Transcription Factor
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
  misc_feature (1)..(216): Functional Homolog of  Ceres CLONE ID no. 8068 at SEQ ID NO. 367 with e-value of 2.99E-80 and BLAST sequence identity of 76.4
MSDETKTQENEVVEAKRQAPRLNERILSSLSRRTVAAHPWHDLEIGPGAPHIFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIRELAPHRLSEIRRFFEDYKKNENKEVAVNDFLPSNSAVEAIQYSMDLYAEYILHTLRR

SEQ ID NO: 350 - DNA, 639 bp, Populus balsamifera subsp. trichocarpa
  misc_feature (1)..(639): Ceres ANNOT ID no. 1497509
  misc_feature 36538:<222: Transcription Factor
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
atgagtgacgtaacaaaaacacaagaaaatgaagttgaaactaagcaccaagcgccccgtctgaatgagagaatcctttcatctttgtcaaggagaactgttgctgcacatccttggcatgatcttgaaattggtattttgcagaagatgatcgtggttgagataacaaaaggaagtaaggtcaaatatgaactggacaagaagacaggactaatcaaggttgatcggattttatactcctcagtggtctatccccacaactatggtttcatccctcgcacattatgcgaagacaatgatcccttggatgttttagtactcatgcaggagcctgtccttcccggttgttttctacgagccagggccattggacttatgcccatgattgaccagggagagaaagacgacaaaattattgcagtttgtgctgatgatcctgagtacaagcactacactgacatcaaggagctggccccccatcgtctttctgagatccgacgtttctttgaagactacaagaaaaatgagaacaaggaggttgcagttaatgacttcttaccttcaaatactgctgttgaagctatccagtactcaatggacctttatgctgagtacgttttgcacaccctgcgtcggtag

SEQ ID NO: 351 - protein, 212 aa, Populus balsamifera subsp. trichocarpa
  misc_feature (1)..(212): Ceres ANNOT ID no. 1497509
  misc_feature (51)..(204): Pfam Name: Pyrophosphatase Pfam Description: Inorganic pyrophosphatase
  misc_feature: SWISSPROT Homolog: IPYR_ARATH Soluble inorganic pyrophosphatase (EC 3.6.1.1) (Pyrophosphate phospho-hydrolase) (PPase) with e-value of 2.9e-115 and BLAST sequence identity of 99.1
  misc_feature: SWISSPROT Homolog: IPYR_MAIZE Soluble inorganic pyrophosphatase (EC 3.6.1.1) (Pyrophosphate phospho-hydrolase) (PPase) with e-value of 1.3e-82 and BLAST sequence identity of 73.9
  misc_feature: SWISSPROT Homolog: IPYR_SOLTU Soluble inorganic pyrophosphatase (EC 3.6.1.1) (Pyrophosphate phospho-hydrolase) (PPase) with e-value of 2.1e-82 and BLAST sequence identity of 79.0
  misc_feature: SWISSPROT Homolog: IPYR_HORVD Soluble inorganic pyrophosphatase (EC 3.6.1.1) (Pyrophosphate phospho-hydrolase) (PPase) with e-value of 3.7e-76 and BLAST sequence identity of 71.0
  misc_feature: SWISSPROT Homolog: IPYR_ORYSA Soluble inorganic pyrophosphatase (EC 3.6.1.1) (Pyrophosphate phospho-hydrolase) (PPase) with e-value of 5.0e-65 and BLAST sequence identity of 66.2
  misc_feature 36638:<222: Transcription Factor
  misc_feature: Phenotype: ROSETTE LEAVES - Curled 2 Useful for making ornamental plants with altered leaf shape
  misc_feature: Phenotype: INFLORESCENCE - Other Useful for making ornamental plants with modified flowers
  misc_feature (1)..(212): Functional Homolog of  Ceres CLONE ID no. 8068 at SEQ ID NO. 367 with e-value of 2.30E-75 and BLAST sequence identity of 75.0
MSDVTKTQENEVETKHQAPRLNERILSSLSRRTVAAHPWHDLEIGILQKMIVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIKELAPHRLSEIRRFFEDYKKNENKEVAVNDFLPSNTAVEAIQYSMDLYAEYVLHTLRR

SEQ ID NO: 352 - protein, 313 aa, Arabidopsis thaliana
  misc_feature (1)..(313): Ceres CLONE ID no. 8184
  misc_feature (187)..(304): Pfam Name: Autophagy_C Pfam Description: Autophagocytosis associated protein C-terminal domain
  misc_feature (6)..(156): Pfam Name: Autophagy_N Pfam Description: Autophagocytosis associated protein N-terminal domain
  misc_feature: Utility: MSX Useful for making plants tolerant to low nitrogen
  misc_feature: Phenotype: WHOLE PLANT - MSX Useful for making plants tolerant to low nitrogen
MVLSQKLHEAFKGTVERITGPRTISAFKEKGVLSVSEFVLAGDNLVSKCPTWSWESGDASKRKPYLPSDKQFLITRNVPCLRRAASVAEDYEAAGGEVLVDDEDNDGWLATHGKPKDKGKEEDNLPSMDALDINEKNTIQSIPTYFGGEEDDDIPDMEEFDEADNVVENDPATLQSTYLVAHEPDDDNILRTRTYDLSITYDKYYQTPRVWLTGYDESRMLLQPELVMEDVSQDHARKTVTIEDHPHLPGKHASVHPCRHGAVMKKIIDVLMSRGVEPEVDKYLFLFLKFMASVIPTIEYDYTMDFDLGSSST

SEQ ID NO: 353 - DNA, 855 bp, Populus balsamifera subsp. trichocarpa
  misc_feature (1)..(855): Ceres ANNOT ID no. 1485684
  misc_feature: Utility: MSX Useful for making plants tolerant to low nitrogen
  misc_feature 36828:<222: Transcription Factor
  misc_feature: Phenotype: WHOLE PLANT - MSX Useful for making plants tolerant to low nitrogen
atggtactatcacagaagattcacgaagcattcaaaggaacagtagagagaatcacaggtccacgcactgtttctgccttcaaagagaaaggcgttcttagtgtcagcgaattcattctcgctggtgacaatcttgtctctaaatgccccacttggtcctgggaatctggagagccgagcaagaggaagtcatacttacctgcagagaaacagtttttgatcactcgaaacgttccttgtctacgaagagctgcatctgtagaagaagagtatgaagcggctggaggtgaagttctacttgataacgaagataatgatggatggctggcaactcacgggaaacctaaagaaaccaaaggtgatgaggatgagaatgtgccttcaatggaggctctagaaatcagtgcaaaaaaaagtcttatccaaacaaaccattcatactttgggggagaggaggaggaagatattcctgacatggcagattttgaagaccctgacaatctaattgaatcagatcctgcaacacttcagactacatacctcgtggctcatgagcccgatgatgataacattctgcgcacccgaacatatgatgtcagcatcacgtatgataaatattatcaaactcctcgtgtatggcttactggatatgatgagtcaaggatgcttttgcaaccagagcttgtacttgaagatgttagccaagaccatgcacgcaaaacggtaactattgaagaccatccccacttacctgggaagcatgcatcagtgcatccttgccgacatggggctgtcatgaagaaaattattgatgttttaatgtcacgtggagttgagccagaagttgacaagtga

SEQ ID NO: 354 - protein, 284 aa, Populus balsamifera subsp. trichocarpa
  misc_feature (1)..(284): Ceres ANNOT ID no. 1485684
  misc_feature (189)..(285): Pfam Name: Autophagy_C Pfam Description: Autophagocytosis associated protein C-terminal domain
  misc_feature (6)..(158): Pfam Name: Autophagy_N Pfam Description: Autophagocytosis associated protein N-terminal domain
  misc_feature: SWISSPROT Homolog: ATG3_BRARE Autophagy-related protein 3 (APG3-like) with e-value of 6.2e-67 and BLAST sequence identity of 47.6
  misc_feature: SWISSPROT Homolog: ATG3_XENLA Autophagy-related protein 3 (APG3-like) with e-value of 2.4e-65 and BLAST sequence identity of 47.6
  misc_feature: SWISSPROT Homolog: ATG3_MOUSE Autophagy-related protein 3 (APG3-like) with e-value of 3.1e-65 and BLAST sequence identity of 47.8
  misc_feature: SWISSPROT Homolog: ATG3_XENTR Autophagy-related protein 3 (APG3-like) with e-value of 6.4e-65 and BLAST sequence identity of 47.1
  misc_feature: SWISSPROT Homolog: ATG3_RAT Autophagy-related protein 3 (APG3-like) (Preconditioning-inducible gene 1 protein) with e-value of 1.0e-64 and BLAST sequence identity of 47.3
  misc_feature: Utility: MSX Useful for making plants tolerant to low nitrogen
  misc_feature 36943:<222: Transcription Factor
  misc_feature: Phenotype: WHOLE PLANT - MSX Useful for making plants tolerant to low nitrogen
  misc_feature (1)..(284): Functional Homolog of  Ceres CLONE ID no. 8184 at SEQ ID NO. 374 with e-value of 2.09E-134 and BLAST sequence identity of 85.8
MVLSQKIHEAFKGTVERITGPRTVSAFKEKGVLSVSEFILAGDNLVSKCPTWSWESGEPSKRKSYLPAEKQFLITRNVPCLRRAASVEEEYEAAGGEVLLDNEDNDGWLATHGKPKETKGDEDENVPSMEALEISAKKSLIQTNHSYFGGEEEEDIPDMADFEDPDNLIESDPATLQTTYLVAHEPDDDNILRTRTYDVSITYDKYYQTPRVWLTGYDESRMLLQPELVLEDVSQDHARKTVTIEDHPHLPGKHASVHPCRHGAVMKKIIDVLMSRGVEPEVDK

SEQ ID NO: 355 - DNA, 855 bp, Populus balsamifera subsp. trichocarpa
  misc_feature (1)..(855): Ceres ANNOT ID no. 1447192
  misc_feature: Utility: MSX Useful for making plants tolerant to low nitrogen
  misc_feature 37036:<222: Transcription Factor
  misc_feature: Phenotype: WHOLE PLANT - MSX Useful for making plants tolerant to low nitrogen
atggttctatcacagaagattcacgaagcattcaaaggaacagtggagagaatcacaggtccacgcactgtttctgcctttaaagagaaaggcgttcttagtgtcagcgaattcattctcgccggtgacaatctcgtctctaaatgccccacttggtcctgggaatctggtgagccgagcaagaggaagccttacttgcctgcagagaaacagtttctgattactcgaaatgttccttgtctacgaagagctgcgtctgtagaagaagattatgaagctgctggaggtgaagttctacttgataatgaagataatgatggatggctagcaactcatgggaaacctaaagaaactaaaggtgacgaggatgagaatgtgccttcaatggaggctctagatatcagtgttaaaagaattcctatccaaacaaacccttcatactttgggggagaggaggaagatattcctgacatggcagactttgaagaccctgacaatctaatcgaatcagatcctgcaacacttcagactacgtatctagtggctcacgaacctgatgatgatgataacattctacgcactcgaacatatgatgtcagcatcacgtacgataaatattatcaaactcctcgtgtatggcttactggatatgatgagtcaaggatgcttttggaaccagagcttgtacttgaagatgttagccaagaccatgcacgcaaaacggtaactattgaagaccatcctcacttacctgggaagcatgcatcagtgcatccttgccgacatggggctgtaatgaagaaaattattgatgttctaatgtcacgcggagttgagccagaagttgacaagtga

SEQ ID NO: 356 - protein, 284 aa, Populus balsamifera subsp. trichocarpa
  misc_feature (1)..(284): Ceres ANNOT ID no. 1447192
  misc_feature (189)..(284): Pfam Name: Autophagy_C Pfam Description: Autophagocytosis associated protein C-terminal domain
  misc_feature (6)..(157): Pfam Name: Autophagy_N Pfam Description: Autophagocytosis associated protein N-terminal domain
  misc_feature: SWISSPROT Homolog: ATG3_BRARE Autophagy-related protein 3 (APG3-like) with e-value of 6.2e-67 and BLAST sequence identity of 47.6
  misc_feature: SWISSPROT Homolog: ATG3_XENLA Autophagy-related protein 3 (APG3-like) with e-value of 2.4e-65 and BLAST sequence identity of 47.6
  misc_feature: SWISSPROT Homolog: ATG3_MOUSE Autophagy-related protein 3 (APG3-like) with e-value of 3.1e-65 and BLAST sequence identity of 47.8
  misc_feature: SWISSPROT Homolog: ATG3_XENTR Autophagy-related protein 3 (APG3-like) with e-value of 6.4e-65 and BLAST sequence identity of 47.1
  misc_feature: SWISSPROT Homolog: ATG3_RAT Autophagy-related protein 3 (APG3-like) (Preconditioning-inducible gene 1 protein) with e-value of 1.0e-64 and BLAST sequence identity of 47.3
  misc_feature: Utility: MSX Useful for making plants tolerant to low nitrogen
  misc_feature 37151:<222: Transcription Factor
  misc_feature: Phenotype: WHOLE PLANT - MSX Useful for making plants tolerant to low nitrogen
  misc_feature (1)..(284): Functional Homolog of  Ceres CLONE ID no. 8184 at SEQ ID NO. 374 with e-value of 3.49E-134 and BLAST sequence identity of 87.1
MVLSQKIHEAFKGTVERITGPRTVSAFKEKGVLSVSEFILAGDNLVSKCPTWSWESGEPSKRKPYLPAEKQFLITRNVPCLRRAASVEEDYEAAGGEVLLDNEDNDGWLATHGKPKETKGDEDENVPSMEALDISVKRIPIQTNPSYFGGEEEDIPDMADFEDPDNLIESDPATLQTTYLVAHEPDDDDNILRTRTYDVSITYDKYYQTPRVWLTGYDESRMLLEPELVLEDVSQDHARKTVTIEDHPHLPGKHASVHPCRHGAVMKKIIDVLMSRGVEPEVDK

SEQ ID NO: 357 - protein, 478 aa, Arabidopsis thaliana
  misc_feature (1)..(478): Ceres CLONE ID no. 8254
  misc_feature (144)..(472): Pfam Name: DUF1682 Pfam Description: Protein of unknown function (DUF1682)
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MNRLFSLFSIALIAFLCLHHHVLASSSSDFEGFDAEDDDVSEDSTELHHSLRPPLLTQSESTVLDLDPSPDSDSTPASKSDPPTQTVKPSSSISFDYWDEDEFEGLPEDEKSTESPVFSDDASSPADPQTPDLESASETPDTDIPKKMQSYTVEIVCVSILIGYAINYFTGKRENENLALAWASKFGLKDTIFEKNFSLLGVGEGEDSPLLLKEATNVFKFYASGRRYCHGLLATLELKSRHDLISRLFNSVVPCKDEISFEVYMNDEAMDHIVFAMARKKAAKTMHKELGDLQRFGGMVPSPGGRKWVTEELAVVSESKEVAGDMITDVVLDQVFGDKSFEKFGKYFISMHFSDQHPGKHRKMLLFKFALPDIKHMDDMVRLIALIPYYIDLIGRYKLSSQARNKTDGARQKAAQEAYKELENVRQEALQRKKAEKKKILEEAQAKLSSEALRKKEAKERARQMKKSMPKVKMSRGH

SEQ ID NO: 358 - DNA, 1416 bp, Populus balsamifera subsp. trichocarpa
  misc_feature (1)..(1416): Ceres ANNOT ID no. 1543042
  misc_feature 37391:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgacccgacccgtttcccttctctacttcctccctctcttacttctcctcctcctctctctcttctaccatgtcctcgccgattcccacttcgaaggattcgaagctgaagaagaagacgacgtcgtcgaggaaacaatagatcccaacgctttcaaactacccgatctccctttaactctgtccgagtcaccgcccatatcaactccaactccggatcctaaagaaccggatccgaaaccctccaaaccctctcccccaccttcaacgaccaacttcgagttctgggacgaagacgaattcgaaggactcccttctcatcaaccccacatcgaatccgtggtaattaccgagtctgccactccagatgccaccgtccaaacgccggatccaaaaccctccaccgtttcgaaaaagaagcagtccttcttggtggagattgtgtgtgtgagttttttgattatgtttgtgataaattacttcactggtaaaagagagaatgagaacttggcgttatcttgggcgtcgaaatttgcgacgaaagattcgatttttgagaagaattttagtcttttaggtgtgggagaaggggatgattcccctttattgttgaaagaagggcagaatgtgtttaaattctatgcgagtggacggaggtattgtcaagggttgttggcgacaatggagttgaagagtaggcatgatttgttgtccaggatatataatatggtggtcccatgtaaggatgagattagtattgaggtttatatgaatgatgatgcgatggatcatgtggtttttgccttggcgaggaagaagatggcgaaagcaatgcagaaggaattgagggatttgcagaggtttgctgggagtgttgtgcagccgcctaatgggaggaaatgggtggctgaggagttggctgttgtttctgagtctaaggaagttgctggggatttgatcactgaggccgtgcttgagcaggtttttggtgagaaatcatttgagaaacatggcaagggcttcatctcaatgcatgtctctgatcaactccctggcacacagaagaagatgctattgttcaaatttgctcttcctgatgccaaaaacatggctgacatgacccggctggtggctttggtaccctattacattgatctagttgggcgctacaagctgagttcacaggctcgttctaaaacagaggcggccagagcgaaagctgcccaagaggcatacaaagaacttcaaggtgcaagacaagaagctttacagaaaaagaaggcagagaggaaaaagatgttagaggaggccgaagcaaagctcggtgcagaggcaattcgcaagaaagaagaaaaggagcgtgctcgtcagatgaagaaggcaatgccaaaagtaaagatgacccgtggtcactag

SEQ ID NO: 359 - protein, 471 aa, Populus balsamifera subsp. trichocarpa
  misc_feature (1)..(471): Ceres ANNOT ID no. 1543042
  misc_feature (135)..(465): Pfam Name: DUF1682 Pfam Description: Protein of unknown function (DUF1682)
  misc_feature 37505:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(471): Functional Homolog of  Ceres CLONE ID no. 8254 at SEQ ID NO. 379 with e-value of 8.80E-161 and BLAST sequence identity of 68.8
MTRPVSLLYFLPLLLLLLLSLFYHVLADSHFEGFEAEEEDDVVEETIDPNAFKLPDLPLTLSESPPISTPTPDPKEPDPKPSKPSPPPSTTNFEFWDEDEFEGLPSHQPHIESVVITESATPDATVQTPDPKPSTVSKKKQSFLVEIVCVSFLIMFVINYFTGKRENENLALSWASKFATKDSIFEKNFSLLGVGEGDDSPLLLKEGQNVFKFYASGRRYCQGLLATMELKSRHDLLSRIYNMVVPCKDEISIEVYMNDDAMDHVVFALARKKMAKAMQKELRDLQRFAGSVVQPPNGRKWVAEELAVVSESKEVAGDLITEAVLEQVFGEKSFEKHGKGFISMHVSDQLPGTQKKMLLFKFALPDAKNMADMTRLVALVPYYIDLVGRYKLSSQARSKTEAARAKAAQEAYKELQGARQEALQKKKAERKKMLEEAEAKLGAEAIRKKEEKERARQMKKAMPKVKMTRGH

SEQ ID NO: 360 - DNA, 1470 bp, Populus balsamifera subsp. trichocarpa
  misc_feature (1)..(1470): Ceres ANNOT ID no. 1489655
  misc_feature 37663:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgacccgacccgtttcccttctctacttcctccctctcttacttctcctcctcctctctctcttctaccatgtcctcgccgattcccacttcgaaggattcgaagctgaagaagaagacgacgtcgtcgaggaaacaatagatcccaacgctttcaaactacccgatctccctttaactctgtccgagtcaccgcccatatcaactccaactccggatcctaaagaaccggatccgaaaccctccaaaccctctcccccaccttcaacgaccaacttcgagttctgggacgaagacgaattcgaaggactcccttctcatcaaccccacatcgaatccgtggtaattaccgagtctgccactccagatgccaccgtccaaacgccggatccaaaaccctccaccgtttcgaaaaagaagcagtccttcttggtggagattgtgtgtgtgagttttttgattatgtttgtgataaattacttcactggtaaaagagagaatgagaacttggcgttatcttgggcgtcgaaatttgcgacgaaagattcgatttttgagaagaattttagtcttttaggtgtgggagaaggggatgattcccctttattgttgaaagaagggcagaatgtgtttaaattctatgcgagtggacggaggtattgtcaagggttgttggcgacaatggagttgaagagtaggcatgatttgttgtccaggatatataatatggtggtcccatgtaaggatgagattagtattgaggtttatatgaatgatgatgcgatggatcatgtggtttttgccttggcgaggaagaagatggcgaaagcaatgcagaaggaattgagggatttgcagaggtttgctgggagtgttgtgcagccgcctaatgggaggaaatgggtggctgaggagttggctgttgtttctgagtctaaggaagttgctggggatttgatcactgaggccgtgcttgagcaggttagaaacagggagtttggttgtcttgaaagaattagcttgattcagttttgggtttttggtgagaaatcatttgagaaacatggcaagggcttcatctcaatgcatgtctctgatcaactccctggcacacagaagaagatgctattgttcaaatttgctcttcctgatgccaaaaacatggctgacatgacccggctggtggctttggtaccctattacattgatctagttgggcgctacaagctgagttcacaggctcgttctaaaacagaggcggccagagcgaaagctgcccaagaggcatacaaagaacttcaaggtgcaagacaagaagctttacagaaaaagaaggcagagaggaaaaagatgttagaggaggccgaagcaaagctcggtgcagaggcaattcgcaagaaagaagaaaaggagcgtgctcgtcagatgaagaaggcaatgccaaaagtaaagatgacccgtggtcactag

SEQ ID NO: 361 - protein, 489 aa, Populus balsamifera subsp. trichocarpa
  misc_feature (1)..(489): Ceres ANNOT ID no. 1489655
  misc_feature (135)..(328): Pfam Name: DUF1682 Pfam Description: Protein of unknown function (DUF1682)
  misc_feature 37779:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(489): Functional Homolog of  Ceres CLONE ID no. 8254 at SEQ ID NO. 379 with e-value of 3.20E-156 and BLAST sequence identity of 68.8
MTRPVSLLYFLPLLLLLLLSLFYHVLADSHFEGFEAEEEDDVVEETIDPNAFKLPDLPLTLSESPPISTPTPDPKEPDPKPSKPSPPPSTTNFEFWDEDEFEGLPSHQPHIESVVITESATPDATVQTPDPKPSTVSKKKQSFLVEIVCVSFLIMFVINYFTGKRENENLALSWASKFATKDSIFEKNFSLLGVGEGDDSPLLLKEGQNVFKFYASGRRYCQGLLATMELKSRHDLLSRIYNMVVPCKDEISIEVYMNDDAMDHVVFALARKKMAKAMQKELRDLQRFAGSVVQPPNGRKWVAEELAVVSESKEVAGDLITEAVLEQVRNREFGCLERISLIQFWVFGEKSFEKHGKGFISMHVSDQLPGTQKKMLLFKFALPDAKNMADMTRLVALVPYYIDLVGRYKLSSQARSKTEAARAKAAQEAYKELQGARQEALQKKKAERKKMLEEAEAKLGAEAIRKKEEKERARQMKKAMPKVKMTRGH

SEQ ID NO: 362 - protein, 164 aa, Arabidopsis thaliana
  misc_feature (1)..(164): Ceres CLONE ID no. 8265
  misc_feature (3)..(32): Pfam Name: zf-RanBP Pfam Description: Zn-finger in Ran binding protein and others
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MSRPGDWNCRSCSHLNFQRRDSCQRCGDSRSGPGGVGGLDFGNFGGRAMSVFGFTTGSDVRPGDWYCTVGNCGTHNFASRSTCFKCGTFKDETGAGGGGGGIGGPAMFDADIMRSRVPGNGGRSSWKSGDWICTRIGCNEHNFASRMECFRCNAPRDFSNRTSF

SEQ ID NO: 363 - DNA, 456 bp, Populus balsamifera subsp. trichocarpa
  misc_feature (1)..(456): Ceres ANNOT ID no. 1438919
  misc_feature 38071:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgaacaggccaggagactggaactgcaggtcatgccaacacctcaatttccagaggcgtgactcttgccaacgttgtggggaccccaggtccgcaggtgattttgggggtttcggtgggcggggtggctcatcacttgggttcaccgggtcggatgttcgtcccggtgattggtactgcactgccggaaactgcggggcccacaactttgctagccgttctagttgcttcaaatgtggagtgtacaaggaaatggactccgccgggggcttcgattctgatttttctcgaactagagggtttggtgggagcactggaggtggcaatcgatctggatggaaatccggagactggatttgcactaggtggggatgcaacgaacataactttgctagcagaatggagtgcttcaagtgcaatgccccaagagatcttagcaacagaacttcatactag

SEQ ID NO: 364 - protein, 151 aa, Populus balsamifera subsp. trichocarpa
  misc_feature (1)..(151): Ceres ANNOT ID no. 1438919
  misc_feature (3)..(32): Pfam Name: zf-RanBP Pfam Description: Zn-finger in Ran binding protein and others
  misc_feature: SWISSPROT Homolog: NRP1_YEAST Asparagine-rich protein (Protein ARP) with e-value of 4.3e-10 and BLAST sequence identity of 70.8
  misc_feature: SWISSPROT Homolog: CAZ_DROME RNA-binding protein cabeza Sarcoma-associated RNA-binding fly homolog (P19) with e-value of 6.8e-10 and BLAST sequence identity of 35.9
  misc_feature: SWISSPROT Homolog: RBP56_HUMAN TATA-binding protein-associated factor 2N (RNA-binding protein 56) (TAFII68) (TAF(II)68) with e-value of 4.2e-09 and BLAST sequence identity of 41.2
  misc_feature: SWISSPROT Homolog: FUS_BOVIN RNA-binding protein FUS (Pigpen protein) with e-value of 1.6e-08 and BLAST sequence identity of 38.3
  misc_feature: SWISSPROT Homolog: FUS_MOUSE RNA-binding protein FUS (Pigpen protein) with e-value of 1.6e-08 and BLAST sequence identity of 38.3
  misc_feature 38228:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(151): Functional Homolog of  Ceres CLONE ID no. 8265 at SEQ ID NO. 384 with e-value of 1.99E-60 and BLAST sequence identity of 78.9
MNRPGDWNCRSCQHLNFQRRDSCQRCGDPRSAGDFGGFGGRGGSSLGFTGSDVRPGDWYCTAGNCGAHNFASRSSCFKCGVYKEMDSAGGFDSDFSRTRGFGGSTGGGNRSGWKSGDWICTRWGCNEHNFASRMECFKCNAPRDLSNRTSY

SEQ ID NO: 365 - DNA, 456 bp, Populus balsamifera subsp. trichocarpa
  misc_feature (1)..(456): Ceres ANNOT ID no. 1499398
  misc_feature 38361:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgagcaggccaggagactggaactgcaggtcatgccaacacctcaactttcagaggcgtgactcgtgccagcgctgtggggaccccaggaccggaggtgatttaggaggttttggtgcgcggggtgggtcagcatttggttttaccggctcggatgttcgccccggtgactggtactgcaccgccggaaactgtggggcccacaactttgctagccgctcgagttgcttcaaatgcggagtgtacaaggaaattgattcttctgggggctttgattccgacttctctcgctctagaggttttgggggcagcactggaggcagcaatcgatctggttggaaatccggggattggatttgcactaggtggggatgcaacgagcataactttgctagcagaatggagtgcttcaagtgcaatgccccaagagaccttagcaacacaacttcatactag

SEQ ID NO: 366 - protein, 151 aa, Populus balsamifera subsp. trichocarpa
  misc_feature (1)..(151): Ceres ANNOT ID no. 1499398
  misc_feature (54)..(85): Pfam Name: zf-RanBP Pfam Description: Zn-finger in Ran binding protein and others
  misc_feature: SWISSPROT Homolog: NRP1_YEAST Asparagine-rich protein (Protein ARP) with e-value of 4.3e-10 and BLAST sequence identity of 70.8
  misc_feature: SWISSPROT Homolog: CAZ_DROME RNA-binding protein cabeza Sarcoma-associated RNA-binding fly homolog (P19) with e-value of 6.8e-10 and BLAST sequence identity of 35.9
  misc_feature: SWISSPROT Homolog: RBP56_HUMAN TATA-binding protein-associated factor 2N (RNA-binding protein 56) (TAFII68) (TAF(II)68) with e-value of 4.2e-09 and BLAST sequence identity of 41.2
  misc_feature: SWISSPROT Homolog: FUS_BOVIN RNA-binding protein FUS (Pigpen protein) with e-value of 1.6e-08 and BLAST sequence identity of 38.3
  misc_feature: SWISSPROT Homolog: FUS_MOUSE RNA-binding protein FUS (Pigpen protein) with e-value of 1.6e-08 and BLAST sequence identity of 38.3
  misc_feature 38518:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(151): Functional Homolog of  Ceres CLONE ID no. 8265 at SEQ ID NO. 384 with e-value of 2.29E-59 and BLAST sequence identity of 78.9
MSRPGDWNCRSCQHLNFQRRDSCQRCGDPRTGGDLGGFGARGGSAFGFTGSDVRPGDWYCTAGNCGAHNFASRSSCFKCGVYKEIDSSGGFDSDFSRSRGFGGSTGGSNRSGWKSGDWICTRWGCNEHNFASRMECFKCNAPRDLSNTTSY

SEQ ID NO: 367 - DNA, 486 bp, Populus balsamifera subsp. trichocarpa
  misc_feature (1)..(486): Ceres ANNOT ID no. 1446419
  misc_feature 38651:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgccttttatcttgatgcatgcagcaaatatgagcaggccaggagactggaactgcaggtcatgccaacacctcaactttcagaggcgtgactcgtgccagcgctgtggggaccccaggaccggaggtgatttaggaggttttggtgcgcggggtgggtcagcatttggttttaccggctcggatgttcgccccggtgactggtactgcaccgccggaaactgtggggcccacaactttgctagccgctcgagttgcttcaaatgcggagtgtacaaggaaattgattcttctgggggctttgattccgacttctctcgctctagaggttttgggggcagcactggaggcagcaatcgatctggttggaaatccggggattggatttgcactaggtggggatgcaacgagcataactttgctagcagaatggagtgcttcaagtgcaatgccccaagagaccttagcaacacaacttcatactag

SEQ ID NO: 368 - protein, 161 aa, Populus balsamifera subsp. trichocarpa
  misc_feature (1)..(161): Ceres ANNOT ID no. 1446419
  misc_feature (64)..(95): Pfam Name: zf-RanBP Pfam Description: Zn-finger in Ran binding protein and others
  misc_feature: SWISSPROT Homolog: NRP1_YEAST Asparagine-rich protein (Protein ARP) with e-value of 4.3e-10 and BLAST sequence identity of 70.8
  misc_feature: SWISSPROT Homolog: CAZ_DROME RNA-binding protein cabeza Sarcoma-associated RNA-binding fly homolog (P19) with e-value of 6.8e-10 and BLAST sequence identity of 35.9
  misc_feature: SWISSPROT Homolog: RBP56_HUMAN TATA-binding protein-associated factor 2N (RNA-binding protein 56) (TAFII68) (TAF(II)68) with e-value of 4.2e-09 and BLAST sequence identity of 41.2
  misc_feature: SWISSPROT Homolog: FUS_BOVIN RNA-binding protein FUS (Pigpen protein) with e-value of 1.6e-08 and BLAST sequence identity of 38.3
  misc_feature: SWISSPROT Homolog: FUS_MOUSE RNA-binding protein FUS (Pigpen protein) with e-value of 1.6e-08 and BLAST sequence identity of 38.3
  misc_feature 38810:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(161): Functional Homolog of  Ceres CLONE ID no. 8265 at SEQ ID NO. 384 with e-value of 2.29E-59 and BLAST sequence identity of 78.9
MPFILMHAANMSRPGDWNCRSCQHLNFQRRDSCQRCGDPRTGGDLGGFGARGGSAFGFTGSDVRPGDWYCTAGNCGAHNFASRSSCFKCGVYKEIDSSGGFDSDFSRSRGFGGSTGGSNRSGWKSGDWICTRWGCNEHNFASRMECFKCNAPRDLSNTTSY

SEQ ID NO: 369 - protein, 104 aa, Arabidopsis thaliana
  misc_feature (1)..(104): Ceres CLONE ID no. 8381
  misc_feature (2)..(98): Pfam Name: LEA_3 Pfam Description: Late embryogenesis abundant protein
  misc_feature: Utility: Soil Drought Useful for making plants with increased tolerance to drought
  misc_feature: Phenotype: WHOLE PLANT - Soil Drought Useful for making plants with increased tolerance to drought
MAARSLSGAVKSLCSAASGSLSCSIVLRRSYVATSQNVTAAGLSKGGSTRVMVGKMEQRGLDQEAESAWGPDPVTGYYRPSNRAAEIDPAELRELLLKNKAKSF

SEQ ID NO: 370 - DNA, 324 bp, Populus balsamifera subsp. trichocarpa
  misc_feature (1)..(324): Ceres ANNOT ID no. 1462544
  misc_feature: Utility: Soil Drought Useful for making plants with increased tolerance to drought
  misc_feature 39007:<222: Transcription Factor
  misc_feature: Phenotype: WHOLE PLANT - Soil Drought Useful for making plants with increased tolerance to drought
atggctcgctctctcccaaacgctaagcttcttgtcgcttctcttgctgatggtctttccctctctgttttccggagaggttacgcggctgctgcaccgatcagtgctgctgtaacagcgagcttcggtaggggtgggtcaaggaccagtgctatgacagggaaaatggaagatggggcggtggccaaagaagattctgaggcctactctgcatgggctcctgatccagttactgggtattacaggcctgctaattatgtagcagagattgatccagctgaacttagggaaatggtgttgagccatagggttaggccacagtag

SEQ ID NO: 371 - protein, 107 aa, Populus balsamifera subsp. trichocarpa
  misc_feature (1)..(107): Ceres ANNOT ID no. 1462544
  misc_feature (1)..(101): Pfam Name: LEA_3 Pfam Description: Late embryogenesis abundant protein
  misc_feature: SWISSPROT Homolog: LEA5_CITSI Late embryogenesis abundant protein Lea5 with e-value of 6.6e-15 and BLAST sequence identity of 45.6
  misc_feature: SWISSPROT Homolog: LEA5D_GOSHI Late embryogenesis abundant protein Lea5-D with e-value of 2.9e-12 and BLAST sequence identity of 41.3
  misc_feature: SWISSPROT Homolog: LEA5A_GOSHI Late embryogenesis abundant protein Lea5-A with e-value of 1.0e-11 and BLAST sequence identity of 39.4
  misc_feature: SWISSPROT Homolog: ARG2_PHAAU Indole-3-acetic acid-induced protein ARG2 with e-value of 2.5e-08 and BLAST sequence identity of 36.6
  misc_feature: Utility: Soil Drought Useful for making plants with increased tolerance to drought
  misc_feature 39084:<222: Transcription Factor
  misc_feature: Phenotype: WHOLE PLANT - Soil Drought Useful for making plants with increased tolerance to drought
  misc_feature (1)..(107): Functional Homolog of  Ceres CLONE ID no. 8381 at SEQ ID NO. 391 with e-value of 8.80E-19 and BLAST sequence identity of 58.7
MARSLPNAKLLVASLADGLSLSVFRRGYAAAAPISAAVTASFGRGGSRTSAMTGKMEDGAVAKEDSEAYSAWAPDPVTGYYRPANYVAEIDPAELREMVLSHRVRPQ

SEQ ID NO: 372 - protein, 129 aa, Arabidopsis thaliana
  misc_feature (1)..(129): Ceres CLONE ID no. 8458
  misc_feature: Phenotype: INFLORESCENCE - Strong Useful for making stronger plants
MTIAPALQTTFVSSTNFLKHSSSWGSSSPNNVILPKNKRSSTSVVVAAVGDVSSDGTIYLIGGAIAVALVGTAFPILFKRKDTCPECDGAGFVRKGGVTLRANAARKDLPQIVCANCNGLGKLNQIDKS

SEQ ID NO: 373 - DNA, 414 bp, Populus balsamifera subsp. trichocarpa
  misc_feature (1)..(414): Ceres ANNOT ID no. 1454042
  misc_feature 39187:<222: Transcription Factor
  misc_feature: Phenotype: INFLORESCENCE - Strong Useful for making stronger plants
atggcaactttaactcctattcagacttctctttcaagattttcaccacaaagatggccagtttcaggcccaggcttttcagctgcgatgcctgctggttccaagtttctgtcatggaatatcagccagaagaagaacaagaataaaaggtcattgactgtggttgcagcggtgggagatgtatcagctgatggcaccacttacctaattgccggtgcggctgctgtagctctactcggaactgcttttcccatactcttctctcgcaaggacctgtgtcctgagtgcgatggagcaggtttcattcggaagtcaggagcaaccttgagagctaatgcagcacggaaggaccaggcccagattgtctgccctcgttgcaatggccttggcaagctcaaccaaattgataaataa

SEQ ID NO: 374 - protein, 137 aa, Populus balsamifera subsp. trichocarpa
  misc_feature (1)..(137): Ceres ANNOT ID no. 1454042
  misc_feature 39226:<222: Transcription Factor
  misc_feature: Phenotype: INFLORESCENCE - Strong Useful for making stronger plants
  misc_feature (1)..(137): Functional Homolog of  Ceres CLONE ID no. 8458 at SEQ ID NO. 394 with e-value of 1.80E-36 and BLAST sequence identity of 72.8
MATLTPIQTSLSRFSPQRWPVSGPGFSAAMPAGSKFLSWNISQKKNKNKRSLTVVAAVGDVSADGTTYLIAGAAAVALLGTAFPILFSRKDLCPECDGAGFIRKSGATLRANAARKDQAQIVCPRCNGLGKLNQIDK

SEQ ID NO: 375 - protein, 235 aa, Arabidopsis thaliana
  misc_feature (1)..(235): Ceres CLONE ID no. 8633
  misc_feature (29)..(213): Pfam Name: Proteasome Pfam Description: Proteasome A-type and B-type
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Other Useful for making ornamental plants with modified flowers
MGDSQYSFSLTTFSPSGKLVQIEHALTAVGSGQTSLGIKASNGVVIATEKKLPSILVDEASVQKIQHLTPNIGVVYSGMGPDFRVLVRKSRKQAEQYLRLYKEPIPVTQLVRETATVMQEFTQSGGVRPFGVSLLVAGYDDKGPQLYQVDPSGSYFSWKASAMGKNVSNAKTFLEKRYTEDMELDDAIHTAILTLKEGFEGEISSKNIEIGKIGADKVFRVLTPAEIDDYLAEVE

SEQ ID NO: 376 - DNA, 720 bp, Populus balsamifera subsp. trichocarpa
  misc_feature (1)..(720): Ceres ANNOT ID no. 1527560
  misc_feature 39373:<222: Transcription Factor
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Other Useful for making ornamental plants with modified flowers
atgggtgatagccagtactccttttctctcactactttcagtcctacaggaaagctagtacagatcgagcacgcattgactgccgttggatcaggccaaacttctctcggaatcaaagctgcaaacggtgttgttattgcaactgagaagaaattgccttctattttagtcgatgaatcatctgttcagaaaatacagaatctgacacctaatattggagttgtctacagtggaatgggtcctgactttcgagttttagttcggaaaagtaggaagcaggcagaacaatatcatagattgtacaaggaaccaattcctgtcacacaacttgtgagggaaactgccgctgtcatgcaagagtttactcaatctggaggtgtaaggccttttggagtatctttgctagttgctggttttgatgacaaaggtccacagctgtaccaggttgatccctcaggttcctacttctcatggaaagcctcagcaatgggaaaaaatgtttcaaatgcaaaaacatttcttgagaagagatacactgatgatatggagcttgatgatgctgtacacactgctatcttgacactgaaagagggatttgaaggacagatctctgggaaaaatattgaaattgggataattggtgctgacaagcaattcaggcatgctctttcggtactaactccagctgaaattgatgattatctggctgaagtggaatag

SEQ ID NO: 377 - protein, 239 aa, Populus balsamifera subsp. trichocarpa
  misc_feature (1)..(239): Ceres ANNOT ID no. 1527560
  misc_feature (29)..(213): Pfam Name: Proteasome Pfam Description: Proteasome A-type and B-type
  misc_feature: SWISSPROT Homolog: PSA2A_ARATH Proteasome subunit alpha type 2-A (EC 3.4.25.1) (20S proteasome alpha subunit B) (Proteasome component 3) with e-value of 2.4e-120 and BLAST sequence identity of 100.0
  misc_feature: SWISSPROT Homolog: PSA2B_ARATH Proteasome subunit alpha type 2-B (EC 3.4.25.1) (20S proteasome alpha subunit B-2) with e-value of 1.7e-119 and BLAST sequence identity of 99.1
  misc_feature: SWISSPROT Homolog: PSA2_ORYSA Proteasome subunit alpha type 2 (EC 3.4.25.1) (20S proteasome alpha subunit B) (20S proteasome subunit alpha-2) with e-value of 6.7e-109 and BLAST sequence identity of 90.2
  misc_feature: SWISSPROT Homolog: PSA2_CARAU Proteasome subunit alpha type 2 (EC 3.4.25.1) with e-value of 5.0e-81 and BLAST sequence identity of 68.1
  misc_feature: SWISSPROT Homolog: PSA2_XENLA Proteasome subunit alpha type 2 with e-value of 2.7e-80 and BLAST sequence identity of 67.7
  misc_feature: SWISSPROT Homolog: PSA2_XENLA EC 3.4.25.1 (Proteasome component C3) (Macropain subunit C3) Multicatalytic endopeptidase complex subunit C3 (xC3)
  misc_feature 39491:<222: Transcription Factor
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(239): Functional Homolog of  Ceres CLONE ID no. 8633 at SEQ ID NO. 397 with e-value of 8.90E-113 and BLAST sequence identity of 94.4
MGDSQYSFSLTTFSPTGKLVQIEHALTAVGSGQTSLGIKAANGVVIATEKKLPSILVDESSVQKIQNLTPNIGVVYSGMGPDFRVLVRKSRKQAEQYHRLYKEPIPVTQLVRETAAVMQEFTQSGGVRPFGVSLLVAGFDDKGPQLYQVDPSGSYFSWKASAMGKNVSNAKTFLEKRYTDDMELDDAVHTAILTLKEGFEGQISGKNIEIGIIGADKQFRHALSVLTPAEIDDYLAEVE

SEQ ID NO: 378 - DNA, 798 bp, Populus balsamifera subsp. trichocarpa
  misc_feature (1)..(798): Ceres ANNOT ID no. 1522449
  misc_feature 39583:<222: Transcription Factor
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Other Useful for making ornamental plants with modified flowers
atgggtgatagccagtactccttttctctcactactttcagtcctaccggaaagctagtacagattgagcacgcattgactgccgttggatcaggccaaacttctctcggaatcaaagcggcaaacggtgttgttattgcaactgagaagaaattgccatctattttagtcgatgaatcttctgttcagaaaatacagaatctgacacccaatattggtgttgtctacaggtttgtttctgcctgcttctcagtaattaggaagtttcatttttttttagcttgtgtttctctggccttaactatagctaacatatctgtcatcaatgattgtagtgggcaggtcaatgttctcaaatggtctggttacggacttgactttgacactggaatgggtcctgactttcgagttttggttcggaaaagtaggaagcaagcagaacaatatcatagactgtacaaggaaccaattcctgtcacacaacttgtgagggaaactgctgctgtcatgcaagagtttactcaatctggaggtgtaaggccttttggagtatctttgctagtcgctggttttgatgacaaaggtccacagctataccaggtggatccatcaggttcctacttctcatggaaagcctcagcaatggggaaaaatgtttcaaatgcaaaaacatttcttgagaagagatacactgatgatatggagcttgatgatgctgtgcacaccgctatcttgacactaaaagagggggtactaactccagccgaaattgatgattatttggctgaagtggaatag

SEQ ID NO: 379 - protein, 265 aa, Populus balsamifera subsp. trichocarpa
  misc_feature (1)..(265): Ceres ANNOT ID no. 1522449
  misc_feature (29)..(264): Pfam Name: Proteasome Pfam Description: Proteasome A-type and B-type
  misc_feature: SWISSPROT Homolog: PSA2A_ARATH Proteasome subunit alpha type 2-A (EC 3.4.25.1) (20S proteasome alpha subunit B) (Proteasome component 3) with e-value of 2.4e-120 and BLAST sequence identity of 100.0
  misc_feature: SWISSPROT Homolog: PSA2B_ARATH Proteasome subunit alpha type 2-B (EC 3.4.25.1) (20S proteasome alpha subunit B-2) with e-value of 1.7e-119 and BLAST sequence identity of 99.1
  misc_feature: SWISSPROT Homolog: PSA2_ORYSA Proteasome subunit alpha type 2 (EC 3.4.25.1) (20S proteasome alpha subunit B) (20S proteasome subunit alpha-2) with e-value of 6.7e-109 and BLAST sequence identity of 90.2
  misc_feature: SWISSPROT Homolog: PSA2_CARAU Proteasome subunit alpha type 2 (EC 3.4.25.1) with e-value of 5.0e-81 and BLAST sequence identity of 68.1
  misc_feature: SWISSPROT Homolog: PSA2_XENLA Proteasome subunit alpha type 2 with e-value of 2.7e-80 and BLAST sequence identity of 67.7
  misc_feature: SWISSPROT Homolog: PSA2_XENLA EC 3.4.25.1 (Proteasome component C3) (Macropain subunit C3) Multicatalytic endopeptidase complex subunit C3 (xC3)
  misc_feature 39703:<222: Transcription Factor
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(265): Functional Homolog of  Ceres CLONE ID no. 8633 at SEQ ID NO. 397 with e-value of 1.49E-87 and BLAST sequence identity of 95.3
MGDSQYSFSLTTFSPTGKLVQIEHALTAVGSGQTSLGIKAANGVVIATEKKLPSILVDESSVQKIQNLTPNIGVVYRFVSACFSVIRKFHFFLACVSLALTIANISVINDCSGQVNVLKWSGYGLDFDTGMGPDFRVLVRKSRKQAEQYHRLYKEPIPVTQLVRETAAVMQEFTQSGGVRPFGVSLLVAGFDDKGPQLYQVDPSGSYFSWKASAMGKNVSNAKTFLEKRYTDDMELDDAVHTAILTLKEGVLTPAEIDDYLAEVE

SEQ ID NO: 380 - protein, 220 aa, Arabidopsis thaliana
  misc_feature (1)..(220): Ceres CLONE ID no. 8788
  misc_feature (1)..(220): Also Known As Ceres CDNA ID no. 23370421
  misc_feature (1)..(220): Also Known As Ceres GEMINI ID 555D2
  misc_feature (158)..(209): Pfam Name: Pterin_4a Pfam Description: Pterin 4 alpha carbinolamine dehydratase
  misc_feature 39821:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (178)..(178): Xaa is any aa, unknown, or other
MAATSSSPPCNISASSLLLRQPSRSILKVFGLLPPVSRNNRKLGRLTVTRSNLAQDFLGDFGARDPYPEEIASQFGDKVLGCQSTEHKILIPNASVLSLSQLQCSPVSSSQPPLSGDDARTLLHKVLGWSIVDNEAGGLKIRCMWKVKDFGCGVELINRIHKVAEASGHYPSLHLESXTQVRAELFTSSIGGLSMNDFIMAAKIDDIKTSDLSPRKRAWA

SEQ ID NO: 381 - DNA, 798 bp, Populus balsamifera subsp. trichocarpa
  misc_feature (1)..(798): Ceres ANNOT ID no. 1474018
  misc_feature 39916:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgacgtggcacttcatccctgcccctagtaactggacgatccttgaaataggtcttgtccaagactttgctaaccaccagataacacagcaagacaagacaaacctccttgaacttagcttccgcaatcaccaccaaaagtctagcaaaccaccatggccaccaccgctacaaccaccactcacatacccttctctctcccactctccaagctctcttctccacacaaccactatcaccacttcaaagtctccatcttcaaagtcaccacttcaaatccccaccttgagaattcaagctatgggggatcagttaggtgaatttggtgctagagacccttttcctgctgaaatagagagtgcttttgctgagaaagtgttaggcaatgttgatactgaacacaagattctcattcctactgtttctgcactttctctttcccagcaagagtgtactcctatatctcctctgcaagaccccatgtctaaggatgatgctcaaaagcttttaaagaaggttcttggctggagactcctcgataaagaagttggacttaaactgcaatgcttgtggaagttgagagattttaaatgtggtgttgagcttgtcaatagaatttacaaagttacagaatcatgtggccattttccagatgtgcacttggaacagaatcaagttagagccgaactttggactgaatcccttggaggcttgagcatgaccgatttcattgtcgcagccaagattgatgagattaagacatcagaccttgtccctagaaaaagagtatgggcataa

SEQ ID NO: 382 - protein, 265 aa, Populus balsamifera subsp. trichocarpa
  misc_feature (1)..(265): Ceres ANNOT ID no. 1474018
  misc_feature (167)..(254): Pfam Name: Pterin_4a Pfam Description: Pterin 4 alpha carbinolamine dehydratase
  misc_feature: SWISSPROT Homolog: PHS_METCA Putative pterin-4-alpha-carbinolamine dehydratase with e-value of 1.4e-12 and BLAST sequence identity of 32.7
  misc_feature: SWISSPROT Homolog: PHS_METCA EC 4.2.1.96) (PHS)(4- alpha-hydroxy-tetrahydropterin dehydratase) ( Pterin carbinolamine dehydratase) (PCD)
  misc_feature: SWISSPROT Homolog: PHS_CHLTE Putative pterin-4-alpha-carbinolamine dehydratase with e-value of 1.8e-12 and BLAST sequence identity of 31.2
  misc_feature: SWISSPROT Homolog: PHS_CHLTE EC 4.2.1.96 (PHS) 4-alpha-hydroxy-tetrahydropterin dehydratase Pterin carbinolamine dehydratase (PCD)
  misc_feature: SWISSPROT Homolog: PHS_CHLTE Putative pterin-4-alpha-carbinolamine dehydratase with e-value of 2.1e-11 and BLAST sequence identity of 33.9
  misc_feature: SWISSPROT Homolog: PHS_CHLTE EC 4.2.1.96 (PHS) 4-alpha-hydroxy-tetrahydropterin dehydratase Pterin carbinolamine dehydratase (PCD)
  misc_feature: SWISSPROT Homolog: PHS_CHLTE Putative pterin-4-alpha-carbinolamine dehydratase with e-value of 3.4e-11 and BLAST sequence identity of 30.4
  misc_feature: SWISSPROT Homolog: PHS_CHLTE EC 4.2.1.96 (PHS) 4-alpha-hydroxy-tetrahydropterin dehydratase Pterin carbinolamine dehydratase (PCD)
  misc_feature: SWISSPROT Homolog: PHS_CHLTE Putative pterin-4-alpha-carbinolamine dehydratase with e-value of 4.3e-11 and BLAST sequence identity of 31.8
  misc_feature: SWISSPROT Homolog: PHS_CHLTE EC 4.2.1.96 (PHS) 4-alpha-hydroxy-tetrahydropterin dehydratase Pterin carbinolamine dehydratase (PCD)
  misc_feature 40076:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(265): Functional Homolog of  Ceres CLONE ID no. 8788 at SEQ ID NO. 402 with e-value of 2.10E-56 and BLAST sequence identity of 57.5
MTWHFIPAPSNWTILEIGLVQDFANHQITQQDKTNLLELSFRNHHQKSSKPPWPPPLQPPLTYPSLSHSPSSLLHTTTITTSKSPSSKSPLQIPTLRIQAMGDQLGEFGARDPFPAEIESAFAEKVLGNVDTEHKILIPTVSALSLSQQECTPISPLQDPMSKDDAQKLLKKVLGWRLLDKEVGLKLQCLWKLRDFKCGVELVNRIYKVTESCGHFPDVHLEQNQVRAELWTESLGGLSMTDFIVAAKIDEIKTSDLVPRKRVWA

SEQ ID NO: 383 - protein, 309 aa, Arabidopsis thaliana
  misc_feature (1)..(309): Ceres CLONE ID no. 8877
  misc_feature (23)..(228): Pfam Name: SOR_SNZ Pfam Description: SOR/SNZ family
  misc_feature: Utility: Mannitol Useful for making plants with enhanced tolerance to drought
  misc_feature: Phenotype: ROSETTE LEAVES - Cup-shaped Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Mannitol Useful for making plants with enhanced tolerance to drought
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MEGTGVVAVYGNGAITEAKKSPFSVKVGLAQMLRGGVIMDVVNAEQARIAEEAGACAVMALERVPADIRAQGGVARMSDPQMIKEIKQAVTIPVMAKARIGHFVEAQILEAIGIDYIDESEVLTLADEDHHINKHNFRIPFVCGCRNLGEALRRIREGAAMIRTKGEAGTGNIIEAVRHVRSVNGDIRVLRNMDDDEVFTFAKKLAAPYDLVMQTKQLGRLPVVQSAAGGVATPADAALMMQLGCDGVFVGSGIFKSGDPARRARAIVQAVTHYSDPEMLVEVSCGLGEAMVGINLNDEKVERFANRSE

SEQ ID NO: 384 - DNA, 930 bp, Populus balsamifera subsp. trichocarpa
  misc_feature (1)..(930): Ceres ANNOT ID no. 1507340
  misc_feature: Utility: Mannitol Useful for making plants with enhanced tolerance to drought
  misc_feature 40325:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Mannitol Useful for making plants with enhanced tolerance to drought
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggcaggaaccggagttgtggctgtctacggcaatggaacaataacagaaaccaaaaaatccccattctccgttaaggtaggcctagctcaaatgctcagaggcggggtcataatggacgtggtcaccgctgaacaagcccgtatagccgaagaagccggagcttgcgccgtcatggcattagaacgagtccccgccgacatccgtgcacaaggtggtgtggcacgcatgagcgaccctcagctcatcaaagaaataaaacaagcagtgaccatccctgtcatggcgaaagcccgaatcgggcatttcgtcgaagcccaaatccttgaagcgattggtgtcgattatgttgacgaatccgaggttcttacactggctgatgaagataatcacattaacaaacataacttccgcatcccttttgtttgcggatgccggaatttgggtgaggccttgaggaggataagggaaggggcggcaatgattaggactaaaggcgaggcgggcacggggaacgttattgaagctgttaggcatgttaggtctgtgatgggggatataaggatgttgagaaatatggatgatgatgaggtttttacctttgcaaagaagattgctgcgccttatgatttggttatgcagacaaagcagcttgggaggttgcctgttgtgcaattcgcggcgggtggagtggctactcctgctgatgcagcgttgatgatgcagttgggatgcgatggggtgtttgtagggtctggggtttttaagagtggggatccggttaagagggggagagctatcgtgcaggctgttacccattatagtgatcctgagctgctggctgaggtgagttgtgggcttggtgaggctatggtcgggcttaatttgaatgataagaaggtggagaggtttgctagtcggtcggattag

SEQ ID NO: 385 - protein, 309 aa, Populus balsamifera subsp. trichocarpa
  misc_feature (1)..(309): Ceres ANNOT ID no. 1507340
  misc_feature (23)..(228): Pfam Name: SOR_SNZ Pfam Description: SOR/SNZ family
  misc_feature: SWISSPROT Homolog: PDXL3_ARATH Probable pyridoxin biosynthesis PDX1-like protein 3 with e-value of 4.0e-159 and BLAST sequence identity of 99.7
  misc_feature: SWISSPROT Homolog: PDX1_HEVBR Probable pyridoxin biosynthesis protein ER1 (PDX1 homolog) (Ethylene-inducible protein HEVER) with e-value of 3.9e-152 and BLAST sequence identity of 94.2
  misc_feature: SWISSPROT Homolog: PDX1_PHAVU Probable pyridoxin biosynthesis protein PDX1 (pvPDX1) with e-value of 7.8e-147 and BLAST sequence identity of 91.9
  misc_feature: SWISSPROT Homolog: PDXL1_ARATH Probable pyridoxin biosynthesis PDX1-like protein 1 (HEVER-like protein) with e-value of 1.9e-143 and BLAST sequence identity of 88.7
  misc_feature: SWISSPROT Homolog: PDX1_GINBI Pyridoxin biosynthesis protein PDX1 (Sor-like protein) with e-value of 1.8e-138 and BLAST sequence identity of 86.7
  misc_feature: Utility: Mannitol Useful for making plants with enhanced tolerance to drought
  misc_feature 40475:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Mannitol Useful for making plants with enhanced tolerance to drought
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(309): Functional Homolog of  Ceres CLONE ID no. 8877 at SEQ ID NO. 405 with e-value of 8.10E-151 and BLAST sequence identity of 92.5
MAGTGVVAVYGNGTITETKKSPFSVKVGLAQMLRGGVIMDVVTAEQARIAEEAGACAVMALERVPADIRAQGGVARMSDPQLIKEIKQAVTIPVMAKARIGHFVEAQILEAIGVDYVDESEVLTLADEDNHINKHNFRIPFVCGCRNLGEALRRIREGAAMIRTKGEAGTGNVIEAVRHVRSVMGDIRMLRNMDDDEVFTFAKKIAAPYDLVMQTKQLGRLPVVQFAAGGVATPADAALMMQLGCDGVFVGSGVFKSGDPVKRGRAIVQAVTHYSDPELLAEVSCGLGEAMVGLNLNDKKVERFASRSD

SEQ ID NO: 386 - DNA, 930 bp, Populus balsamifera subsp. trichocarpa
  misc_feature (1)..(930): Ceres ANNOT ID no. 1529361
  misc_feature: Utility: Mannitol Useful for making plants with enhanced tolerance to drought
  misc_feature 40616:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Mannitol Useful for making plants with enhanced tolerance to drought
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggcaggaaccggagtggtggcagtctatggcaacggagcaataacagaaaccaaaaaatccccattctccgtgaaggtaggcctagcccaaatgctaagaggcggggtcataatggacgttgtcacccctgaacaagcccggattgccgaagaagccggcgcctgtgctgtcatggcactagaacgagtccccgctgacatccgtgcacaaggcggtgtggcacgcatgagcgacccacagctcatcaaagaaataaaacaggcagtgacaatccctgtcatggcgaaagcccgaatcgggcatttcgtcgaggcccaaattcttgaagccattggcatcgactatatcgacgaatccgaggttcttacaccagctgatgaagaaaatcacattaacaagcataatttccgcatcccttttgtttgcggatgccgaaatttgggtgaggccttgaggaggataagggaaggtgcagcaatgataaggactaaaggagaggcgggtacggggaatgtcattgaagctgttaggcatgtgaggtctgtgatgggggatataagggtgttgagaaacatggatgatgatgaggtgtttacctttgccaagaaaattgctgctccttatgatttggttatgcagacaaagcaacttgggaggttgcctgttgtgcaatttgcagcagggggagtggctacccctgctgatgcagcgttgatgatgcagttgggatgtgatggtgtgtttgttgggtctggggtttttaagagtggggaccctgttaagagggggagagctattgtgcaggctgtaacgcattacagtgatcctcaggtgttggcggaggtgagttgtgggcttggtgaggctatggttgggcttaatttgaatgataagaagatcgagaggtttgctagtcggtcggattag

SEQ ID NO: 387 - protein, 309 aa, Populus balsamifera subsp. trichocarpa
  misc_feature (1)..(309): Ceres ANNOT ID no. 1529361
  misc_feature (23)..(228): Pfam Name: SOR_SNZ Pfam Description: SOR/SNZ family
  misc_feature: SWISSPROT Homolog: PDXL3_ARATH Probable pyridoxin biosynthesis PDX1-like protein 3 with e-value of 4.0e-159 and BLAST sequence identity of 99.7
  misc_feature: SWISSPROT Homolog: PDX1_HEVBR Probable pyridoxin biosynthesis protein ER1 (PDX1 homolog) (Ethylene-inducible protein HEVER) with e-value of 3.9e-152 and BLAST sequence identity of 94.2
  misc_feature: SWISSPROT Homolog: PDX1_PHAVU Probable pyridoxin biosynthesis protein PDX1 (pvPDX1) with e-value of 7.8e-147 and BLAST sequence identity of 91.9
  misc_feature: SWISSPROT Homolog: PDXL1_ARATH Probable pyridoxin biosynthesis PDX1-like protein 1 (HEVER-like protein) with e-value of 1.9e-143 and BLAST sequence identity of 88.7
  misc_feature: SWISSPROT Homolog: PDX1_GINBI Pyridoxin biosynthesis protein PDX1 (Sor-like protein) with e-value of 1.8e-138 and BLAST sequence identity of 86.7
  misc_feature: Utility: Mannitol Useful for making plants with enhanced tolerance to drought
  misc_feature 40766:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Mannitol Useful for making plants with enhanced tolerance to drought
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(309): Functional Homolog of  Ceres CLONE ID no. 8877 at SEQ ID NO. 405 with e-value of 1.49E-149 and BLAST sequence identity of 92.2
MAGTGVVAVYGNGAITETKKSPFSVKVGLAQMLRGGVIMDVVTPEQARIAEEAGACAVMALERVPADIRAQGGVARMSDPQLIKEIKQAVTIPVMAKARIGHFVEAQILEAIGIDYIDESEVLTPADEENHINKHNFRIPFVCGCRNLGEALRRIREGAAMIRTKGEAGTGNVIEAVRHVRSVMGDIRVLRNMDDDEVFTFAKKIAAPYDLVMQTKQLGRLPVVQFAAGGVATPADAALMMQLGCDGVFVGSGVFKSGDPVKRGRAIVQAVTHYSDPQVLAEVSCGLGEAMVGLNLNDKKIERFASRSD

SEQ ID NO: 388 - protein, 187 aa, Arabidopsis thaliana
  misc_feature (1)..(187): Ceres CLONE ID no. 8916
  misc_feature: Phenotype: WHOLE PLANT - Dark Green Useful for increasing chlorophyll and photosynthetic capacity
  misc_feature: Phenotype: WHOLE PLANT - Misc. Dwarf Useful for modulating plant size
  misc_feature: Phenotype: FLOWER - Reduced fertility Useful for sterility, genetic confinement systems
MRPLDETETTVVFEKLFKFVGNNLKKIVENPSDEGPESTPGSYCFRLQKNRVYYVSEALVKRATNISRKNLVSFGTCIGKYTHAGSFHLTIMSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 389 - DNA, 417 bp, Populus balsamifera subsp. trichocarpa
  misc_feature (1)..(417): Ceres ANNOT ID no. 1462804
  misc_feature 40973:<222: Transcription Factor
  misc_feature: Phenotype: WHOLE PLANT - Dark Green Useful for increasing chlorophyll and photosynthetic capacity
  misc_feature: Phenotype: WHOLE PLANT - Misc. Dwarf Useful for modulating plant size
  misc_feature: Phenotype: FLOWER - Reduced fertility Useful for sterility, genetic confinement systems
atgaggcctttggacgagaaagagatgggtgaagttttcaagaaactgatgttgttcacaggaaacaacctcaaaaacatcattgaaagcccatcacatgaaggaccagacccgaacccaggtcggtactgcttcaggctccacaaaaacaaggtattttacatcagtgaatcaatagtgaagcgagcaacaaacattggccgcaaaaatttggtatctttaggcgggttagggaagattactgatagtatcaatcaaaatgatggggttgtcgtgttttctatgagtgatgtgcctttggggtttggaaccgccgccaggtcgacacaggattgtaggaagtgtgatcctaatgggattgttgtgcatcactactctgatattggtgagtatttgagagatgaagatgatctttga

SEQ ID NO: 390 - protein, 138 aa, Populus balsamifera subsp. trichocarpa
  misc_feature (1)..(138): Ceres ANNOT ID no. 1462804
  misc_feature: SWISSPROT Homolog: NIP7_RAT 60S ribosome subunit biogenesis protein NIP7 homolog (PEachy) (KD93) with e-value of 6.5e-56 and BLAST sequence identity of 59.9
  misc_feature: SWISSPROT Homolog: NIP7_HUMAN 60S ribosome subunit biogenesis protein NIP7 homolog (KD93) with e-value of 1.3e-55 and BLAST sequence identity of 59.4
  misc_feature: SWISSPROT Homolog: NIP7_MOUSE 60S ribosome subunit biogenesis protein NIP7 homolog (PEachy) (KD93) with e-value of 1.7e-55 and BLAST sequence identity of 59.4
  misc_feature: SWISSPROT Homolog: NIP7_YEAST 60S ribosome subunit biogenesis protein NIP7 with e-value of 3.1e-49 and BLAST sequence identity of 54.0
  misc_feature: SWISSPROT Homolog: Y058_ARCFU Hypothetical UPF0113 protein AF0058 with e-value of 9.6e-07 and BLAST sequence identity of 29.2
  misc_feature 41064:<222: Transcription Factor
  misc_feature: Phenotype: WHOLE PLANT - Dark Green Useful for increasing chlorophyll and photosynthetic capacity
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature (1)..(138): Functional Homolog of  Ceres CLONE ID no. 8916 at SEQ ID NO. 410 with e-value of 2.29E-41 and BLAST sequence identity of 74.6
MRPLDEKEMGEVFKKLMLFTGNNLKNIIESPSHEGPDPNPGRYCFRLHKNKVFYISESIVKRATNIGRKNLVSLGGLGKITDSINQNDGVVVFSMSDVPLGFGTAARSTQDCRKCDPNGIVVHHYSDIGEYLRDEDDL

SEQ ID NO: 391 - protein, 181 aa, Arabidopsis thaliana
  misc_feature (1)..(181): Ceres CLONE ID no. 9132
  misc_feature (75)..(154): Pfam Name: YABBY Pfam Description: YABBY protein
  misc_feature: Phenotype: CAULINE LEAVES - Corkscrew Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: FLOWER - Sterile Useful for sterility, genetic confinement systems
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWATYIPNSPTSITSGGHNMIHGLGFGEKK

SEQ ID NO: 392 - DNA, 543 bp, Populus balsamifera subsp. trichocarpa
  misc_feature (1)..(543): Ceres ANNOT ID no. 1458620
  misc_feature 41265:<222: Transcription Factor
  misc_feature: Phenotype: CAULINE LEAVES - Corkscrew Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: FLOWER - Sterile Useful for sterility, genetic confinement systems
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
atgaacctagaagagaaagcaagcacagaggttccatcatctgagcatctctgctatgtccgttgcaacttctgcaacactgttcttgcggtcgggattccatgcaagaggctgctggacactgtgactgtcaaatgtggtcattgcaataatctctcctttctcagcaccagacctcccaaccaagggcaatgtcttgatcagtaccaccgactgagtctacagggagtttctagtaatgaaaagttcttattcaaggagaagcaagggttttgcactgatatcagaaagggcgaatcctcatcctcctcgacctctagcgaacaaccggtgcccacagtacccttcgtagtaaagccgcctgagaagaaacaccgacttccatctgcttacaataggtttatgaaggaggagataaagcgcatcaaagcagccgatcctgagataccacacagagaagcttttagcacagcagctaaaaattgggctagggctaggtaccttccaaagtcgggtgctggttctgggagccctaataattaa

SEQ ID NO: 393 - protein, 180 aa, Populus balsamifera subsp. trichocarpa
  misc_feature (1)..(180): Ceres ANNOT ID no. 1458620
  misc_feature (8)..(175): Pfam Name: YABBY Pfam Description: YABBY protein
  misc_feature: SWISSPROT Homolog: CRC_ARATH Protein CRABS CLAW with e-value of 1.2e-95 and BLAST sequence identity of 99.4
  misc_feature: SWISSPROT Homolog: YABDL_ORYSA Protein DROOPING LEAF with e-value of 1.1e-42 and BLAST sequence identity of 57.2
  misc_feature: SWISSPROT Homolog: YAB1_ORYSA Protein YABBY (OsYAB1) (Filamentous flower protein 1) with e-value of 3.6e-30 and BLAST sequence identity of 45.6
  misc_feature: SWISSPROT Homolog: YAB2_ARATH Axial regulator YABBY2 with e-value of 2.0e-29 and BLAST sequence identity of 47.0
  misc_feature: SWISSPROT Homolog: YAB5_ARATH Axial regulator YABBY5 with e-value of 2.9e-28 and BLAST sequence identity of 46.4
  misc_feature 41415:<222: Transcription Factor
  misc_feature: Phenotype: CAULINE LEAVES - Corkscrew Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: FLOWER - Sterile Useful for sterility, genetic confinement systems
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(180): Functional Homolog of  Ceres CLONE ID no. 9132 at SEQ ID NO. 413 with e-value of 5.00E-48 and BLAST sequence identity of 71.4
MNLEEKASTEVPSSEHLCYVRCNFCNTVLAVGIPCKRLLDTVTVKCGHCNNLSFLSTRPPNQGQCLDQYHRLSLQGVSSNEKFLFKEKQGFCTDIRKGESSSSSTSSEQPVPTVPFVVKPPEKKHRLPSAYNRFMKEEIKRIKAADPEIPHREAFSTAAKNWARARYLPKSGAGSGSPNN

SEQ ID NO: 394 - protein, 119 aa, Arabidopsis thaliana
  misc_feature (1)..(119): Ceres CLONE ID no. 9221
  misc_feature (55)..(119): Pfam Name: RALF Pfam Description: Rapid ALkalinization Factor (RALF)
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MTNTRAIYAVIAILAIVISAVESTGDFGDSLDFVRAGSSSLFSGCTGSIAECIAEEEEMEFDSDISRRILAQKKYISYGAMRRNSVPCSRRGASYYNCQRGAQANPYSRGCSTITRCRR

SEQ ID NO: 395 - DNA, 339 bp, Populus balsamifera subsp. trichocarpa
  misc_feature (1)..(339): Ceres ANNOT ID no. 1535229
  misc_feature 41634:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgacaacctcaaaattttacattttccttctactttctgcagtcctagccgtccgtgtgtccctatcatcatcaacagcagttgattttctccccttggagtcgtcgtcggagtgccggggatccattgctgaatgcttgatggatgaggagtttgggatggacacagagagcaacaggcgcattctagcaacgtcgaggtacgtaagctatggtgcgctgaggaggaacactgtaccatgttcgagacgcggcgcctcgtattataattgtcgacctggagctcaggctaatccttactctcgcgggtgtagtcgtattacacgctgcaggaattaa

SEQ ID NO: 396 - protein, 112 aa, Populus balsamifera subsp. trichocarpa
  misc_feature (1)..(112): Ceres ANNOT ID no. 1535229
  misc_feature (48)..(112): Pfam Name: RALF Pfam Description: Rapid ALkalinization Factor (RALF)
  misc_feature 41712:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(112): Functional Homolog of  Ceres CLONE ID no. 9221 at SEQ ID NO. 416 with e-value of 2.50E-28 and BLAST sequence identity of 61.4
MTTSKFYIFLLLSAVLAVRVSLSSSTAVDFLPLESSSECRGSIAECLMDEEFGMDTESNRRILATSRYVSYGALRRNTVPCSRRGASYYNCRPGAQANPYSRGCSRITRCRN

SEQ ID NO: 397 - protein, 263 aa, Arabidopsis thaliana
  misc_feature (1)..(263): Ceres CLONE ID no. 9325
  misc_feature (61)..(263): Pfam Name: PsbP Pfam Description: PsbP
MAYSACFLHQSALASSAARSSSSSSSQRHVSLSKPVQIICKAQQSHEDDNSAVSRRLALTLLVGAAAVGSKVSPADAAYGEAANVFGKPKTNTDFLPYNGDGFKVQVPAKWNPSKEIEYPGQVLRFEDNFDATSNLNVMVTPTDKKSITDYGSPGEFLSQVNYLLGKQAYFGETASEGGFDNNAVATANILESSSQEVGGKPYYYLSVLTRTADGDEGGKHQLITATVNGGKLYICKAQAGDKRWFKGARKFVESAATSFSVA

SEQ ID NO: 398 - DNA, 789 bp, Populus balsamifera subsp. trichocarpa
  misc_feature (1)..(789): Ceres ANNOT ID no. 1442982
  misc_feature 41876:<222: Transcription Factor
atggcctccactgcatgcttcttgcaccaccatgcactaaccactcctgccagatcaacctcatcatcacagcgccaagtggttaacctcaagcccgcccagctggtttgcagggcacagaagcaggcagtacaggaagaggatgacggtgttgtgtctcgtagattggcactcactgtgctcattggtgctgctgcccttggctcaaaggttgctcccgctgatgctgcctatggtgaatctgccaatattttcgggaagccaaagacaaacacagacttcttgccctacaatggagatggattcaagttgtcagttccagcaaaatggaatccaagcaaagagagagagttccctggtcaggttctgagatatgaggacaattttgatgccaccagcaacctttctgtcatggtcaccccaactgacacgaaatccatcgccgactacggttcccctgaggaattcctctcgaaggtggattacttgcttggaaaacaatcctccttgtttgcgacttcatctgagggtggtttcgacaccaataccgtagcaacggctaacatattggagacctcaactccggtgatcgatgggaaacaatattacttcttgtcagtgctgacaaggactgctgatggagatgaaggtggcaagcaccaacttatcacagccactgtgaaagatggtaagctttacatttgcaaggcacaagctggagacaagagatggttcaagggagcaagaaagttcgtggagagcgctgcaagttctttcagtgttgcttaa

SEQ ID NO: 399 - protein, 262 aa, Populus balsamifera subsp. trichocarpa
  misc_feature (1)..(262): Ceres ANNOT ID no. 1442982
  misc_feature (60)..(262): Pfam Name: PsbP Pfam Description: PsbP
  misc_feature: SWISSPROT Homolog: PSBP1_ARATH Oxygen-evolving enhancer protein 2-1, chloroplast precursor with e-value of 7.1e-137 and BLAST sequence identity of 99.6
  misc_feature: SWISSPROT Homolog: PSBP1_ARATH Oxygen-evolving enhancer protein 2-1, chloroplast precursor OEE2 (23 kDa subunit of oxygen evolving system of photosystem II) (OEC 23 kDa subunit) (23 kDa thylakoid membrane protein)
  misc_feature: SWISSPROT Homolog: PSBP_SINAL Oxygen-evolving enhancer protein 2-1, chloroplast precursor with e-value of 2.9e-124 and BLAST sequence identity of 89.7
  misc_feature: SWISSPROT Homolog: PSBP_SINAL Oxygen-evolving enhancer protein 2-1, chloroplast precursor OEE2 (23 kDa subunit of oxygen evolving system of photosystem II) (OEC 23 kDa subunit) (23 kDa thylakoid membrane protein)
  misc_feature: SWISSPROT Homolog: PSBP2_ARATH Oxygen-evolving enhancer protein 2-2, chloroplast precursor (OEE2) with e-value of 1.5e-120 and BLAST sequence identity of 86.8
  misc_feature: SWISSPROT Homolog: PSBP2_ARATH 23 kDa subunit of oxygen evolving system of photosystem II OEC 23 kDa subunit 23 kDa thylakoid membrane protein
  misc_feature: SWISSPROT Homolog: PSBP1_TOBAC Oxygen-evolving enhancer protein 2-1, chloroplast precursor with e-value of 3.1e-111 and BLAST sequence identity of 81.0
  misc_feature: SWISSPROT Homolog: PSBP1_TOBAC Oxygen-evolving enhancer protein 2-1, chloroplast precursor OEE2 (23 kDa subunit of oxygen evolving system of photosystem II) (OEC 23 kDa subunit) (23 kDa thylakoid membrane)
  misc_feature: SWISSPROT Homolog: PSBP_LYCES Oxygen-evolving enhancer protein 2-1, chloroplast precursor with e-value of 2.6e-107 and BLAST sequence identity of 79.1
  misc_feature: SWISSPROT Homolog: PSBP_LYCES Oxygen-evolving enhancer protein 2-1, chloroplast precursor OEE2 (23 kDa subunit of oxygen evolving system of photosystem II) (OEC 23 kDa subunit) (23 kDa thylakoid membrane protein)
  misc_feature 42008:<222: Transcription Factor
  misc_feature (1)..(262): Functional Homolog of  Ceres CLONE ID no. 9325 at SEQ ID NO. 419 with e-value of 7.10E-104 and BLAST sequence identity of 76.9
MASTACFLHHHALTTPARSTSSSQRQVVNLKPAQLVCRAQKQAVQEEDDGVVSRRLALTVLIGAAALGSKVAPADAAYGESANIFGKPKTNTDFLPYNGDGFKLSVPAKWNPSKEREFPGQVLRYEDNFDATSNLSVMVTPTDTKSIADYGSPEEFLSKVDYLLGKQSSLFATSSEGGFDTNTVATANILETSTPVIDGKQYYFLSVLTRTADGDEGGKHQLITATVKDGKLYICKAQAGDKRWFKGARKFVESAASSFSVA

SEQ ID NO: 400 - DNA, 789 bp, Populus balsamifera subsp. trichocarpa
  misc_feature (1)..(789): Ceres ANNOT ID no. 1452462
  misc_feature 42085:<222: Transcription Factor
atggcctccacttcatgcttcttgcaccaccatgcactaaccactcctgctagatcaaccccatcatcacaacgccaagtggctaacctcaagcccacccagctggcttgcagagcccaaaagcaggcagtacaggaggaggataatggtgctgtgtctcgcagattggctctcacagtgctcattggtgctgctgcccttggctccaaggtagctcctgctgatgctgcctatggtgaatctgccaatattttcgggaagccaaagacagacacagatttcttgccctacaatggagatggattcaagttgtcagttccatcaaaatggaatccaagcaaggagagagagttccctggtcaggttcttagatacgaggacaacttcgatgccaccagcaacgtttctgtcatggtcatcccaaccgataagaaatccatcaccgactacggttcccctgaggaattcctctccaaggtggatttcttgcttggaaaacaatcctccttgtttgcaaccgcatctgagggtggtttcgaccccaataccgtggcaacagctaacatattggagacatcaactccagtggttggtgggaagcaatatttcttcttgtcagtactgacaaggactgctgatggagatgaaggtggcaagcaccaactgatcacagccactgtgaaagatggcaagctttacatttgcaaggcacaagctggagacaagaggtggttcaagggagcaagaaagttcgtggagagcactgcaagttctttcagtgttgcttaa

SEQ ID NO: 401 - protein, 262 aa, Populus balsamifera subsp. trichocarpa
  misc_feature (1)..(262): Ceres ANNOT ID no. 1452462
  misc_feature (60)..(262): Pfam Name: PsbP Pfam Description: PsbP
  misc_feature: SWISSPROT Homolog: PSBP1_ARATH Oxygen-evolving enhancer protein 2-1, chloroplast precursor with e-value of 7.1e-137 and BLAST sequence identity of 99.6
  misc_feature: SWISSPROT Homolog: PSBP1_ARATH Oxygen-evolving enhancer protein 2-1, chloroplast precursor OEE2 (23 kDa subunit of oxygen evolving system of photosystem II) (OEC 23 kDa subunit) (23 kDa thylakoid membrane protein)
  misc_feature: SWISSPROT Homolog: PSBP_SINAL Oxygen-evolving enhancer protein 2-1, chloroplast precursor with e-value of 2.9e-124 and BLAST sequence identity of 89.7
  misc_feature: SWISSPROT Homolog: PSBP_SINAL Oxygen-evolving enhancer protein 2-1, chloroplast precursor OEE2 (23 kDa subunit of oxygen evolving system of photosystem II) (OEC 23 kDa subunit) (23 kDa thylakoid membrane protein)
  misc_feature: SWISSPROT Homolog: PSBP2_ARATH Oxygen-evolving enhancer protein 2-2, chloroplast precursor (OEE2) with e-value of 1.5e-120 and BLAST sequence identity of 86.8
  misc_feature: SWISSPROT Homolog: PSBP1_TOBAC Oxygen-evolving enhancer protein 2-1, chloroplast precursor with e-value of 3.1e-111 and BLAST sequence identity of 81.0
  misc_feature: SWISSPROT Homolog: PSBP1_TOBAC Oxygen-evolving enhancer protein 2-1, chloroplast precursor OEE2 (23 kDa subunit of oxygen evolving system of photosystem II) (OEC 23 kDa subunit) (23 kDa thylakoid membrane)
  misc_feature: SWISSPROT Homolog: PSBP_LYCES Oxygen-evolving enhancer protein 2-1, chloroplast precursor with e-value of 2.6e-107 and BLAST sequence identity of 79.1
  misc_feature: SWISSPROT Homolog: PSBP_LYCES Oxygen-evolving enhancer protein 2-1, chloroplast precursor OEE2 (23 kDa subunit of oxygen evolving system of photosystem II) (OEC 23 kDa subunit) (23 kDa thylakoid membrane protein)
  misc_feature 42208:<222: Transcription Factor
  misc_feature (1)..(262): Functional Homolog of  Ceres CLONE ID no. 9325 at SEQ ID NO. 419 with e-value of 6.40E-103 and BLAST sequence identity of 76.1
MASTSCFLHHHALTTPARSTPSSQRQVANLKPTQLACRAQKQAVQEEDNGAVSRRLALTVLIGAAALGSKVAPADAAYGESANIFGKPKTDTDFLPYNGDGFKLSVPSKWNPSKEREFPGQVLRYEDNFDATSNVSVMVIPTDKKSITDYGSPEEFLSKVDFLLGKQSSLFATASEGGFDPNTVATANILETSTPVVGGKQYFFLSVLTRTADGDEGGKHQLITATVKDGKLYICKAQAGDKRWFKGARKFVESTASSFSVA

SEQ ID NO: 402 - protein, 261 aa, Arabidopsis thaliana
  misc_feature (1)..(261): Ceres CLONE ID no. 9683
  misc_feature (10)..(177): Pfam Name: adh_short Pfam Description: short chain dehydrogenase
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
MSGLRRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMST

SEQ ID NO: 403 - DNA, 789 bp, Populus balsamifera subsp. trichocarpa
  misc_feature (1)..(789): Ceres ANNOT ID no. 1471514
  misc_feature 42427:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
atgtctaagccaaggttggaaggcaaggttgcactgattactggtgcagctagcgggatcggcgaggaggcagtgaagttatttgttgagaatggaggttttgttgttgctgcagatgtccaggatgatttagggcatcaagtagtagcatcgataggggctgatagagctacttaccgccactgcgatgtaagagatgagaagcaagttgaggaaacagtgaaatacatcatggataaatatgggaagcttgatgttttattcagcaatgctggcatcattggcccattaacagggatcctagaacttgacattgaaggttttgacaacaccatggctacaaatgtacggggagttgcagcaacaattaagcacgcagcccgtgccatggtgtctaaaaacattcggggatctattatatgcacgactagcgttgcgtcctcgcttgctggaacaggaccccatgcttataccacatcgaagcacgctctggttggtctagtcagggcggcttgcagtgagctaggggcttatgggattagagtcaattgcatttctccttatggggttgcgacaccactttcttgtagagcttataatttgcaacctagtgaagttgaagctaatagctgtgccttggccaacttgaagggtattgtattgaaggctaggcatatagccgaagctgctttgtttctcgcttccgatgaatcagcttacataagtggacacaacttggccgttgacggaggattcacggttgttaatcacagtttttcagccatctga

SEQ ID NO: 404 - protein, 262 aa, Populus balsamifera subsp. trichocarpa
  misc_feature (1)..(262): Ceres ANNOT ID no. 1471514
  misc_feature (9)..(176): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 52.6
  misc_feature: SWISSPROT Homolog: LINC_PSEPA 2,5-dichloro-2,5-cyclohexadiene-1,4-diol dehydrogenase (EC 1.1.1.-)EC.1.1.1.- (2,5-DDOL dehydrogenase) with e-value of 8.5e-38 and BLAST sequence identity of 37.5
  misc_feature: SWISSPROT Homolog: BACC2_BACSU Bacilysin biosynthesis oxidoreductase bacC (EC 1.-.-.-) with e-value of 1.9e-33 and BLAST sequence identity of 35.1
  misc_feature: SWISSPROT Homolog: Y325_THEMA Hypothetical oxidoreductase TM0325 (EC 1.-.-.-) with e-value of 2.2e-32 and BLAST sequence identity of 39.1
  misc_feature: SWISSPROT Homolog: BACC_BACSU Bacilysin biosynthesis oxidoreductase bacC (EC 1.-.-.-) with e-value of 5.7e-32 and BLAST sequence identity of 34.3
  misc_feature 42588:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
  misc_feature (1)..(262): Functional Homolog of  Ceres CLONE ID no. 9683 at SEQ ID NO. 424 with e-value of 1.70E-79 and BLAST sequence identity of 61.2
MSKPRLEGKVALITGAASGIGEEAVKLFVENGGFVVAADVQDDLGHQVVASIGADRATYRHCDVRDEKQVEETVKYIMDKYGKLDVLFSNAGIIGPLTGILELDIEGFDNTMATNVRGVAATIKHAARAMVSKNIRGSIICTTSVASSLAGTGPHAYTTSKHALVGLVRAACSELGAYGIRVNCISPYGVATPLSCRAYNLQPSEVEANSCALANLKGIVLKARHIAEAALFLASDESAYISGHNLAVDGGFTVVNHSFSAI

SEQ ID NO: 405 - protein, 140 aa, Arabidopsis thaliana
  misc_feature (1)..(140): Ceres CLONE ID no. 9897
  misc_feature (19)..(140): Pfam Name: Ribosomal_L14 Pfam Description: Ribosomal protein L14p/L23e
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
MSKRGRGGTSGNKFRMSLGLPVAATVNCADNTGAKNLYIISVKGIKGRLNRLPSACVGDMVMATVKKGKPDLRKKVLPAVIVRQRKPWRRKDGVFMYFEDNAGVIVNPKGDMKGSAITGPIGKECADLWPRIASAANAIV

SEQ ID NO: 406 - DNA, 423 bp, Populus balsamifera subsp. trichocarpa
  misc_feature (1)..(423): Ceres ANNOT ID no. 1445849
  misc_feature 42853:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
atgtcgaagcgaggaaggggaggatcggccggaaacaagttccgcatgtcgctgggtcttccggtggcggcgacggtgaactgcgctgacaacactggagcgaagaatctctatatcatatcagtgaaaggaatcaaaggtcgcctcaaccgtttgccgtcggcttgcgtcggagacatggtgatggctacagtgaagaaaggaaaacctgatctcaggaagaaggtgatgcctgctgtcattgttaggcagagaaagccttggcgcagaaaggacggtgttttcatgtattttgaagataatgctggtgttattgtcaatcccaagggagaaatgaaaggatctgccatcactggacccatcggcaaggaatgtgctgatttgtggccaagaattgccagtgctgccaatgccatcgtctga

SEQ ID NO: 407 - protein, 140 aa, Populus balsamifera subsp. trichocarpa
  misc_feature (1)..(140): Ceres ANNOT ID no. 1445849
  misc_feature (19)..(140): Pfam Name: Ribosomal_L14 Pfam Description: Ribosomal protein L14p/L23e
  misc_feature: SWISSPROT Homolog: RL23_ARATH 60S ribosomal protein L23 with e-value of 1.1e-71 and BLAST sequence identity of 99.3
  misc_feature: SWISSPROT Homolog: RL23_TOBAC 60S ribosomal protein L23 with e-value of 1.1e-69 and BLAST sequence identity of 95.0
  misc_feature: SWISSPROT Homolog: RL23_TORRU 60S ribosomal protein L23 (L17) with e-value of 5.0e-65 and BLAST sequence identity of 90.0
  misc_feature: SWISSPROT Homolog: RL23_BRARE 60S ribosomal protein L23 with e-value of 1.8e-60 and BLAST sequence identity of 84.9
  misc_feature: SWISSPROT Homolog: RL23_HUMAN 60S ribosomal protein L23 (Ribosomal protein L17) with e-value of 3.7e-60 and BLAST sequence identity of 84.2
  misc_feature 43000:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature (1)..(140): Functional Homolog of  Ceres CLONE ID no. 9897 at SEQ ID NO. 427 with e-value of 8.20E-71 and BLAST sequence identity of 97.1
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 408 - DNA, 441 bp, Populus balsamifera subsp. trichocarpa
  misc_feature (1)..(441): Ceres ANNOT ID no. 1500561
  misc_feature 43123:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
atggatatgcaagtggagcagtgtatgcgcgcagcccaggttaaaaaacaattattaaaaaactcaatactctccctgcataacctttacatcatatttgtgaagggaattaagggtcgcttgaaccgcttgtcttctgcctgcgttggtgatatggtcatggccactgtcaagaaggggaagcctgatctcagaaagaaggttatgcctgctgtcattgttaggcagcgtaagccttggcgccgaaaggatagtgttttcatgtattttgaagataatgctggtgtcattgtgaaccccaaaggagaaatgaaaggctcagcaattaccggtccaattgggaaggagtgtgctgatctttggcctaggattgcaagtgcagctaaagctaagagctttaatttgtctgttccttttttttgggaattatactgtcgttaa

SEQ ID NO: 409 - protein, 138 aa, Populus balsamifera subsp. trichocarpa
  misc_feature (1)..(138): Ceres ANNOT ID no. 1500561
  misc_feature (20)..(121): Pfam Name: Ribosomal_L14 Pfam Description: Ribosomal protein L14p/L23e
  misc_feature: SWISSPROT Homolog: RL23_ARATH 60S ribosomal protein L23 with e-value of 1.1e-71 and BLAST sequence identity of 99.3
  misc_feature: SWISSPROT Homolog: RL23_TOBAC 60S ribosomal protein L23 with e-value of 1.1e-69 and BLAST sequence identity of 95.0
  misc_feature: SWISSPROT Homolog: RL23_TORRU 60S ribosomal protein L23 (L17) with e-value of 5.0e-65 and BLAST sequence identity of 90.0
  misc_feature: SWISSPROT Homolog: RL23_BRARE 60S ribosomal protein L23 with e-value of 1.8e-60 and BLAST sequence identity of 84.9
  misc_feature: SWISSPROT Homolog: RL23_HUMAN 60S ribosomal protein L23 (Ribosomal protein L17) with e-value of 3.7e-60 and BLAST sequence identity of 84.2
  misc_feature 43270:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature (1)..(138): Functional Homolog of  Ceres CLONE ID no. 9897 at SEQ ID NO. 427 with e-value of 9.00E-49 and BLAST sequence identity of 94.1
MRAAQVKKQLLKNSILSLHNLYIIFVKGIKGRLNRLSSACVGDMVMATVKKGKPDLRKKVMPAVIVRQRKPWRRKDSVFMYFEDNAGVIVNPKGEMKGSAITGPIGKECADLWPRIASAAKAKSFNLSVPFFWELYCR

SEQ ID NO: 410 - DNA, 438 bp, Populus balsamifera subsp. trichocarpa
  misc_feature (1)..(438): Ceres ANNOT ID no. 1464458
  misc_feature 43393:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
atggaaaataattctacgataactgggcttccaagaattgataccatattgataaaatcaagggcggaggagtataggaggctaaggtgggctgtagcccagggaattaagggtcgcttgaaccgcttgccttctgcctgcgttggtgatatggtaatggccactgtcaagaaggggaagcctgatctcaggaagaaggttatgcctgctgtcattgttaggcagcgtaagccttggcgtcgaaaggatggtattttcatgtattttgaagataatgctggtgtcattgtgaaccccaaaggagaaatgaaaggctcagcaattaccggtccaattggaaaggagtgtgctgatctttggcctaggattgcaagtgcagctaatgctaagagctttaatttgtctgttccttttctttgggaatcatactctcgttaa

SEQ ID NO: 411 - protein, 145 aa, Populus balsamifera subsp. trichocarpa
  misc_feature (1)..(145): Ceres ANNOT ID no. 1464458
  misc_feature (35)..(127): Pfam Name: Ribosomal_L14 Pfam Description: Ribosomal protein L14p/L23e
  misc_feature: SWISSPROT Homolog: RL23_ARATH 60S ribosomal protein L23 with e-value of 1.1e-71 and BLAST sequence identity of 99.3
  misc_feature: SWISSPROT Homolog: RL23_TOBAC 60S ribosomal protein L23 with e-value of 1.1e-69 and BLAST sequence identity of 95.0
  misc_feature: SWISSPROT Homolog: RL23_TORRU 60S ribosomal protein L23 (L17) with e-value of 5.0e-65 and BLAST sequence identity of 90.0
  misc_feature: SWISSPROT Homolog: RL23_BRARE 60S ribosomal protein L23 with e-value of 1.8e-60 and BLAST sequence identity of 84.9
  misc_feature: SWISSPROT Homolog: RL23_HUMAN 60S ribosomal protein L23 (Ribosomal protein L17) with e-value of 3.7e-60 and BLAST sequence identity of 84.2
  misc_feature 43540:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature (1)..(145): Functional Homolog of  Ceres CLONE ID no. 9897 at SEQ ID NO. 427 with e-value of 1.69E-47 and BLAST sequence identity of 95.8
MENNSTITGLPRIDTILIKSRAEEYRRLRWAVAQGIKGRLNRLPSACVGDMVMATVKKGKPDLRKKVMPAVIVRQRKPWRRKDGIFMYFEDNAGVIVNPKGEMKGSAITGPIGKECADLWPRIASAANAKSFNLSVPFLWESYSR

SEQ ID NO: 412 - protein, 114 aa, Arabidopsis thaliana
  misc_feature (1)..(114): Ceres CLONE ID no. 10044
  misc_feature: Utility: ABA Useful for making plants with enhanced tolerance to drought
  misc_feature: Utility: PEG Useful for making plants with increased tolerance to drought
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
MFRAMSTRKVHGGYEKLGDEEARLKRVSSVPASVYGHSRNPVQEVKKTPTAKPTGGSVHPLFSFFDVHFQRKKKKTTKKKSLATAKPEFARYMEYVREGGVWDPSSNAPVIHYR

SEQ ID NO: 413 - DNA, 324 bp, Populus balsamifera subsp. trichocarpa
  misc_feature (1)..(324): Ceres ANNOT ID no. 1510467
  misc_feature: Utility: ABA Useful for making plants with enhanced tolerance to drought
  misc_feature: Utility: PEG Useful for making plants with increased tolerance to drought
  misc_feature 43743:<222: Transcription Factor
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
atgttgagagcattgagcacatgcaggaaccatgggggttatgaaaggttagttgacgagcctgttaacataagtctattggatgggaagttgaagagggctaaaagcgtaccagctagtgtttttggctcatcaaagtcacgaaagttgggaccagaactggcccttcaaaatatttttccggcgaagcctagcagcagaaaggttagcaagagtcatccactgtttagtctcttcaataatcgtagaaagaagaaacctacggctaggccagaatttgctaggtacttgcagtatgtgaaggaaggagggatatggctctga

SEQ ID NO: 414 - protein, 107 aa, Populus balsamifera subsp. trichocarpa
  misc_feature (1)..(107): Ceres ANNOT ID no. 1510467
  misc_feature: Utility: ABA Useful for making plants with enhanced tolerance to drought
  misc_feature: Utility: PEG Useful for making plants with increased tolerance to drought
  misc_feature 43799:<222: Transcription Factor
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
  misc_feature (1)..(107): Functional Homolog of  Ceres CLONE ID no. 10044 at SEQ ID NO. 434 with e-value of 1.60E-17 and BLAST sequence identity of 57.6
MLRALSTCRNHGGYERLVDEPVNISLLDGKLKRAKSVPASVFGSSKSRKLGPELALQNIFPAKPSSRKVSKSHPLFSLFNNRRKKKPTARPEFARYLQYVKEGGIWL

SEQ ID NO: 415 - DNA, 333 bp, Populus balsamifera subsp. trichocarpa
  misc_feature (1)..(333): Ceres ANNOT ID no. 1457266
  misc_feature: Utility: ABA Useful for making plants with enhanced tolerance to drought
  misc_feature: Utility: PEG Useful for making plants with increased tolerance to drought
  misc_feature 43872:<222: Transcription Factor
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
atgttgagagcattgagcacatgcaggaaccatgggggttatgaaaggttagttgacgagcctgttaacataagtctattggatgggaagttgaagagggctaaaagcgtaccagctagtgtttttggctcatcaaagtcacgaaagttgggaccagaactggcccttcaaaatatttttccggcgaagcctagcagcagaaaggttagcaagagtcatccactgtttagtctcttcaataatcgtagaaagaagaaacctacggctaggccagaatttgctagctgtccaatcgttctcgtctctggcaagcgagttgagaatcaattatga

SEQ ID NO: 416 - protein, 110 aa, Populus balsamifera subsp. trichocarpa
  misc_feature (1)..(110): Ceres ANNOT ID no. 1457266
  misc_feature: Utility: ABA Useful for making plants with enhanced tolerance to drought
  misc_feature: Utility: PEG Useful for making plants with increased tolerance to drought
  misc_feature 43928:<222: Transcription Factor
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
  misc_feature (1)..(110): Functional Homolog of  Ceres CLONE ID no. 10044 at SEQ ID NO. 434 with e-value of 3.70E-11 and BLAST sequence identity of 56.25
MLRALSTCRNHGGYERLVDEPVNISLLDGKLKRAKSVPASVFGSSKSRKLGPELALQNIFPAKPSSRKVSKSHPLFSLFNNRRKKKPTARPEFASCPIVLVSGKRVENQL

SEQ ID NO: 417 - DNA, 366 bp, Populus balsamifera subsp. trichocarpa
  misc_feature (1)..(366): Ceres ANNOT ID no. 1457267
  misc_feature: Utility: ABA Useful for making plants with enhanced tolerance to drought
  misc_feature: Utility: PEG Useful for making plants with increased tolerance to drought
  misc_feature 44001:<222: Transcription Factor
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
atgttgagagcattgagcacatgcaggaaccatgggggttatgaaaggttagttgacgagcctgttaacataagtctattggatgggaagttgaagagggctaaaagcgtaccagctagtgtttttggctcatcaaagtcacgaaagttgggaccagaactggcccttcaaaatatttttccggcgaagcctagcagcagaaaggttagcaagagtcatccactgtttagtctcttcaataatcgtagaaagaagaaacctacggctaggccagaatttgctagctgtccaatcgttctcttctctggcatatttaccataaatggaggcttggaacaagttcaactcagaagagcggtagcctga

SEQ ID NO: 418 - protein, 121 aa, Populus balsamifera subsp. trichocarpa
  misc_feature (1)..(121): Ceres ANNOT ID no. 1457267
  misc_feature: Utility: ABA Useful for making plants with enhanced tolerance to drought
  misc_feature: Utility: PEG Useful for making plants with increased tolerance to drought
  misc_feature 44059:<222: Transcription Factor
  misc_feature: Phenotype: WHOLE PLANT - ABA Useful for making plants with enhanced tolerance to drought
  misc_feature: Phenotype: WHOLE PLANT - PEG Useful for making plants with increased tolerance to drought
  misc_feature (1)..(121): Functional Homolog of  Ceres CLONE ID no. 10044 at SEQ ID NO. 434 with e-value of 3.70E-11 and BLAST sequence identity of 56.25
MLRALSTCRNHGGYERLVDEPVNISLLDGKLKRAKSVPASVFGSSKSRKLGPELALQNIFPAKPSSRKVSKSHPLFSLFNNRRKKKPTARPEFASCPIVLFSGIFTINGGLEQVQLRRAVA

SEQ ID NO: 419 - protein, 164 aa, Arabidopsis thaliana
  misc_feature (1)..(164): Ceres CLONE ID no. 10072
  misc_feature (1)..(140): Pfam Name: Gp_dh_C Pfam Description: Glyceraldehyde 3-phosphate dehydrogenase C-terminal domain
  misc_feature: Utility: Cold Germination Useful for making plants with increased tolerance to cold stress
  misc_feature: Phenotype: WHOLE PLANT - Cold Germination Useful for making plants with increased tolerance to cold stress
MTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 420 - DNA, 1143 bp, Populus balsamifera subsp. trichocarpa
  misc_feature (1)..(1143): Ceres ANNOT ID no. 1458457
  misc_feature: Utility: Cold Germination Useful for making plants with increased tolerance to cold stress
  misc_feature 44197:<222: Transcription Factor
  misc_feature: Phenotype: WHOLE PLANT - Cold Germination Useful for making plants with increased tolerance to cold stress
atgccttttcttcacgctaattctgaaacatttgaaccattcagtacatgcagtggaaggagcatccaacccatcaaagccacagctaccgaaatgcccccaacagttttaagatcacgggctgatggaaagacgaagattggaatcaatggttttggacgaattggtagattggtattgcgagtagcaactttcagggatgatattgatgtggtggcagtgaatgatcccttcattgatgctgagtacatggcttatatgttcagatatgattctactcatggagttttcaatggaaccatcaaggttctggatgattccaccttggaaatcaatgggaaacaaataaaaattacaagcaaaagggatcctgcagagatcccttggggtgattttggggctgagtttgtggttgaatcatctggtgtcttcaccacacttgagaaggctgcagctcacaagaagggtggtgccaagaaagtggtcatatcagctccctcagctgatgctccgatgtttgtagttggagtaaatgagaagacatacaagccaaacatggacgttgtttctaatgcaagctgcactaccaattgccttgctcctcttgcgaaggttgttcatgaggaatttggtatccttgaaggtttaatgacaaccgtccatgcaaccacagcaactcaaaagactgtagatggtccatcaatgaaggattggcgtggggggcgaggagccgcgcaaaatatcattcctagttccactggcgcagcaaaggctgttggaaaagttcttccagaactcaatggaaaacttactggaatggccttccgtgtcccaactcctaatgtttctgttgtggacttaacttgtcgacttgagaagagtgcatcatatgaagatgtcaaggcagctattaagtatgcatcagagggcccacttatgggcattcttggttatactgatgatgatgttgtctccaatgattttgttggcgactcaaggtcaagcatatttgatgccaaagctgggatagggttgagcgcttccttcatgaagcttgtttcttggtatgacaacgagtggggttacagcaaccgagtgctggacctgattgagcacatggcactggtggcagcgcataattaa

SEQ ID NO: 421 - protein, 297 aa, Populus balsamifera subsp. trichocarpa
  misc_feature (1)..(297): Ceres ANNOT ID no. 1458457
  misc_feature (1)..(111): Pfam Name: Gp_dh_N Pfam Description: Glyceraldehyde 3-phosphate dehydrogenase NAD binding domain
  misc_feature (116)..(273): Pfam Name: Gp_dh_C Pfam Description: Glyceraldehyde 3-phosphate dehydrogenase C-terminal domain
  misc_feature: SWISSPROT Homolog: G3PC_TOBAC Glyceraldehyde-3-phosphate dehydrogenase, cytosolic (EC 1.2.1.12) (Fragment) with e-value of 1.1e-67 and BLAST sequence identity of 83.9
  misc_feature: SWISSPROT Homolog: G3PC_MAIZE Glyceraldehyde-3-phosphate dehydrogenase, cytosolic 1 (EC 1.2.1.12) with e-value of 2.3e-67 and BLAST sequence identity of 83.4
  misc_feature: SWISSPROT Homolog: G3PC_PETCR Glyceraldehyde-3-phosphate dehydrogenase, cytosolic (EC 1.2.1.12) with e-value of 3.0e-67 and BLAST sequence identity of 82.0
  misc_feature: SWISSPROT Homolog: G3P_PODAN Glyceraldehyde-3-phosphate dehydrogenase (EC 1.2.1.12) (GAPDH) with e-value of 3.8e-67 and BLAST sequence identity of 79.3
  misc_feature: SWISSPROT Homolog: G3PD_MAIZE Glyceraldehyde-3-phosphate dehydrogenase, cytosolic 2 (EC 1.2.1.12) with e-value of 4.8e-67 and BLAST sequence identity of 82.8
  misc_feature: Utility: Cold Germination Useful for making plants with increased tolerance to cold stress
  misc_feature 44322:<222: Transcription Factor
  misc_feature: Phenotype: WHOLE PLANT - Cold Germination Useful for making plants with increased tolerance to cold stress
  misc_feature (1)..(297): Functional Homolog of  Ceres CLONE ID no. 10072 at SEQ ID NO. 441 with e-value of 1.90E-78 and BLAST sequence identity of 94.4
MAYMFRYDSTHGVFNGTIKVLDDSTLEINGKQIKITSKRDPAEIPWGDFGAEFVVESSGVFTTLEKAAAHKKGGAKKVVISAPSADAPMFVVGVNEKTYKPNMDVVSNASCTTNCLAPLAKVVHEEFGILEGLMTTVHATTATQKTVDGPSMKDWRGGRGAAQNIIPSSTGAAKAVGKVLPELNGKLTGMAFRVPTPNVSVVDLTCRLEKSASYEDVKAAIKYASEGPLMGILGYTDDDVVSNDFVGDSRSSIFDAKAGIGLSASFMKLVSWYDNEWGYSNRVLDLIEHMALVAAHN

SEQ ID NO: 422 - DNA, 1356 bp, Populus balsamifera subsp. trichocarpa
  misc_feature (1)..(1356): Ceres ANNOT ID no. 1464514
  misc_feature: Utility: Cold Germination Useful for making plants with increased tolerance to cold stress
  misc_feature 44418:<222: Transcription Factor
  misc_feature: Phenotype: WHOLE PLANT - Cold Germination Useful for making plants with increased tolerance to cold stress
atggctttctcttgtcttctcagatctacgcccgccgctcctcttgttgaagcttcccgctccgacttctctccttcaccgtccgatcgattcaagctgatgagtggtgtgaagtgccagttactatttagagatgtgtctagcgttagttttaactctttgaagagcatttttggcacttcaattccaacagggtcatcttcctcacagttgagtactgaagaatttgatattaaaatctccacatatatatataggacatgcagtggaaggagcatccaacccatcaaggccacagctaccgaaatgcctcccacagttttaaaatcgcgggctgatggaaagacgaagattggaatcaatggttttggtcgtattggtagattggttttgcgagtagcaactttcagggatgatattgatgtggtggcagtgaacgatcctttcattgatgctaactacatggcttacatgtttaaatatgattctactcatggcgttttcagtggaaccatcaaggtcttagatgattccaacttggaaatcaatgggaagcaaatcaaaattacaagcaaaagggatcccacagagatcccttggggtgattttggggccgagtatgtggttgaatcatctggtattttcactacagttgagaaggctgcagctcacatgaagggtggtgcgaagaaagtggtcatatcagctccctcagctgatgctccgatgtttgtagttggagtaaatgagaagacatacaagccaaacatggacattgtttccaatgcaagttgcactaccaattgccttgctcctcttgctaaggttgttcatgaggaatttggtatcattgaaggtttaatgacaactgtccatgcaaccacagcaactcaaaagactgtagatggtccatcaaggaaggattggcgtggtggccgaggagcagcacaaaatatcattcccagttccactggcgctgcaaaggctgttggaaaagttcttccagaactcaacggaaaacttactggaatggccttccgtgtcccaacacctaatgtttctgtcgtggacttaacttgtcgacttgagaagagtgcatcatatgaagatgtcaaggcagctattaagtacgcatcagaaggcccacttaagggcattcttgggtatactgacgatgatgttgtctccagtgattttcttggtgactcaaggtcaagcatatttgatgccaaagctggtataggattgagtgcttccttcatgaagcttgtttcttggtacgacaacgagtggggttacagcaaccgagtgctggaccttatcgagcacatggcgttggtggcagcacacaattaa

SEQ ID NO: 423 - protein, 349 aa, Populus balsamifera subsp. trichocarpa
  misc_feature (1)..(349): Ceres ANNOT ID no. 1464514
  misc_feature (14)..(43): Pfam Name: DapB_N Pfam Description: Dihydrodipicolinate reductase, N-terminus
  misc_feature (168)..(325): Pfam Name: Gp_dh_C Pfam Description: Glyceraldehyde 3-phosphate dehydrogenase C-terminal domain
  misc_feature: SWISSPROT Homolog: G3PC_TOBAC Glyceraldehyde-3-phosphate dehydrogenase, cytosolic (EC 1.2.1.12) (Fragment) with e-value of 1.1e-67 and BLAST sequence identity of 83.9
  misc_feature: SWISSPROT Homolog: G3PC_MAIZE Glyceraldehyde-3-phosphate dehydrogenase, cytosolic 1 (EC 1.2.1.12) with e-value of 2.3e-67 and BLAST sequence identity of 83.4
  misc_feature: SWISSPROT Homolog: G3PC_PETCR Glyceraldehyde-3-phosphate dehydrogenase, cytosolic (EC 1.2.1.12) with e-value of 3.0e-67 and BLAST sequence identity of 82.0
  misc_feature: SWISSPROT Homolog: G3P_PODAN Glyceraldehyde-3-phosphate dehydrogenase (EC 1.2.1.12) (GAPDH) with e-value of 3.8e-67 and BLAST sequence identity of 79.3
  misc_feature: SWISSPROT Homolog: G3PD_MAIZE Glyceraldehyde-3-phosphate dehydrogenase, cytosolic 2 (EC 1.2.1.12) with e-value of 4.8e-67 and BLAST sequence identity of 82.8
  misc_feature: Utility: Cold Germination Useful for making plants with increased tolerance to cold stress
  misc_feature 44548:<222: Transcription Factor
  misc_feature: Phenotype: WHOLE PLANT - Cold Germination Useful for making plants with increased tolerance to cold stress
  misc_feature (1)..(349): Functional Homolog of  Ceres CLONE ID no. 10072 at SEQ ID NO. 441 with e-value of 1.30E-77 and BLAST sequence identity of 93.2
MPPTVLKSRADGKTKIGINGFGRIGRLVLRVATFRDDIDVVAVNDPFIDANYMAYMFKYDSTHGVFSGTIKVLDDSNLEINGKQIKITSKRDPTEIPWGDFGAEYVVESSGIFTTVEKAAAHMKGGAKKVVISAPSADAPMFVVGVNEKTYKPNMDIVSNASCTTNCLAPLAKVVHEEFGIIEGLMTTVHATTATQKTVDGPSRKDWRGGRGAAQNIIPSSTGAAKAVGKVLPELNGKLTGMAFRVPTPNVSVVDLTCRLEKSASYEDVKAAIKYASEGPLKGILGYTDDDVVSSDFLGDSRSSIFDAKAGIGLSASFMKLVSWYDNEWGYSNRVLDLIEHMALVAAHN

SEQ ID NO: 424 - DNA, 1053 bp, Populus balsamifera subsp. trichocarpa
  misc_feature (1)..(1053): Ceres ANNOT ID no. 1493574
  misc_feature: Utility: Cold Germination Useful for making plants with increased tolerance to cold stress
  misc_feature 44653:<222: Transcription Factor
  misc_feature: Phenotype: WHOLE PLANT - Cold Germination Useful for making plants with increased tolerance to cold stress
atggccaagattaagatcggtatcaacggtgagcgattcaacgtcgtcgtcgttgtgtttagtgtttttattttgttttttaaaatcaaattaaatgtaggttttggaaggatcgggcgtttggtggcgagagttgctttgcagagagatgatgttgagcttgtcgctacctacatgttcaaatatgacactgttcatgggcaatggaagcacggagatatcaaggtcaaggatgagaagactcttctttttggtgacaagccagtcgctgtttttggtgtcagaaacccagaggagattccatggggcgctgctggtgctgattttgttgttgagtccactggtgttttcactgacaaggacaaagctgctgctcatttgaagggtggtgcaaagaaggttattatttctgctcctagtaaggatgctcccatgtttgttatgggtgtcaatgagaaggagtacaagcctgatctcaacattgtttccaatgccagctgcactaccaactgccttgctcctttggccaaggtcattcatgacaagtttggtattgttgagggtcttatgactactgtccactccattactgccacacaaaagactgttgatggaccatcaatgaaggattggagaggtggtagagctgcttccttcaatatcattcccagcagcactggagctgctaaggcagtagggaaagttttgcctgcactcaatggaaagttgactggaatggctttccgtgttcccacagttgatgtctcagtggttgacctcactgtgagaattgagaagaaggctacatatgaccagatcaaagcagctatcaaggaggaatctgagaccaatctgaagggaatccttggttacactgaggatgatgttgtctcaaccgacttcatgggtgacagcaggtcaagcatatttgatgccaaggctggaattgcattgaatgataactttgtgaagcttgtctcctggtatgacaatgaatggggctacagctctcgcgtgattgacttgatcattcatatcgcctctgtgcaataa

SEQ ID NO: 425 - protein, 350 aa, Populus balsamifera subsp. trichocarpa
  misc_feature (1)..(350): Ceres ANNOT ID no. 1493574
  misc_feature (172)..(329): Pfam Name: Gp_dh_C Pfam Description: Glyceraldehyde 3-phosphate dehydrogenase C-terminal domain
  misc_feature (4)..(10): Pfam Name: Gp_dh_N Pfam Description: Glyceraldehyde 3-phosphate dehydrogenase NAD binding domain
  misc_feature: SWISSPROT Homolog: G3PC_TOBAC Glyceraldehyde-3-phosphate dehydrogenase, cytosolic (EC 1.2.1.12) (Fragment) with e-value of 1.1e-67 and BLAST sequence identity of 83.9
  misc_feature: SWISSPROT Homolog: G3PC_MAIZE Glyceraldehyde-3-phosphate dehydrogenase, cytosolic 1 (EC 1.2.1.12) with e-value of 2.3e-67 and BLAST sequence identity of 83.4
  misc_feature: SWISSPROT Homolog: G3PC_PETCR Glyceraldehyde-3-phosphate dehydrogenase, cytosolic (EC 1.2.1.12) with e-value of 3.0e-67 and BLAST sequence identity of 82.0
  misc_feature: SWISSPROT Homolog: G3P_PODAN Glyceraldehyde-3-phosphate dehydrogenase (EC 1.2.1.12) (GAPDH) with e-value of 3.8e-67 and BLAST sequence identity of 79.3
  misc_feature: SWISSPROT Homolog: G3PD_MAIZE Glyceraldehyde-3-phosphate dehydrogenase, cytosolic 2 (EC 1.2.1.12) with e-value of 4.8e-67 and BLAST sequence identity of 82.8
  misc_feature: Utility: Cold Germination Useful for making plants with increased tolerance to cold stress
  misc_feature 44774:<222: Transcription Factor
  misc_feature: Phenotype: WHOLE PLANT - Cold Germination Useful for making plants with increased tolerance to cold stress
  misc_feature (1)..(350): Functional Homolog of  Ceres CLONE ID no. 10072 at SEQ ID NO. 441 with e-value of 1.89E-64 and BLAST sequence identity of 80.0
MAKIKIGINGERFNVVVVVFSVFILFFKIKLNVGFGRIGRLVARVALQRDDVELVATYMFKYDTVHGQWKHGDIKVKDEKTLLFGDKPVAVFGVRNPEEIPWGAAGADFVVESTGVFTDKDKAAAHLKGGAKKVIISAPSKDAPMFVMGVNEKEYKPDLNIVSNASCTTNCLAPLAKVIHDKFGIVEGLMTTVHSITATQKTVDGPSMKDWRGGRAASFNIIPSSTGAAKAVGKVLPALNGKLTGMAFRVPTVDVSVVDLTVRIEKKATYDQIKAAIKEESETNLKGILGYTEDDVVSTDFMGDSRSSIFDAKAGIALNDNFVKLVSWYDNEWGYSSRVIDLIIHIASVQ

SEQ ID NO: 426 - DNA, 993 bp, Populus balsamifera subsp. trichocarpa
  misc_feature (1)..(993): Ceres ANNOT ID no. 1527203
  misc_feature: Utility: Cold Germination Useful for making plants with increased tolerance to cold stress
  misc_feature 44879:<222: Transcription Factor
  misc_feature: Phenotype: WHOLE PLANT - Cold Germination Useful for making plants with increased tolerance to cold stress
atgggaaagatcaagattggaatcaacggatttggaagaatcggaaggctggtagctagagtagctctacagagagatgatgttgaacttgttgctgttaatgatcctttcattaccactgaatacatgacatacatgtttaagtatgatacagttcatggtccatggaaacatcatgagcttaaggttaaggattctaagacacttctctttggagagagacctgtcactgtttttggttccaggaacccagaggagatcccatggggtgagaccggagctgagtatattgtggaatcaactggagttttcactgacaaggaaaaggctgctgctcacttgaagggtggagctaagaaagtcatcatctcagcccccagcaaggatgctcctatgtttgttatgggagttaatgagaagagttacactccagatcttaacattatatccaatgctagctgcaccaccaactgccttgctccccttgctaaggtcattcatgacagatttggcattgttgagggacttatgaccactgtgcactctatcactgctacccagaaaactgttgatggaccctcttcaaaggactggagaggtggaagagctgcttcattcaacatcattcctagcagcactggagctgcaaaggctgttgggaaggtgctacctgctctgaatggcaagctaacaggaatggctttccgtgttcctaccgttgatgtctctgttgtggacctgacagtaagacttgagaagtcagctaaatatgatgaaattaaagccgctatcaaggaagagtctgagggaaagatgaagggaatcttaggctacaccgatgaagatttggtttcatctgacttcattggtgactgtaggtcaagtatcttcgatgccaaagctggaattgctttgaatgacaactatgtgaagctcgttgcatggtatgacaatgagtggggatacagtttccttcagtttcttttctattag

SEQ ID NO: 427 - protein, 285 aa, Populus balsamifera subsp. trichocarpa
  misc_feature (1)..(285): Ceres ANNOT ID no. 1527203
  misc_feature (1)..(109): Pfam Name: Gp_dh_N Pfam Description: Glyceraldehyde 3-phosphate dehydrogenase NAD binding domain
  misc_feature (114)..(271): Pfam Name: Gp_dh_C Pfam Description: Glyceraldehyde 3-phosphate dehydrogenase C-terminal domain
  misc_feature: SWISSPROT Homolog: G3PC_TOBAC Glyceraldehyde-3-phosphate dehydrogenase, cytosolic (EC 1.2.1.12) (Fragment) with e-value of 1.1e-67 and BLAST sequence identity of 83.9
  misc_feature: SWISSPROT Homolog: G3PC_MAIZE Glyceraldehyde-3-phosphate dehydrogenase, cytosolic 1 (EC 1.2.1.12) with e-value of 2.3e-67 and BLAST sequence identity of 83.4
  misc_feature: SWISSPROT Homolog: G3PC_PETCR Glyceraldehyde-3-phosphate dehydrogenase, cytosolic (EC 1.2.1.12) with e-value of 3.0e-67 and BLAST sequence identity of 82.0
  misc_feature: SWISSPROT Homolog: G3P_PODAN Glyceraldehyde-3-phosphate dehydrogenase (EC 1.2.1.12) (GAPDH) with e-value of 3.8e-67 and BLAST sequence identity of 79.3
  misc_feature: SWISSPROT Homolog: G3PD_MAIZE Glyceraldehyde-3-phosphate dehydrogenase, cytosolic 2 (EC 1.2.1.12) with e-value of 4.8e-67 and BLAST sequence identity of 82.8
  misc_feature: Utility: Cold Germination Useful for making plants with increased tolerance to cold stress
  misc_feature 44998:<222: Transcription Factor
  misc_feature: Phenotype: WHOLE PLANT - Cold Germination Useful for making plants with increased tolerance to cold stress
  misc_feature (1)..(285): Functional Homolog of  Ceres CLONE ID no. 10072 at SEQ ID NO. 441 with e-value of 1.19E-60 and BLAST sequence identity of 80.2
MFKYDTVHGPWKHHELKVKDSKTLLFGERPVTVFGSRNPEEIPWGETGAEYIVESTGVFTDKEKAAAHLKGGAKKVIISAPSKDAPMFVMGVNEKSYTPDLNIISNASCTTNCLAPLAKVIHDRFGIVEGLMTTVHSITATQKTVDGPSSKDWRGGRAASFNIIPSSTGAAKAVGKVLPALNGKLTGMAFRVPTVDVSVVDLTVRLEKSAKYDEIKAAIKEESEGKMKGILGYTDEDLVSSDFIGDCRSSIFDAKAGIALNDNYVKLVAWYDNEWGYSFLQFLFY

SEQ ID NO: 428 - protein, 148 aa, Arabidopsis thaliana
  misc_feature (1)..(148): Ceres CLONE ID no. 10159
  misc_feature (18)..(146): Pfam Name: Tim17 Pfam Description: Tim17/Tim22/Tim23 family
  misc_feature: Phenotype: WHOLE PLANT - Small Useful for modulating plant size
MPSSTFSGTVSTPKLSVAVDMGNPFLNLTVDAFLKIGAVGVTKSLAEDTYKAIEKGSLSKSTLEHALKKLCKEGVYWGAAGGVYIGTEYGIERIRGSRDWKNAMLAGAATGAVLSAVGKKGKDTIVIDAILGGALATASQFVNNHYFY

SEQ ID NO: 429 - DNA, 441 bp, Populus balsamifera subsp. trichocarpa
  misc_feature (1)..(441): Ceres ANNOT ID no. 1439969
  misc_feature 45143:<222: Transcription Factor
  misc_feature: Phenotype: WHOLE PLANT - Small Useful for modulating plant size
atgccaagtagcagtttcggggcttctttagcaactccaaaacttaatgtggcaatcgacacgggcaatcccttcctcaatgtcaccgttgatggtttcttgaagattggcactgttgcagcagctaaatcacttgctgaggatgcatattatgtcgtcaaaggagggaatttctcaggtcgcaagattgagcattcgttgaagaagatgtgcaaggaaggtgcttattggggaactgttgctggcatgtatgttgggatggaatatggaatggagagaattcgtggcactcatgactggaagaatgccatgcttggaggtgctttgacaggagctctgatatctgctgccagtaataagagtaaagacaatgttgtaattgatgccattgctgggggtgccattgcaactgcatcaacattcctcaactatctcatatga

SEQ ID NO: 430 - protein, 146 aa, Populus balsamifera subsp. trichocarpa
  misc_feature (1)..(146): Ceres ANNOT ID no. 1439969
  misc_feature (18)..(146): Pfam Name: Tim17 Pfam Description: Tim17/Tim22/Tim23 family
  misc_feature 45190:<222: Transcription Factor
  misc_feature: Phenotype: WHOLE PLANT - Small Useful for modulating plant size
  misc_feature (1)..(146): Functional Homolog of  Ceres CLONE ID no. 10159 at SEQ ID NO. 450 with e-value of 3.00E-48 and BLAST sequence identity of 62.9
MPSSSFGASLATPKLNVAIDTGNPFLNVTVDGFLKIGTVAAAKSLAEDAYYVVKGGNFSGRKIEHSLKKMCKEGAYWGTVAGMYVGMEYGMERIRGTHDWKNAMLGGALTGALISAASNKSKDNVVIDAIAGGAIATASTFLNYLI

SEQ ID NO: 431 - protein, 131 aa, Arabidopsis thaliana
  misc_feature (1)..(131): Ceres CLONE ID no. 10375
  misc_feature (1)..(131): Also Known As Ceres CDNA ID no. 23388050
  misc_feature (1)..(131): Also Known As Ceres GEMINI ID 532H1
  misc_feature (53)..(131): Pfam Name: SBP Pfam Description: SBP domain
  misc_feature 45273:<222: Transcription Factor
  misc_feature: Phenotype: Activates expression of the gene endogenous to the AtPES (SEQ ID NO 4142) regalutory region Useful for modulating Terpenoid Biosynthesis
MSMRRSKAEGKRSLRELSEEEEEEEETEDEDTFEEEEALEKKQKGKATSSSGVCQVESCTADISKAKQYHKRHKVCQFHAKAPHVRISGLHQRFCQQCSRFHALSEFDEAKRSCRRRLAGHNERRRKSTTD

SEQ ID NO: 432 - DNA, 447 bp, Populus balsamifera subsp. trichocarpa
  misc_feature (1)..(447): Ceres ANNOT ID no. 1449163
  misc_feature 45325:<222: Transcription Factor
  misc_feature: Phenotype: Activates expression of the gene endogenous to the AtPES (SEQ ID NO 4142) regalutory region Useful for modulating Terpenoid Biosynthesis
atgggaacaagcaaagctgaaggaaagaggaacttgaaggaaatagaagatgaagaggaagatgatgatgaagaagatatttatactgggttagggtttggagatgatgacaagatcaagaagaaaggaagaacagggtctggttgtggtggtggtggtggtagatcgtcgtcaagtccgcctatttcttgtcaagtaaaaaattgcacaactgatatgactgatgccaagcgataccataaacgccataaggtgtgtgagttccatgccaaagcttcttctgtacttgtaaatggagtcgagcaacgcttttgccagcaatgtagcaggttccatgatttatctgagtttgatgacagcaaaaggagttgccggaggcgtttagcggggcacaatgaacggcgtaggaaaagctcgtctgacaaccaaggagaaggctcaaattga

SEQ ID NO: 433 - protein, 148 aa, Populus balsamifera subsp. trichocarpa
  misc_feature (1)..(148): Ceres ANNOT ID no. 1449163
  misc_feature (63)..(141): Pfam Name: SBP Pfam Description: SBP domain
  misc_feature: SWISSPROT Homolog: SPL3_ARATH Squamosa promoter-binding-like protein 3 with e-value of 3.0e-67 and BLAST sequence identity of 99.2
  misc_feature: SWISSPROT Homolog: SBP1_ANTMA Squamosa promoter-binding protein 1 with e-value of 4.7e-37 and BLAST sequence identity of 61.5
  misc_feature: SWISSPROT Homolog: SPL4_ARATH Squamosa promoter-binding-like protein 4 with e-value of 1.5e-33 and BLAST sequence identity of 56.8
  misc_feature: SWISSPROT Homolog: SPL5_ARATH Squamosa promoter-binding-like protein 5 with e-value of 9.4e-32 and BLAST sequence identity of 50.4
  misc_feature: SWISSPROT Homolog: SPL6_ARATH Squamosa promoter-binding-like protein 6 with e-value of 1.1e-31 and BLAST sequence identity of 59.2
  misc_feature 45407:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(148): Functional Homolog of  Ceres CLONE ID no. 10375 at SEQ ID NO. 453 with e-value of 1.30E-38 and BLAST sequence identity of 63.2
MGTSKAEGKRNLKEIEDEEEDDDEEDIYTGLGFGDDDKIKKKGRTGSGCGGGGGRSSSSPPISCQVKNCTTDMTDAKRYHKRHKVCEFHAKASSVLVNGVEQRFCQQCSRFHDLSEFDDSKRSCRRRLAGHNERRRKSSSDNQGEGSN

SEQ ID NO: 434 - protein, 137 aa, Arabidopsis thaliana
  misc_feature (1)..(137): Ceres CLONE ID no. 10857
  misc_feature (31)..(125): Pfam Name: Lg106 Pfam Description: Lg106-like protein
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: WHOLE PLANT - Other Useful for making bigger plants
MEDVKGKEIIDDAPIDNKVSDEMESEENAIKKKYGGLLPKKIPLISKDHERAFFDSADWALGKQKGQKPKGPLEALRPKLQPTPQQQPRARRMAYSSGETEDTEIDNNEAPDDQACASAVDSTNLKDDGGAKDNIKS

SEQ ID NO: 435 - DNA, 600 bp, Populus balsamifera subsp. trichocarpa
  misc_feature (1)..(600): Ceres ANNOT ID no. 1464446
  misc_feature 45539:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: WHOLE PLANT - Other Useful for making bigger plants
atgtcaagcaagagcatcgaggacgtaaaggagcaagagttcagtaacgatgctgccgaaaatccagtcgaaaacgatggtgaccaaaaagaattggatcaaaatggtgaaaaccccatgctctcacccgagcaggaggaggagatcatcaagaaaaaatatgggggaatgttatcaaagaagaagccgttgatatctaaggatcatgaacgagcattttttgattctgctgattgggcactgggaaagcaaggagctcaaaaacctaaaggaccgcttgaagctctccgcccaaaacttcagcccactccgcaacaccaaatgcgttcaaggcgctcagcttatgctcctgcagacgatgatgatggtatcttgcagaaccacgtgcaatccttgcctatatttgcccacttactgtcatctacttctactaatttcattttatttgcagcagaggatggcagtaatcacgcatcacccgagcatgagaactgcgaatcacaaggtggggacgataagaactcagctcctaaagatcaaacctgcaacggtggagacgataagaactctgctcctggtgttcaaacctgcaatgcctag

SEQ ID NO: 436 - protein, 199 aa, Populus balsamifera subsp. trichocarpa
  misc_feature (1)..(199): Ceres ANNOT ID no. 1464446
  misc_feature (51)..(146): Pfam Name: Lg106 Pfam Description: Lg106-like protein
  misc_feature 45606:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: WHOLE PLANT - Other Useful for making bigger plants
  misc_feature (1)..(199): Functional Homolog of  Ceres CLONE ID no. 10857 at SEQ ID NO. 456 with e-value of 2.80E-32 and BLAST sequence identity of 67.5
MSSKSIEDVKEQEFSNDAAENPVENDGDQKELDQNGENPMLSPEQEEEIIKKKYGGMLSKKKPLISKDHERAFFDSADWALGKQGAQKPKGPLEALRPKLQPTPQHQMRSRRSAYAPADDDDGILQNHVQSLPIFAHLLSSTSTNFILFAAEDGSNHASPEHENCESQGGDDKNSAPKDQTCNGGDDKNSAPGVQTCNA

SEQ ID NO: 437 - protein, 254 aa, Arabidopsis thaliana
  misc_feature (1)..(254): Ceres CLONE ID no. 10879
  misc_feature (7)..(85): Pfam Name: LSM Pfam Description: LSM domain
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MSMSKSSKMLQFINYRMRVTIQDGRQLIGKFMAFDRHMNLVLGDCEEFRKLPPAKGNKKTSEEREERRTLGLVLLRGEEVISMTVEGPPPPEESRAKSGSVTAVAGPGIGRAAGRGVPTGPLVQAQPGLSGPVRGIGGPAPGMMQPQISRPPQIIRPPGQMPPQPPFAGQGGPPPPYGMRPPYPGPPPPQYGGQQRPMMIPPPGGMMRGPPPPHGMQGPPPSRPGIPPPGGAPMFAPPHPGMPPAPPNHHNQQH

SEQ ID NO: 438 - DNA, 861 bp, Populus balsamifera subsp. trichocarpa
  misc_feature (1)..(861): Ceres ANNOT ID no. 1467184
  misc_feature 45817:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgtcgatgtcaaagagttcgaagatgctccaatatatcaactaccggatgcgtgtgaccatccaagatggccggcagctggtagggaaattcatggcctttgatcgccacatgaaccttgtactcggtgattgtgaggagttccgtaagctcccaccagcaaagggcaagaagaataatgaggagcgtgaggaccgccgtactcttggccttgttctccttcgtggtgaagaggtcatctctatgactgttgagggccctcctcctcctgaagagtctcgtgccaaggctgtctctgctgcagctgttgctggtcccggtcttggtcgtgctgctggccgtggaattcctactgctcctcttgttcaggcgcagcctggcctagcaggtcctgtccgtggtgttggtgggccttcccctggcatgatgcagccacaactctctcgtcctcaactttctgctccacccatgacctaccctgcaggaagtggcctgccaactggtggtgcacctattctccggccacctggtcagatgcctcctatgccatatcctggacagggtccaccaatgggccggggtccacctccaccaggtccacctcaatttgctgctaggcccccacagggtttcccgatgccaccacagtttgcccagagaccaatgggagggccaccacagccacaggtacaaatgatgagaggaccacctgctccaccaagacctggaatgccagcaccacctccaccccgtcctgggatgccacttccacctggtggtcatgttcctgtttttggaccccctcgtccgggtatgccacctcctcccaattcccaacagcagcagaatcagcagcaatag

SEQ ID NO: 439 - protein, 286 aa, Populus balsamifera subsp. trichocarpa
  misc_feature (1)..(286): Ceres ANNOT ID no. 1467184
  misc_feature (7)..(84): Pfam Name: LSM Pfam Description: LSM domain
  misc_feature: SWISSPROT Homolog: RSMB_ERIEU Small nuclear ribonucleoprotein-associated protein B' snRNP-B' (Sm protein B') (Sm-B') (SmB') (snRPB') with e-value of 7.0e-59 and BLAST sequence identity of 52.6
  misc_feature: SWISSPROT Homolog: RSMB_HUMAN Small nuclear ribonucleoprotein-associated proteins B and B' snRNP-B (Sm protein B/B') (Sm-B/Sm-B') (SmB/SmB') with e-value of 7.0e-59 and BLAST sequence identity of 52.6
  misc_feature: SWISSPROT Homolog: RSMB_MONDO Small nuclear ribonucleoprotein-associated protein B' snRNP-B'(Sm protein B') (Sm-B') (SmB') (snRPB') with e-value of 2.1e-57 and BLAST sequence identity of 51.8
  misc_feature: SWISSPROT Homolog: RSMN_HUMAN Small nuclear ribonucleoprotein-associated protein N snRNP-N with e-value of 3.5e-57 and BLAST sequence identity of 51.4
  misc_feature: SWISSPROT Homolog: RSMN_HUMAN Sm protein N (Sm-N) (SmN) (Sm-D) Tissue-specific splicing protein
  misc_feature: SWISSPROT Homolog: RSMN_MOUSE Small nuclear ribonucleoprotein-associated protein N snRNP-N (Sm protein N)(Sm-D) (Tissue-specific splicing protein) with e-value of 3.5e-57 and BLAST sequence identity of 51.4
  misc_feature 45975:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(286): Functional Homolog of  Ceres CLONE ID no. 10879 at SEQ ID NO. 459 with e-value of 1.50E-96 and BLAST sequence identity of 81.1
MSMSKSSKMLQYINYRMRVTIQDGRQLVGKFMAFDRHMNLVLGDCEEFRKLPPAKGKKNNEEREDRRTLGLVLLRGEEVISMTVEGPPPPEESRAKAVSAAAVAGPGLGRAAGRGIPTAPLVQAQPGLAGPVRGVGGPSPGMMQPQLSRPQLSAPPMTYPAGSGLPTGGAPILRPPGQMPPMPYPGQGPPMGRGPPPPGPPQFAARPPQGFPMPPQFAQRPMGGPPQPQVQMMRGPPAPPRPGMPAPPPPRPGMPLPPGGHVPVFGPPRPGMPPPPNSQQQQNQQQ

SEQ ID NO: 440 - protein, 183 aa, Arabidopsis thaliana
  misc_feature (1)..(183): Ceres CLONE ID no. 10987
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
MQAKKQKQLLKARLCRERQIYEMRKRAELKAAVAELERPWEPIHKPPNLFSVCADEQVKVLADRFQKPGGFDLWTDRDGPQLFESVDDLPSARFFPKGVVHSVKPYGRLSSSSVVDDGDESEVKDEEIGKKLRGRRVRKRGDDGGKRRTENRGNGGRLRNGGSSSSQVYDMTLQNDGRYEIGS

SEQ ID NO: 441 - DNA, 1812 bp, Populus balsamifera subsp. trichocarpa
  misc_feature (1)..(1812): Ceres ANNOT ID no. 1454090
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 46219:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
atggtcacaacccagtggggtagcatggtggtaagttgcacgtgcagtggtctccggaaaacgagaaccccccggttcccaagcccaggcaccgccatgacctcaggcacagaagccagtgattattatagctctcagggctgttcgggggatcccacgctgaagaagcaacatgtgaacctcttgtctggaccgcatggaaagtcggaagcaactgccacctctagtagtcgaaatctaggaattgcaggcttcatttataagctgagcaaaagggacctttcgatttggtataagccgtggctggaagaaaagccaatatgcaacttaattgattatgtgaatgtcatcgatgctgatctgaaagttaaagatctttggtgcaatgaaacctgggacttcagtagggtggtaacacatattccccagcttatcaagcattgcattatggaagtctccatccattcgcttcatgttgttgatgattgcgtggtttgggctgacaatatttcagatgtcaaccaacggttaatcaagctgctgtcgggtgatcttgattgcatctttcttgtgggagtttggtggctatggagacatagaaacatcatactagccgaggattgtcgcgctgcttggaatgataaagaggctgcatgcagacagatcttggctttgttaagttggatgtggatggcatctctctggaaaatcctgctccactccctttacagcattcctccttccttggacgaactgccaaatccaaaagaaccctcgataatttcaatgtctctctcaatcccaacgctccacctctctttctctaaaaccctctcatcccaaaaccctctcttctttccaaaacccttcagcctcactctccctcctaaaaccacaataataattcgaatgggcggaggcccaagaacattccctggaggagtctccaagtggcaatggaaacgaatgcaaaaaaataaagctaaacaactcctaaaagctaggctttgccgggagagacagatttacgaaatgagaaaaagggcagagctcaaagctgctgtttctgaattagagcgtccttgggaggttgttgacaaagcacccaagttgttttctgtaggcgctgatgaacaagttaaggttttggctgaccgctttcagaaaccaggtgggtttgatttgtggagtgaaagagatggtccccagttgtttgagacccctgatggggttccatctgccagattttttccaacaggtgttgttcaaactgtgaaaccttatggtaaggtttctgcttctggttttggtgaattgagtgctcgaatgctggattctgattttggaagctacactgaaagtgaatatcagaatgacggaatgcccgttaatgagaaattcagtaatttattagaaattgaagatgggtcagtttcagagagtggatataggggaagttctgatgggaaattggggatggataagaggaatgcaaagagaaatactggtaaatacaggaagaagggggataggaggagatttgggaatgtttctaatgcatttgattcagggcaagttggttttgagaaagagaaaagagtgggtggcactaccaatcgcagtgctggtcgtgataataggattagtaggagtaacaatggcagtaggattaataggaatcggagagattccaagtctgatgtttatgatataagtttgcaacaggatgggagttatggattccaagtcgagaatgagaagttcaattctagttcttgggatgtggaggcatttgagttcgattcattctag

SEQ ID NO: 442 - protein, 571 aa, Populus balsamifera subsp. trichocarpa
  misc_feature (1)..(571): Ceres ANNOT ID no. 1454090
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 46338:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature (1)..(571): Functional Homolog of  Ceres CLONE ID no. 10987 at SEQ ID NO. 462 with e-value of 1.20E-52 and BLAST sequence identity of 80.3
MTSGTEASDYYSSQGCSGDPTLKKQHVNLLSGPHGKSEATATSSSRNLGIAGFIYKLSKRDLSIWYKPWLEEKPICNLIDYVNVIDADLKVKDLWCNETWDFSRVVTHIPQLIKHCIMEVSIHSLHVVDDCVVWADNISDVNQRLIKLLSGDLDCIFLVGVWWLWRHRNIILAEDCRAAWNDKEAACRQILALLSWMWMASLWKILLHSLYSIPPSLDELPNPKEPSIISMSLSIPTLHLSFSKTLSSQNPLFFPKPFSLTLPPKTTIIIRMGGGPRTFPGGVSKWQWKRMQKNKAKQLLKARLCRERQIYEMRKRAELKAAVSELERPWEVVDKAPKLFSVGADEQVKVLADRFQKPGGFDLWSERDGPQLFETPDGVPSARFFPTGVVQTVKPYGKVSASGFGELSARMLDSDFGSYTESEYQNDGMPVNEKFSNLLEIEDGSVSESGYRGSSDGKLGMDKRNAKRNTGKYRKKGDRRRFGNVSNAFDSGQVGFEKEKRVGGTTNRSAGRDNRISRSNNGSRINRNRRDSKSDVYDISLQQDGSYGFQVENEKFNSSSWDVEAFEFDSF

SEQ ID NO: 443 - DNA, 921 bp, Populus balsamifera subsp. trichocarpa
  misc_feature (1)..(921): Ceres ANNOT ID no. 1475712
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 46511:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
atgggtggaggcccaagaacatacccaggaggagtctccaagtggcagtggaaacgaatgcaaaaaaacaaagctaaacaactcctaaaggctaggctttctcgggagagacagatttacgaaatgagaaaaagggcagagctcaaagcttctgtttctgaattagagcgtccttgggaagttgttcagaaagcacctaagttgttttctgttggtgctgatgaacaagttaaggttttggccgaccgctttcagaaaccaggagggtttgatttgtggagtgaaagagatggaccccagttgtttgagacccctgatggggttccctccgcccggtttttccctaaaggtgttgtacatagtgtgaaaccttatgggaaggtttctgcttctgggtttggtgaattgagtggtgaaatgccggattctgaattagaaagctatactgaaagcgaaactgaagcggaaagtgaatatgagaatgatggaatgtccgttaatgggaaattaagcagggaagatgaggatgggtcggttttagagagcgcgtatggggagaatcctgatggaaaattggggatggataagaggaatgcaaagagaattaatggtaaacacaggaagaaggggaataggaggagatttgggagtggttttaatgcatttgactcagggcaggttggttttgagaaagagaaaagagtgggggggatttccaacttcgatgctggtggtaataataggagtaaaaatggtagtaggattagtaagactagaggtttgcagaatcggagagattcaaattctgaagttcacgttatgagcttgcaacgggatgggagttatggattccaagtcgagaatgagaagtttgattctgattcttgggatgtggaggcatttgagttcgattcgttttag

SEQ ID NO: 444 - protein, 287 aa, Populus balsamifera subsp. trichocarpa
  misc_feature (1)..(287): Ceres ANNOT ID no. 1475712
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 46600:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature (1)..(287): Functional Homolog of  Ceres CLONE ID no. 10987 at SEQ ID NO. 462 with e-value of 2.09E-51 and BLAST sequence identity of 76.8
MQKNKAKQLLKARLSRERQIYEMRKRAELKASVSELERPWEVVQKAPKLFSVGADEQVKVLADRFQKPGGFDLWSERDGPQLFETPDGVPSARFFPKGVVHSVKPYGKVSASGFGELSGEMPDSELESYTESETEAESEYENDGMSVNGKLSREDEDGSVLESAYGENPDGKLGMDKRNAKRINGKHRKKGNRRRFGSGFNAFDSGQVGFEKEKRVGGISNFDAGGNNRSKNGSRISKTRGLQNRRDSNSEVHVMSLQRDGSYGFQVENEKFDSDSWDVEAFEFDSF

SEQ ID NO: 445 - protein, 204 aa, Arabidopsis thaliana
  misc_feature (1)..(204): Ceres CLONE ID no. 11130
  misc_feature (1)..(204): Also Known As Ceres CDNA ID no. 23364997
  misc_feature (1)..(204): Also Known As Ceres GEMINI ID 532C11
  misc_feature (39)..(76): Pfam Name: zf-AN1 Pfam Description: AN1-like Zinc finger
  misc_feature 46721:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
RRTTTTTTTTHEEEEEKLMAGGGTEAFPDLGEHCQDPDCKLLDFLPFTCDGCKLVFCLEHRSYKSHNCPKSDHGSRTVSICETCSIAIETTGFDERGIKSLLEKHERSGDCDPNKKKKPTCPVKRCKEILTFANNLTCKDCGVKFCLKHRFPTDHVCNKKTINTAGTRSRWNERFMEALSLRNQKGCGRGSSVSSKSPASVRSF

SEQ ID NO: 446 - DNA, 450 bp, Populus balsamifera subsp. trichocarpa
  misc_feature (1)..(450): Ceres ANNOT ID no. 1466979
  misc_feature 46807:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgggaggaggaacagaggcttttccagatttgggaagacactgccaacattctgaatgcaagcagctcgattttctgcctttcaactgcaatggttgtcggaaggtgttttgcttagagcatagatcctacaagtctcatgagtgtccgaaatcagaccacaagagtcgaaaagtagttgtttgtgaaacatgttcggcgtctattgagactactggatgcaacgaggatgctgagaaagtggtgttgctgaaacatgagaaatctggagactgtgacccaaggaagaagaagaagaagaagccaacttgcgctgttaagcgctgcaaggagatattaaccttctctaacacatgcacctgcaaaacttgccagttaaaggtgtgcttaaagcatcggtttccagccgaccatgcgtgtaagaaatatcatcctctgcagtacatgtga

SEQ ID NO: 447 - protein, 149 aa, Populus balsamifera subsp. trichocarpa
  misc_feature (1)..(149): Ceres ANNOT ID no. 1466979
  misc_feature (15)..(57): Pfam Name: zf-AN1 Pfam Description: AN1-like Zinc finger
  misc_feature: SWISSPROT Homolog: ZFN2B_MOUSE AN1-type zinc finger protein 2B with e-value of 8.6e-22 and BLAST sequence identity of 34.8
  misc_feature: SWISSPROT Homolog: ZFN2B_RAT AN1-type zinc finger protein 2B with e-value of 1.4e-21 and BLAST sequence identity of 34.8
  misc_feature: SWISSPROT Homolog: ZFN2B_HUMAN AN1-type zinc finger protein 2B with e-value of 3.7e-21 and BLAST sequence identity of 34.1
  misc_feature: SWISSPROT Homolog: ZFAN1_MOUSE AN1-type zinc finger protein 1 with e-value of 1.2e-13 and BLAST sequence identity of 37.9
  misc_feature: SWISSPROT Homolog: ZFAN1_HUMAN AN1-type zinc finger protein 1 with e-value of 4.2e-12 and BLAST sequence identity of 34.5
  misc_feature 46911:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(149): Functional Homolog of  Ceres CLONE ID no. 11130 at SEQ ID NO. 467 with e-value of 1.30E-56 and BLAST sequence identity of 73.3
MGGGTEAFPDLGRHCQHSECKQLDFLPFNCNGCRKVFCLEHRSYKSHECPKSDHKSRKVVVCETCSASIETTGCNEDAEKVVLLKHEKSGDCDPRKKKKKKPTCAVKRCKEILTFSNTCTCKTCQLKVCLKHRFPADHACKKYHPLQYM

SEQ ID NO: 448 - protein, 390 aa, Arabidopsis thaliana
  misc_feature (1)..(390): Ceres CLONE ID no. 11214
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (316)..(316): Xaa is any aa, unknown, or other
MAATAASSLQIATRRPSMSSPSKVLKAGTYIVGANPGNASWDKLSCTRQLSNLGCLRNNTAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRXAKAIGFIDTMIEYSYNNGPIQKTLTADEVGNAAAFLASPLASAITGATIYVDNGLNAMGVALDSPVFKDLNSKN

SEQ ID NO: 449 - DNA, 1185 bp, Populus balsamifera subsp. trichocarpa
  misc_feature (1)..(1185): Ceres ANNOT ID no. 1501485
  misc_feature 47140:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggcggcaactgcggcttctggccttcaaatggcaactgcaaggccctgcatttcctcttcccacagagtggtcaaggcaggtgctgctattcttggagccagttctaaaggggcatcatgggctaagcttgcgagtggttctcatatatcgtctattcagcctttccaaaggactttcatgtcatcttcagttaaattgaataaggctgtgacaaaggcaatgtctgaatctagtgacagtaagccagtgtctggattgccaattgatttgagaggtaaacgggcatttattgctggtgtagctgatgacaatgggtatggttgggccatagcaaaatctcttgctgcttcaggtgctgaaattcttgtcggaacatgggtgcctgctttgaacatttttgaaacaagcctgagacgggggaaatttgatgaatctcgcgtgttgccagatggttctttgatggatatcaccaaagtatacccccttgatgcagtgtttgacaaccctgaggatgtacctgaagatgtgaaagcaaataaacgttatgctggatccagtaaatggactgttcaggaagttgctgaatctgtcaaacaggattttggcagcattgacatccttgtgcactcgcttgccaatggaccggaggtcagcaaaccccttttggaaacatcaagaaaaggatatcttgcagccatatctgcatccagttactcatatgtttctttactcaagcatttccttccaattatgaatccgggtggttcatctatttctctcacatacattgcttcagagaggatcataccaggatatggtggaggcatgagttctgccaaagctgcacttgaaagtgacacacgtgtgcttgcatttgaagcaggaaggaaaaacagaatcagggtcaacacaatatctgctggtccactaagaagccgtgctgcaaaagcaattggatttattgatactatgattgaatattcattagccaatgcacccttgcaaaaagagctatctgcagatgaggtgggcaatgctgctgccttcttagcatcacctttggcttctgcagtcactggtactgttatgtatgttgacaatggcctcaacacaatgggtgtcggagttgacagtccgatattcaaagaccttgacattccaaaagacaatcaccagggttaa

SEQ ID NO: 450 - protein, 394 aa, Populus balsamifera subsp. trichocarpa
  misc_feature (1)..(394): Ceres ANNOT ID no. 1501485
  misc_feature: SWISSPROT Homolog: FABI_BRANA Enoyl-[acyl-carrier-protein] reductase[NADH],chloroplast precursor (EC 1.3.1.9) (NADH-dependent enoyl-ACP reductase) with e-value of 4.3e-178 and BLAST sequence identity of 89.4
  misc_feature: SWISSPROT Homolog: FABI1_RHIME Enoyl-[acyl-carrier-protein] reductase [NADH] 1 (EC 1.3.1.9) (NADH-dependent enoyl-ACP reductase 1) with e-value of 1.3e-38 and BLAST sequence identity of 36.3
  misc_feature: SWISSPROT Homolog: FABI_BACSU Enoyl-[acyl-carrier-protein] reductase [NADH] with e-value of 2.9e-33 and BLAST sequence identity of 34.4
  misc_feature: SWISSPROT Homolog: FABI_BACSU EC 1.3.1.9 NADH-dependent enoyl-ACP reductase Cold shock-induced protein 15 (CSI15) Vegetative protein 241 (VEG241)
  misc_feature: SWISSPROT Homolog: FABI2_RHIME Enoyl-[acyl-carrier-protein] reductase [NADH] 2 (EC 1.3.1.9) (NADH-dependent enoyl-ACP reductase 2) with e-value of 2.9e-33 and BLAST sequence identity of 33.2
  misc_feature: SWISSPROT Homolog: FABI_RICCN Enoyl-[acyl-carrier-protein] reductase [NADH] (EC 1.3.1.9) (NADH-dependent enoyl-ACP reductase) with e-value of 3.6e-33 and BLAST sequence identity of 38.0
  misc_feature 47295:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(394): Functional Homolog of  Ceres CLONE ID no. 11214 at SEQ ID NO. 470 with e-value of 1.89E-156 and BLAST sequence identity of 79.0
MAATAASGLQMATARPCISSSHRVVKAGAAILGASSKGASWAKLASGSHISSIQPFQRTFMSSSVKLNKAVTKAMSESSDSKPVSGLPIDLRGKRAFIAGVADDNGYGWAIAKSLAASGAEILVGTWVPALNIFETSLRRGKFDESRVLPDGSLMDITKVYPLDAVFDNPEDVPEDVKANKRYAGSSKWTVQEVAESVKQDFGSIDILVHSLANGPEVSKPLLETSRKGYLAAISASSYSYVSLLKHFLPIMNPGGSSISLTYIASERIIPGYGGGMSSAKAALESDTRVLAFEAGRKNRIRVNTISAGPLRSRAAKAIGFIDTMIEYSLANAPLQKELSADEVGNAAAFLASPLASAVTGTVMYVDNGLNTMGVGVDSPIFKDLDIPKDNHQG

SEQ ID NO: 451 - DNA, 1191 bp, Populus balsamifera subsp. trichocarpa
  misc_feature (1)..(1191): Ceres ANNOT ID no. 1490496
  misc_feature 47445:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggcggcaactgcggcttctggccttcaaatggcaactgcaaggccctgcatttcctcttctcgcagaatggttaaggcaggtgctgctattcttggcgccaattctaaaggggcttcatgggctaagcttgcgagtggttctcatatatcatatatccagccttttaaaaggacactcatgtcgtcttcagttaaattgaataaggttgtgacaaaggcaatgtctgaatctaatgaaagtaagccattgtccggattgccaattgatttgagaggtaaacgggcatttattgctggtgtggctgacgacaatggatatggttgggcaatagcaaaatctcttgctgctgctggtgctgaaattctggttggaacatgggtgcctgctttgaacatttttgaaacaagcctgcgaaggggaaagtttgatgaatctcgcgtgttgccagatggttctttgatggagatcaccaaagtatatccccttgatgcggtgtttgacaaccttgaggatgtacctgaagatgtgaaagcaaataagcgttatgctggatccagcaagtggaccgttcaggaagttgccgaatctgtcaaacaggattatggcagcatcgacatcctggtgcactcacttgccaatgggcctgaggttactaaaccccttttggaaacatcaaggaaaggatatcttgcagccatatctgcatccagttactcatatgtttctttactcaagcatttccttcctttaatgaatccaggtggttcatcaatttctctcacatacattgcctctgagaggatcataccaggatacggtggaggcatgagttctgccaaagctgcactcgagagcgacacacgtgcaagtgtgcttgcatttgaagcaggaaggaaaaacagaatcagggtcaacacaatatctgctggtccactaagaagccgagcagccaaagcaattggatttattgacaccatgattgaatattcattagccaatgcacccttgcaaaaagaactatctgcagatgaggtgggtaatgctgctgccttcttagcatcacctttagcttctgccgtcactggtactgttatgtacgttgacaatggcctcaatgtaatgggtgttggtgtcgacagcccaatattcaaagaccttaacattccaacagacaagcaccagggataa

SEQ ID NO: 452 - protein, 396 aa, Populus balsamifera subsp. trichocarpa
  misc_feature (1)..(396): Ceres ANNOT ID no. 1490496
  misc_feature: SWISSPROT Homolog: FABI_BRANA Enoyl-[acyl-carrier-protein] reductase[NADH],chloroplast precursor (EC 1.3.1.9) (NADH-dependent enoyl-ACP reductase) with e-value of 4.3e-178 and BLAST sequence identity of 89.4
  misc_feature: SWISSPROT Homolog: FABI1_RHIME Enoyl-[acyl-carrier-protein] reductase [NADH] 1 (EC 1.3.1.9) (NADH-dependent enoyl-ACP reductase 1) with e-value of 1.3e-38 and BLAST sequence identity of 36.3
  misc_feature: SWISSPROT Homolog: FABI_BACSU Enoyl-[acyl-carrier-protein] reductase [NADH] with e-value of 2.9e-33 and BLAST sequence identity of 34.4
  misc_feature: SWISSPROT Homolog: FABI_BACSU EC 1.3.1.9 NADH-dependent enoyl-ACP reductase Cold shock-induced protein 15 (CSI15) Vegetative protein 241 (VEG241)
  misc_feature: SWISSPROT Homolog: FABI2_RHIME Enoyl-[acyl-carrier-protein] reductase [NADH] 2 (EC 1.3.1.9) (NADH-dependent enoyl-ACP reductase 2) with e-value of 2.9e-33 and BLAST sequence identity of 33.2
  misc_feature: SWISSPROT Homolog: FABI_RICCN Enoyl-[acyl-carrier-protein] reductase [NADH] (EC 1.3.1.9) (NADH-dependent enoyl-ACP reductase) with e-value of 3.6e-33 and BLAST sequence identity of 38.0
  misc_feature 47600:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(396): Functional Homolog of  Ceres CLONE ID no. 11214 at SEQ ID NO. 470 with e-value of 1.20E-154 and BLAST sequence identity of 78.7
MAATAASGLQMATARPCISSSRRMVKAGAAILGANSKGASWAKLASGSHISYIQPFKRTLMSSSVKLNKVVTKAMSESNESKPLSGLPIDLRGKRAFIAGVADDNGYGWAIAKSLAAAGAEILVGTWVPALNIFETSLRRGKFDESRVLPDGSLMEITKVYPLDAVFDNLEDVPEDVKANKRYAGSSKWTVQEVAESVKQDYGSIDILVHSLANGPEVTKPLLETSRKGYLAAISASSYSYVSLLKHFLPLMNPGGSSISLTYIASERIIPGYGGGMSSAKAALESDTRASVLAFEAGRKNRIRVNTISAGPLRSRAAKAIGFIDTMIEYSLANAPLQKELSADEVGNAAAFLASPLASAVTGTVMYVDNGLNVMGVGVDSPIFKDLNIPTDKHQG

SEQ ID NO: 453 - DNA, 1158 bp, Populus balsamifera subsp. trichocarpa
  misc_feature (1)..(1158): Ceres ANNOT ID no. 1448498
  misc_feature 47750:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggcggcaactgcggcttctggccttcaaatggcaactgcaaggccctgcatttcctcttcccacagagtggtcaaggcaggtgctgctattcttggagccagttctaaaggggcatcatgggctaagcttgcgagtggttctcatatatcgtctattcagcctttccaaaggactttcatgtcatcttcagttaaattgaataaggctgtgacaaaggcaatgtctgaatctagtgacagtaagccagtgtctggattgccaattgatttgagagctgatgacaatgggtatggttgggccatagcaaaatctcttgctgcttcaggtgctgaaattcttgtcggaacatgggtgcctgctttgaacatttttgaaacaagcctgagacgggggaaatttgatgaatctcgcgtgttgccagatggttctttgatggatatcaccaaagtatacccccttgatgcagtgtttgacaaccctgaggatgtacctgaagatgtgaaagcaaataaacgttatgctggatccagtaaatggactgttcaggaagttgctgaatctgtcaaacaggattttggcagcattgacatccttgtgcactcgcttgccaatggaccggaggtcagcaaaccccttttggaaacatcaagaaaaggatatcttgcagccatatctgcatccagttactcatatgtttctttactcaagcatttccttccaattatgaatccgggtggttcatctatttctctcacatacattgcttcagagaggatcataccaggatatggtggaggcatgagttctgccaaagctgcacttgaaagtgacacacgtgtgcttgcatttgaagcaggaaggaaaaacagaatcagggtcaacacaatatctgctggtccactaagaagccgtgctgcaaaagcaattggatttattgatactatgattgaatattcattagccaatgcacccttgcaaaaagagctatctgcagatgaggtgggcaatgctgctgccttcttagcatcacctttggcttctgcagtcactggtactgttatgtatgttgacaatggcctcaacacaatgggtgtcggagttgacagtccgatattcaaagaccttgacattccaaaagacaatcaccagggttaa

SEQ ID NO: 454 - protein, 385 aa, Populus balsamifera subsp. trichocarpa
  misc_feature (1)..(385): Ceres ANNOT ID no. 1448498
  misc_feature: SWISSPROT Homolog: FABI_BRANA Enoyl-[acyl-carrier-protein] reductase[NADH],chloroplast precursor (EC 1.3.1.9) (NADH-dependent enoyl-ACP reductase) with e-value of 4.3e-178 and BLAST sequence identity of 89.4
  misc_feature: SWISSPROT Homolog: FABI1_RHIME Enoyl-[acyl-carrier-protein] reductase [NADH] 1 (EC 1.3.1.9) (NADH-dependent enoyl-ACP reductase 1) with e-value of 1.3e-38 and BLAST sequence identity of 36.3
  misc_feature: SWISSPROT Homolog: FABI_BACSU Enoyl-[acyl-carrier-protein] reductase [NADH] with e-value of 2.9e-33 and BLAST sequence identity of 34.4
  misc_feature: SWISSPROT Homolog: FABI_BACSU EC 1.3.1.9 NADH-dependent enoyl-ACP reductase Cold shock-induced protein 15 (CSI15) Vegetative protein 241 (VEG241)
  misc_feature: SWISSPROT Homolog: FABI2_RHIME Enoyl-[acyl-carrier-protein] reductase [NADH] 2 (EC 1.3.1.9) (NADH-dependent enoyl-ACP reductase 2) with e-value of 2.9e-33 and BLAST sequence identity of 33.2
  misc_feature: SWISSPROT Homolog: FABI_RICCN Enoyl-[acyl-carrier-protein] reductase [NADH] (EC 1.3.1.9) (NADH-dependent enoyl-ACP reductase) with e-value of 3.6e-33 and BLAST sequence identity of 38.0
  misc_feature 47905:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(385): Functional Homolog of  Ceres CLONE ID no. 11214 at SEQ ID NO. 470 with e-value of 3.09E-149 and BLAST sequence identity of 78.7
MAATAASGLQMATARPCISSSHRVVKAGAAILGASSKGASWAKLASGSHISSIQPFQRTFMSSSVKLNKAVTKAMSESSDSKPVSGLPIDLRADDNGYGWAIAKSLAASGAEILVGTWVPALNIFETSLRRGKFDESRVLPDGSLMDITKVYPLDAVFDNPEDVPEDVKANKRYAGSSKWTVQEVAESVKQDFGSIDILVHSLANGPEVSKPLLETSRKGYLAAISASSYSYVSLLKHFLPIMNPGGSSISLTYIASERIIPGYGGGMSSAKAALESDTRVLAFEAGRKNRIRVNTISAGPLRSRAAKAIGFIDTMIEYSLANAPLQKELSADEVGNAAAFLASPLASAVTGTVMYVDNGLNTMGVGVDSPIFKDLDIPKDNHQG

SEQ ID NO: 455 - DNA, 1176 bp, Populus balsamifera subsp. trichocarpa
  misc_feature (1)..(1176): Ceres ANNOT ID no. 1474848
  misc_feature 48055:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggccacggctgcaactcctgctacaaacatggcaatgatcaagccttgcatttcttcttctcgcaaagtattcatgtcaagtgcagcaagtttcagtactgaatctaaagaggcatcttggaataggcttacaagctcctctcacatctcatcaaggcaaccttttttccagagcattttctcagcaccaataaaatttaagaaggttgttaccagagcaatgtctgctgcgaatgagaacaagcctctgccaggattgcctgttgatttaagaggtaagagagcatttattgctggtgtagctgatgacaatggatatggctgggcaatagcgaagtcccttgctgctgccggtgctgagattattgttggtacatgggtgcctgcattgaacatatttgaaagcagtctacggcgtgggaaatttgatgaatcacgcgtattgccagatggttctttaatggaaattactaaagtttacccaatggatgcagtctatgacagtctagatgatgttcctgaggatgtaaagtcaaacaaacgttatgcagggtcctcaaaatggactgttaaggagcttgtcgaatcggtgaagcaggattttggaagcattgacatccttgtgcattcacttgctaatgggccagaggttagcaaacctctcctagagacatccaggaatggatatctcgctgccatctcagcttcgagctattcctttgtttcattactgaaagaatttgtttcaataatgaatccaggtggcgcttcaatttctcttacctacattgcttctgaaaggatcattccaggatatggtggaggcatgagttcagcaaaggctgctctcgagagtgatacacgagtgctggcttttgaagctggaagaaaacacaaaatcagagtcaacactatatctgcaggccccttaagaagtcgtgctgcgaaagcaattggatttattgatatgatgattgattactcatcggctaatgcacccctacagaaggaactatctgctgaggaggtggggaatgcagctgccttcctggcttcacccttggcttcggctatcactggagcagttgtttatgtggacaatggtttgaatgctatgggagtgggagttgacagcccaatatttgtggatcttgacattccgaaggataactag

SEQ ID NO: 456 - protein, 391 aa, Populus balsamifera subsp. trichocarpa
  misc_feature (1)..(391): Ceres ANNOT ID no. 1474848
  misc_feature: SWISSPROT Homolog: FABI_BRANA Enoyl-[acyl-carrier-protein] reductase[NADH],chloroplast precursor (EC 1.3.1.9) (NADH-dependent enoyl-ACP reductase) with e-value of 4.3e-178 and BLAST sequence identity of 89.4
  misc_feature: SWISSPROT Homolog: FABI1_RHIME Enoyl-[acyl-carrier-protein] reductase [NADH] 1 (EC 1.3.1.9) (NADH-dependent enoyl-ACP reductase 1) with e-value of 1.3e-38 and BLAST sequence identity of 36.3
  misc_feature: SWISSPROT Homolog: FABI_BACSU Enoyl-[acyl-carrier-protein] reductase [NADH] with e-value of 2.9e-33 and BLAST sequence identity of 34.4
  misc_feature: SWISSPROT Homolog: FABI_BACSU EC 1.3.1.9 NADH-dependent enoyl-ACP reductase Cold shock-induced protein 15 (CSI15) Vegetative protein 241 (VEG241)
  misc_feature: SWISSPROT Homolog: FABI2_RHIME Enoyl-[acyl-carrier-protein] reductase [NADH] 2 (EC 1.3.1.9) (NADH-dependent enoyl-ACP reductase 2) with e-value of 2.9e-33 and BLAST sequence identity of 33.2
  misc_feature: SWISSPROT Homolog: FABI_RICCN Enoyl-[acyl-carrier-protein] reductase [NADH] (EC 1.3.1.9) (NADH-dependent enoyl-ACP reductase) with e-value of 3.6e-33 and BLAST sequence identity of 38.0
  misc_feature 48210:<222: Transcription Factor
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: ROSETTE LEAVES - Leaf Fused to Inflorescence Useful for making ornamental plants with flowers and leaves fused
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(391): Functional Homolog of  Ceres CLONE ID no. 11214 at SEQ ID NO. 470 with e-value of 1.70E-141 and BLAST sequence identity of 73.3
MATAATPATNMAMIKPCISSSRKVFMSSAASFSTESKEASWNRLTSSSHISSRQPFFQSIFSAPIKFKKVVTRAMSAANENKPLPGLPVDLRGKRAFIAGVADDNGYGWAIAKSLAAAGAEIIVGTWVPALNIFESSLRRGKFDESRVLPDGSLMEITKVYPMDAVYDSLDDVPEDVKSNKRYAGSSKWTVKELVESVKQDFGSIDILVHSLANGPEVSKPLLETSRNGYLAAISASSYSFVSLLKEFVSIMNPGGASISLTYIASERIIPGYGGGMSSAKAALESDTRVLAFEAGRKHKIRVNTISAGPLRSRAAKAIGFIDMMIDYSSANAPLQKELSAEEVGNAAAFLASPLASAITGAVVYVDNGLNAMGVGVDSPIFVDLDIPKDN

SEQ ID NO: 457 - protein, 232 aa, Arabidopsis thaliana
  misc_feature (1)..(232): Ceres CLONE ID no. 11494
  misc_feature (72)..(181): Pfam Name: GSHPx Pfam Description: Glutathione peroxidase
  misc_feature: Phenotype: ROSETTE LEAVES - Curled 3 Useful for making ornamental plants with altered leaf shape
  misc_feature: Phenotype: INFLORESCENCE - Late Flowering Useful for modulating flowering time
MLRSSIRLLYIRRTSPLLRSLSSSSSLSSKRFDSAKPIFNSHRTFCLPPISTTGAKLSRSEHSMAASSEPKSLYDFTVKDAKGNDVDLSIYKGKVLLIVNVASQCGLTNSNCTELAQLYEKYKGHGFEILAFPCNQFGNQEPGTNEEIVQFACTRFKAEYPIFDKVDVNGDKAAPVYKFLKSSKGGLFGDGIKWNFAKFLVDKDGNVVDRFAPTTSPLSIEKDVKKLLGVTA

SEQ ID NO: 458 - DNA, 507 bp, Populus balsamifera subsp. trichocarpa
  misc_feature (1)..(507): Ceres ANNOT ID no. 1438708
  misc_feature 48440:<222: Transcription Factor
  misc_feature: Phenotype: ROSETTE LEAVES - Curled 3 Useful for making ornamental plants with altered leaf shape
  misc_feature: Phenotype: INFLORESCENCE - Late Flowering Useful for modulating flowering time
atggctagccaatccagtgctcaatcagttcatgatttcactgttaaggatgctagggaaaatgatgttgacctcagcatatataaggggaaggtcctcttgattgtcaatgttgcttcacaatgtggcttgaccaattcaaactacacggagttgacccagctatatgacaaatacagggatcaaggtttggagattctggcttttccatgcaatcagtttggatctcaggagccagggaacaatgaacaaatagtggagtttgcttgtactcgctttaaggctgactatcccatatttgataaggttgacgtgaatggtaagaatgctgctccaatttacaagttcttgaagtctagcaagggtggactttttggggacagcatcaaatggaacttttccaagttcctggtggataaagatggcaaagttgtggatcgttatgctcccactacttcccctcttagcattgagaaagatgtcaagaaactactggggattgcttaa

SEQ ID NO: 459 - protein, 168 aa, Populus balsamifera subsp. trichocarpa
  misc_feature (1)..(168): Ceres ANNOT ID no. 1438708
  misc_feature (9)..(118): Pfam Name: GSHPx Pfam Description: Glutathione peroxidase
  misc_feature: SWISSPROT Homolog: GPX6_ARATH Probable phospholipid hydroperoxide glutathione peroxidase 6, mitochondrial precursor (EC 1.11.1.12) (PHGPx) (AtGPX1) with e-value of 1.0e-114 and BLAST sequence identity of 96.6
  misc_feature: SWISSPROT Homolog: GPX4_SPIOL Probable phospholipid hydroperoxide glutathione peroxidase (EC 1.11.1.12) (PHGPx) with e-value of 1.8e-74 and BLAST sequence identity of 82.4
  misc_feature: SWISSPROT Homolog: GPX4_MESCR Probable phospholipid hydroperoxide glutathione peroxidase (EC 1.11.1.12) (PHGPx) with e-value of 2.4e-72 and BLAST sequence identity of 80.0
  misc_feature: SWISSPROT Homolog: GPX4_NICSY Probable phospholipid hydroperoxide glutathione peroxidase (EC 1.11.1.12) (PHGPx) (6P229) with e-value of 1.3e-71 and BLAST sequence identity of 79.8
  misc_feature: SWISSPROT Homolog: GPX4_TOBAC Probable phospholipid hydroperoxide glutathione peroxidase (EC 1.11.1.12) (PHGPx) (Nt-SubC08) with e-value of 2.2e-71 and BLAST sequence identity of 79.2
  misc_feature 48536:<222: Transcription Factor
  misc_feature: Phenotype: ROSETTE LEAVES - Curled 3 Useful for making ornamental plants with altered leaf shape
  misc_feature: Phenotype: INFLORESCENCE - Late Flowering Useful for modulating flowering time
  misc_feature (1)..(168): Functional Homolog of  Ceres CLONE ID no. 11494 at SEQ ID NO. 479 with e-value of 1.10E-73 and BLAST sequence identity of 82.6
MASQSSAQSVHDFTVKDARENDVDLSIYKGKVLLIVNVASQCGLTNSNYTELTQLYDKYRDQGLEILAFPCNQFGSQEPGNNEQIVEFACTRFKADYPIFDKVDVNGKNAAPIYKFLKSSKGGLFGDSIKWNFSKFLVDKDGKVVDRYAPTTSPLSIEKDVKKLLGIA

SEQ ID NO: 460 - protein, 72 aa, Arabidopsis thaliana
  misc_feature (1)..(72): Ceres CLONE ID no. 11496
  misc_feature (9)..(72): Pfam Name: COX17 Pfam Description: Cytochrome C oxidase copper chaperone (COX17)
  misc_feature: Utility: ABA Useful for making plants with enhanced tolerance to drought
  misc_feature: Phenotype: WHOLE PLANT - ABA Useful for making plants with enhanced tolerance to drought
MSGLQAQDSACSLDKPSKDVVATATKPKKRICCACPDTKKLRDECIVEHGESACTKWIEAHILCLRSESFKV

SEQ ID NO: 461 - DNA, 240 bp, Populus balsamifera subsp. trichocarpa
  misc_feature (1)..(240): Ceres ANNOT ID no. 1520074
  misc_feature: Utility: ABA Useful for making plants with enhanced tolerance to drought
  misc_feature 48664:<222: Transcription Factor
  misc_feature: Phenotype: WHOLE PLANT - ABA Useful for making plants with enhanced tolerance to drought
atgagtgggctacctttgcaaaatgcttccccttcctcagctgtaagccaggtgtcactaattacaacatctggtcaagaatcaaagccaaagaagaagatctgctgtgcttgccctgaaactaagaaactaagggatgaatgcgttgtggagcatggtgaagctgcttgtgcaaaatggatcgatgctcatcgacagtgccttcgtgctgagggctttactgagggctttaacatttga

SEQ ID NO: 462 - protein, 79 aa, Populus balsamifera subsp. trichocarpa
  misc_feature (1)..(79): Ceres ANNOT ID no. 1520074
  misc_feature (26)..(73): Pfam Name: COX17 Pfam Description: Cytochrome C oxidase copper chaperone (COX17)
  misc_feature: SWISSPROT Homolog: COX17_MOUSE Cytochrome c oxidase copper chaperone with e-value of 1.9e-10 and BLAST sequence identity of 54.9
  misc_feature: SWISSPROT Homolog: COX17_CANFA Cytochrome c oxidase copper chaperone with e-value of 2.4e-10 and BLAST sequence identity of 57.4
  misc_feature: SWISSPROT Homolog: COX17_HUMAN Cytochrome c oxidase copper chaperone with e-value of 2.4e-10 and BLAST sequence identity of 57.4
  misc_feature: SWISSPROT Homolog: COX17_PIG Cytochrome c oxidase copper chaperone (Dopuin) with e-value of 2.4e-10 and BLAST sequence identity of 57.4
  misc_feature: Utility: ABA Useful for making plants with enhanced tolerance to drought
  misc_feature 48740:<222: Transcription Factor
  misc_feature: Phenotype: WHOLE PLANT - ABA Useful for making plants with enhanced tolerance to drought
  misc_feature (1)..(79): Functional Homolog of  Ceres CLONE ID no. 11496 at SEQ ID NO. 482 with e-value of 1.20E-19 and BLAST sequence identity of 60.0
MSGLPLQNASPSSAVSQVSLITTSGQESKPKKKICCACPETKKLRDECVVEHGEAACAKWIDAHRQCLRAEGFTEGFNI

SEQ ID NO: 463 - protein, 119 aa, Arabidopsis thaliana
  misc_feature (1)..(119): Ceres CLONE ID no. 11830
  misc_feature (29)..(115): Pfam Name: X8 Pfam Description: X8 domain
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
MSTFLIRILLPLLIIAMTLPRRSEAESEQWCIADEQTPDDELQAALDWACGKGGADCSKMQQENQPCFLPNTIRDHASFAFNSYYQTYKNKGGSCYFKGAAMITELDPSHGSCQYEYNP

SEQ ID NO: 464 - DNA, 354 bp, Populus balsamifera subsp. trichocarpa
  misc_feature (1)..(354): Ceres ANNOT ID no. 1472114
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 48909:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
atgccaatcctttggaaaaggacaatgctagcccttcttatcctgtccatagctcctaggaaatcagatggggagttagagcaatggtgcatagcagatgagcagaccccagatgatgagttgcagatagcattggactgggcttgtgggaaaggtggtgcagactgcagtaagattcaagtgaaccagccttgctatttgccaaatactgtgagagaccatgcttcctatgccttcaacaactacttccagaagttcaagcacaaaggtggatcttgctacttcaaaggagctgctatcattacagaacttgaccccagtcatagctcttgccagtacgagttccatccctga

SEQ ID NO: 465 - protein, 117 aa, Populus balsamifera subsp. trichocarpa
  misc_feature (1)..(117): Ceres ANNOT ID no. 1472114
  misc_feature (28)..(113): Pfam Name: X8 Pfam Description: X8 domain
  misc_feature: SWISSPROT Homolog: E131_ARATH Putative glucan endo-1,3-beta-glucosidase 1 precursor with e-value of 7.9e-23 and BLAST sequence identity of 52.7
  misc_feature: SWISSPROT Homolog: E131_ARATH EC 3.2.1.39 ((1->3)-beta-glucan endohydrolase)((1->3)- beta-glucanase) (Beta-1,3-endoglucanase) ( Beta-1,3-glucanase)
  misc_feature: SWISSPROT Homolog: E134_ARATH Putative glucan endo-1,3-beta-glucosidase 4 precursor with e-value of 2.0e-21 and BLAST sequence identity of 49.4
  misc_feature: SWISSPROT Homolog: E134_ARATH EC 3.2.1.39) ((1->3)-beta-glucan endohydrolase) ((1->3)-beta- glucanase) (Beta-1,3-glucanase)
  misc_feature: SWISSPROT Homolog: E133_ARATH Putative glucan endo-1,3-beta-glucosidase 3 precursor with e-value of 6.3e-19 and BLAST sequence identity of 44.1
  misc_feature: SWISSPROT Homolog: E133_ARATH EC 3.2.1.39 ((1->3)-beta-glucan endohydrolase) ((1->3)- beta -glucanase) (Beta-1,3-endoglucanase) (Beta-1,3-glucanase)
  misc_feature: SWISSPROT Homolog: E13B_WHEAT Glucan endo-1,3-beta-glucosidase precursor with e-value of 2.5e-14 and BLAST sequence identity of 35.4
  misc_feature: SWISSPROT Homolog: E13B_WHEAT EC 3.2.1.39 ((1->3)- beta-glucan endohydrolase) ((1->3)-beta-glucanase)( Beta-1,3-endoglucanase)
  misc_feature: SWISSPROT Homolog: EA6_ARATH Probable glucan endo-1,3-beta-glucosidase A6 precursor with e-value of 3.5e-10 and BLAST sequence identity of 30.0
  misc_feature: SWISSPROT Homolog: EA6_ARATH EC 3.2.1.39 ((1->3)-beta-glucan endohydrolase) ((1->3)- beta-glucanase) ((1->3)-beta-glucanase) ( Beta-1,3-endoglucanase) (Anther-specific protein A6)
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 49075:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
  misc_feature (1)..(117): Functional Homolog of  Ceres CLONE ID no. 11830 at SEQ ID NO. 485 with e-value of 1.20E-46 and BLAST sequence identity of 76.5
MPILWKRTMLALLILSIAPRKSDGELEQWCIADEQTPDDELQIALDWACGKGGADCSKIQVNQPCYLPNTVRDHASYAFNNYFQKFKHKGGSCYFKGAAIITELDPSHSSCQYEFHP

SEQ ID NO: 466 - DNA, 390 bp, Populus balsamifera subsp. trichocarpa
  misc_feature (1)..(390): Ceres ANNOT ID no. 1525524
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 49177:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
atgccaatcctttggaaaaggacaatgctagcccttcttatcctgtccatagctcctaggaaatcagatggggagttagagcaatggtgcatagcagatgagcagaccccagatgatgagttgcagatagcattggactgggcttgtgggaaaggtggtgcagactgcagtaagattcaagtgaaccagccttgctatttgccaaatactgtgagagaccatgcttcctatgccttcaacaactacttccagaagttcaagcacaaaggtggatcttgctacttcaaaggagctgctatcattacagaacttgaccccagtaagcacttgctaagctttttttttttttttaatttttttatctctagttatttctcgacttgtttttaa

SEQ ID NO: 467 - protein, 129 aa, Populus balsamifera subsp. trichocarpa
  misc_feature (1)..(129): Ceres ANNOT ID no. 1525524
  misc_feature (28)..(110): Pfam Name: X8 Pfam Description: X8 domain
  misc_feature: SWISSPROT Homolog: E131_ARATH Putative glucan endo-1,3-beta-glucosidase 1 precursor with e-value of 7.9e-23 and BLAST sequence identity of 52.7
  misc_feature: SWISSPROT Homolog: E131_ARATH EC 3.2.1.39 ((1->3)-beta-glucan endohydrolase)((1->3)- beta-glucanase) (Beta-1,3-endoglucanase) ( Beta-1,3-glucanase)
  misc_feature: SWISSPROT Homolog: E134_ARATH Putative glucan endo-1,3-beta-glucosidase 4 precursor with e-value of 2.0e-21 and BLAST sequence identity of 49.4
  misc_feature: SWISSPROT Homolog: E134_ARATH EC 3.2.1.39) ((1->3)-beta-glucan endohydrolase) ((1->3)-beta- glucanase) (Beta-1,3-glucanase)
  misc_feature: SWISSPROT Homolog: E133_ARATH Putative glucan endo-1,3-beta-glucosidase 3 precursor with e-value of 6.3e-19 and BLAST sequence identity of 44.1
  misc_feature: SWISSPROT Homolog: E133_ARATH EC 3.2.1.39 ((1->3)-beta-glucan endohydrolase) ((1->3)- beta -glucanase) (Beta-1,3-endoglucanase) (Beta-1,3-glucanase)
  misc_feature: SWISSPROT Homolog: E13B_WHEAT Glucan endo-1,3-beta-glucosidase precursor with e-value of 2.5e-14 and BLAST sequence identity of 35.4
  misc_feature: SWISSPROT Homolog: E13B_WHEAT EC 3.2.1.39 ((1->3)- beta-glucan endohydrolase) ((1->3)-beta-glucanase)( Beta-1,3-endoglucanase)
  misc_feature: SWISSPROT Homolog: EA6_ARATH Probable glucan endo-1,3-beta-glucosidase A6 precursor with e-value of 3.5e-10 and BLAST sequence identity of 30.0
  misc_feature: SWISSPROT Homolog: EA6_ARATH EC 3.2.1.39 ((1->3)-beta-glucan endohydrolase) ((1->3)- beta-glucanase) ((1->3)-beta-glucanase) ( Beta-1,3-endoglucanase) (Anther-specific protein A6)
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 49345:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
  misc_feature (1)..(129): Functional Homolog of  Ceres CLONE ID no. 11830 at SEQ ID NO. 485 with e-value of 1.79E-41 and BLAST sequence identity of 77.2
MPILWKRTMLALLILSIAPRKSDGELEQWCIADEQTPDDELQIALDWACGKGGADCSKIQVNQPCYLPNTVRDHASYAFNNYFQKFKHKGGSCYFKGAAIITELDPSKHLLSFFFFFNFFISSYFSTCF

SEQ ID NO: 468 - DNA, 357 bp, Populus balsamifera subsp. trichocarpa
  misc_feature (1)..(357): Ceres ANNOT ID no. 1453309
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 49450:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
atgtcaccaaattttccaaggattcttctcctagctctgtccttccatgctttaatgctgcaaaaatcagagggtcaatttgaggaatggtgcatagctgatgagcaaacaccagatgatgagttgcaaagggccatggactgggcatgtgggaagggaggtgcagattgcagcaagattcaaatgaatcaaccttgttatatgccaaatacaataagggatcatgcctcttatgccttcaatgattattaccagaagtttaagcataaaggagcaacttgttacttcaacgctgctgctctcatcaccgatcttgatccaagtcagcactcttgcaaatttgattatcttccctga

SEQ ID NO: 469 - protein, 118 aa, Populus balsamifera subsp. trichocarpa
  misc_feature (1)..(118): Ceres ANNOT ID no. 1453309
  misc_feature (29)..(114): Pfam Name: X8 Pfam Description: X8 domain
  misc_feature: SWISSPROT Homolog: E131_ARATH Putative glucan endo-1,3-beta-glucosidase 1 precursor with e-value of 7.9e-23 and BLAST sequence identity of 52.7
  misc_feature: SWISSPROT Homolog: E131_ARATH EC 3.2.1.39 ((1->3)-beta-glucan endohydrolase)((1->3)- beta-glucanase) (Beta-1,3-endoglucanase) ( Beta-1,3-glucanase)
  misc_feature: SWISSPROT Homolog: E134_ARATH Putative glucan endo-1,3-beta-glucosidase 4 precursor with e-value of 2.0e-21 and BLAST sequence identity of 49.4
  misc_feature: SWISSPROT Homolog: E134_ARATH EC 3.2.1.39) ((1->3)-beta-glucan endohydrolase) ((1->3)-beta- glucanase) (Beta-1,3-glucanase)
  misc_feature: SWISSPROT Homolog: E133_ARATH Putative glucan endo-1,3-beta-glucosidase 3 precursor with e-value of 6.3e-19 and BLAST sequence identity of 44.1
  misc_feature: SWISSPROT Homolog: E133_ARATH EC 3.2.1.39 ((1->3)-beta-glucan endohydrolase) ((1->3)- beta -glucanase) (Beta-1,3-endoglucanase) (Beta-1,3-glucanase)
  misc_feature: SWISSPROT Homolog: E13B_WHEAT Glucan endo-1,3-beta-glucosidase precursor with e-value of 2.5e-14 and BLAST sequence identity of 35.4
  misc_feature: SWISSPROT Homolog: E13B_WHEAT EC 3.2.1.39 ((1->3)- beta-glucan endohydrolase) ((1->3)-beta-glucanase)( Beta-1,3-endoglucanase)
  misc_feature: SWISSPROT Homolog: EA6_ARATH Probable glucan endo-1,3-beta-glucosidase A6 precursor with e-value of 3.5e-10 and BLAST sequence identity of 30.0
  misc_feature: SWISSPROT Homolog: EA6_ARATH EC 3.2.1.39 ((1->3)-beta-glucan endohydrolase) ((1->3)- beta-glucanase) ((1->3)-beta-glucanase) ( Beta-1,3-endoglucanase) (Anther-specific protein A6)
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature 49616:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - pH (high) Useful for making plants tolerant to high pH or low phosphate
  misc_feature (1)..(118): Functional Homolog of  Ceres CLONE ID no. 11830 at SEQ ID NO. 485 with e-value of 2.10E-40 and BLAST sequence identity of 64.4
MSPNFPRILLLALSFHALMLQKSEGQFEEWCIADEQTPDDELQRAMDWACGKGGADCSKIQMNQPCYMPNTIRDHASYAFNDYYQKFKHKGATCYFNAAALITDLDPSQHSCKFDYLP

SEQ ID NO: 470 - protein, 124 aa, Arabidopsis thaliana
  misc_feature (1)..(124): Ceres CLONE ID no. 11843
  misc_feature (2)..(124): Pfam Name: DUF343 Pfam Description: Protein of unknown function (DUF343)
  misc_feature: Phenotype: WHOLE PLANT - Small Useful for modulating plant size
MRLITHNMLSCNIKGVTSGFPLRIEAGNVIEKEVDFNPDFIRHMFAKIEWKALVEGARSMGYAELPEESPDAAVLKSDEPFLKKLHHALLELHLEEGALVCPETGRKFPVNKGIPNMLLHEDEV

SEQ ID NO: 471 - DNA, 369 bp, Populus balsamifera subsp. trichocarpa
  misc_feature (1)..(369): Ceres ANNOT ID no. 1443460
  misc_feature 49746:<222: Transcription Factor
  misc_feature: Phenotype: WHOLE PLANT - Small Useful for modulating plant size
atgaggctatttactcacaacatgctatcctccaatatcaagggagtagcgaacggcttccctctaagaatcgaggtagatcaagtggtcgaaaagcaagtggacttcaatcccgatttcctcagaaacatgttcccaaagctcgagtggaaagcccttgtcgatgccgcacgaaccatgggctacaccgagcttcctgaggaggccgattcgtcgatgctggagtctgaggaatttttaaggaagttgcaccacgcgcttttggagcttcacctcgaagaaggggctttggtttgtcctgagactgggagaaagtttccggtcaataaagggattcctaatatgcttcttcacgaagatgaggtttga

SEQ ID NO: 472 - protein, 122 aa, Populus balsamifera subsp. trichocarpa
  misc_feature (1)..(122): Ceres ANNOT ID no. 1443460
  misc_feature (2)..(122): Pfam Name: DUF343 Pfam Description: Protein of unknown function (DUF343)
  misc_feature: SWISSPROT Homolog: U315_ARATH UPF0315 protein At1g22270 with e-value of 4.5e-64 and BLAST sequence identity of 100.0
  misc_feature: SWISSPROT Homolog: U316_ARATH UPF0315 protein At1g78190 with e-value of 3.4e-50 and BLAST sequence identity of 78.2
  misc_feature: SWISSPROT Homolog: U315_MOUSE UPF0315 protein with e-value of 5.2e-31 and BLAST sequence identity of 50.0
  misc_feature: SWISSPROT Homolog: U315_HUMAN UPF0315 protein AD-001 with e-value of 2.6e-27 and BLAST sequence identity of 46.0
  misc_feature: SWISSPROT Homolog: U315_DROME UPF0315 protein CG12975 with e-value of 2.8e-23 and BLAST sequence identity of 47.2
  misc_feature 49826:<222: Transcription Factor
  misc_feature: Phenotype: WHOLE PLANT - Small Useful for modulating plant size
  misc_feature (1)..(122): Functional Homolog of  Ceres CLONE ID no. 11843 at SEQ ID NO. 492 with e-value of 2.30E-50 and BLAST sequence identity of 80.3
MRLFTHNMLSSNIKGVANGFPLRIEVDQVVEKQVDFNPDFLRNMFPKLEWKALVDAARTMGYTELPEEADSSMLESEEFLRKLHHALLELHLEEGALVCPETGRKFPVNKGIPNMLLHEDEV

SEQ ID NO: 473 - DNA, 369 bp, Populus balsamifera subsp. trichocarpa
  misc_feature (1)..(369): Ceres ANNOT ID no. 1504967
  misc_feature 49883:<222: Transcription Factor
  misc_feature: Phenotype: WHOLE PLANT - Small Useful for modulating plant size
atgaggctatttactcacaacatgctgtcctccaatatcaagggagtttccaacggcttccctttacgaatcgaggtagagcaagtgctcgaaaagcaagtggacttcaatcccgatttcgtcaaaaacttgttccctaagctcgagtggaaagcccttgtcgacggcgcacgaaccttgggctacgctgagcttcccgaggaggccgattcatcgatgcttgagtctgaggaattcttaaggaaggttcaccacgctcttttggagcttcacctcgaagagggggctttgacttgtcctgagacaggaagaaagtttccggttactaaagggatacccaatatgcttcttcatgaagatgaggtttga

SEQ ID NO: 474 - protein, 122 aa, Populus balsamifera subsp. trichocarpa
  misc_feature (1)..(122): Ceres ANNOT ID no. 1504967
  misc_feature (2)..(122): Pfam Name: DUF343 Pfam Description: Protein of unknown function (DUF343)
  misc_feature: SWISSPROT Homolog: U315_ARATH UPF0315 protein At1g22270 with e-value of 4.5e-64 and BLAST sequence identity of 100.0
  misc_feature: SWISSPROT Homolog: U316_ARATH UPF0315 protein At1g78190 with e-value of 3.4e-50 and BLAST sequence identity of 78.2
  misc_feature: SWISSPROT Homolog: U315_MOUSE UPF0315 protein with e-value of 5.2e-31 and BLAST sequence identity of 50.0
  misc_feature: SWISSPROT Homolog: U315_HUMAN UPF0315 protein AD-001 with e-value of 2.6e-27 and BLAST sequence identity of 46.0
  misc_feature: SWISSPROT Homolog: U315_DROME UPF0315 protein CG12975 with e-value of 2.8e-23 and BLAST sequence identity of 47.2
  misc_feature 49963:<222: Transcription Factor
  misc_feature: Phenotype: WHOLE PLANT - Small Useful for modulating plant size
  misc_feature (1)..(122): Functional Homolog of  Ceres CLONE ID no. 11843 at SEQ ID NO. 492 with e-value of 4.29E-49 and BLAST sequence identity of 77.0
MRLFTHNMLSSNIKGVSNGFPLRIEVEQVLEKQVDFNPDFVKNLFPKLEWKALVDGARTLGYAELPEEADSSMLESEEFLRKVHHALLELHLEEGALTCPETGRKFPVTKGIPNMLLHEDEV

SEQ ID NO: 475 - protein, 298 aa, Arabidopsis thaliana
  misc_feature (1)..(298): Ceres CLONE ID no. 11854
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
MSDVTGDLAAVSEAKGGSDAARISEVKAWLTSQFEAVGKEVPNFEYTHRSITHLYNLATASQAKSQAATIVANDFRLKASEYRAQAARIREILESAGMSQESLPSNVVSSAQVLANVANLLNIRDTELSSFLVAMGDISLRKTGVEEKRAKAQKESNALLDYTRKAIQRLTYLKKILAQLEDDVVPCESQMENWKTNLEVMAVKEEQYIQQYKKYEMLLNRVGYTPKISHRELVEMAEHRKELDKMTKPVLDTLRSYQDLPPDKALAALAIEDKKRQFTAAEKYLEEVLQSALETNDE

SEQ ID NO: 476 - DNA, 858 bp, Populus balsamifera subsp. trichocarpa
  misc_feature (1)..(858): Ceres ANNOT ID no. 1506763
  misc_feature 50127:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
atgtcggtgacggaggcgaagagtggtggtaatgatgctggtagaattgcagaagtgaaggcgtggcttacctcacaatttgatgcagcggggaaagatgttcctgaattcgaatatacgccacgcagcattgctcatttatataatttagctgctgcttcgcaagcgaaaacacaggctgccaacattgttgcgaatgattttcgccagaaagctgtggagtatcgtgcacaagctgcaaggattagagagatactcgagaatgtgggattagcacaggagagtttgccctcgaatgtggtttcatcagctcaagttcttgcaaatgtagcaaactttttgaatataagagacacggaactaacaatgggggatctttctttaagaaagactggagtagaagagaagagagctaaagtacagaaggagtccaaaattctccttgattacacacggaaggcaatagccaggcttacctatttaaaaagaacactcgcacaactagaggatgatgtacctccttgcgaggctcagatggagaattggaagacaaatttagcagttatggcatcaaaggagcgacaatatttgcagcagtactctaactacaaggcacttcttaatcgtgtgggctacacccaagacattagccatgggatgctggtagaaatggctgagcacagacaagatttggagaagaaaacaaaacccatcatggatactttgaggagttatcaggacttgcctccggataaagccttggctactttagccattgaggacaagaaaaggcagtatgctgctgccgagaagtatctcgaagatgtattgcaatcagcccttgccacaacagattaa

SEQ ID NO: 477 - protein, 285 aa, Populus balsamifera subsp. trichocarpa
  misc_feature (1)..(285): Ceres ANNOT ID no. 1506763
  misc_feature: SWISSPROT Homolog: CCDC5_MOUSE Coiled-coil domain-containing protein 5 with e-value of 3.6e-23 and BLAST sequence identity of 30.0
  misc_feature: SWISSPROT Homolog: CCDC5_RAT Coiled-coil domain-containing protein 5 with e-value of 2.0e-22 and BLAST sequence identity of 29.3
  misc_feature: SWISSPROT Homolog: CCDC5_HUMAN Coiled-coil domain-containing protein 5 Enhancer of invasion-cluster (HEI-C) with e-value of 5.3e-22 and BLAST sequence identity of 27.6
  misc_feature 50232:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature (1)..(285): Functional Homolog of  Ceres CLONE ID no. 11854 at SEQ ID NO. 497 with e-value of 1.09E-114 and BLAST sequence identity of 80.5
MSVTEAKSGGNDAGRIAEVKAWLTSQFDAAGKDVPEFEYTPRSIAHLYNLAAASQAKTQAANIVANDFRQKAVEYRAQAARIREILENVGLAQESLPSNVVSSAQVLANVANFLNIRDTELTMGDLSLRKTGVEEKRAKVQKESKILLDYTRKAIARLTYLKRTLAQLEDDVPPCEAQMENWKTNLAVMASKERQYLQQYSNYKALLNRVGYTQDISHGMLVEMAEHRQDLEKKTKPIMDTLRSYQDLPPDKALATLAIEDKKRQYAAAEKYLEDVLQSALATTD

SEQ ID NO: 478 - DNA, 957 bp, Populus balsamifera subsp. trichocarpa
  misc_feature (1)..(957): Ceres ANNOT ID no. 1453614
  misc_feature 50347:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
atgtcggtgacggaggcgaagagtggtggtaatgatgctggtagaattgcagaagtgaaggcgtggcttacctcacaatttgatgcagcggggaaagatgttcctgaattcgaatatacgccacgcagcattgctcatttatataatttagctgctgcttcgcaagcgaaaacacaggctgccaacattgttgcgaatgattttcgccagaaagctgtggagtatcgtgcacaagctgcaaggattagagagatactcgagaatgtgggattagcacaggagagtttgccctcgaatgtggtttcatcagctcaagttcttgcaaatgtagcaaactttttgaatataagagacacggaactaagcaggtgggatgtcattctagatactaaattgcatctttgttcttgtctttttaatgtcacaagtttaaactggagaaatgcaaatagttttcttgtagcaatgggggatctttctttaagaaagactggagtagaagagaagagagctaaagtacagaaggagtccaaaattctccttgattacacacggaaggcaatagccaggcttacctatttaaaaagaacactcgcacaactagaggatgatgtacctccttgcgaggctcagatggagaattggaagacaaatttagcagttatggcatcaaaggagcgacaatatttgcagcagtactctaactacaaggcacttcttaatcgtgtgggctacacccaagacattagccatgggatgctggtagaaatggctgagcacagacaagatttggagaagaaaacaaaacccatcatggatactttgaggagttatcaggacttgcctccggataaagccttggctactttagccattgaggacaagaaaaggcagtatgctgctgccgagaagtatctcgaagatgtattgcaatcagcccttgccacaacagattaa

SEQ ID NO: 479 - protein, 318 aa, Populus balsamifera subsp. trichocarpa
  misc_feature (1)..(318): Ceres ANNOT ID no. 1453614
  misc_feature: SWISSPROT Homolog: CCDC5_MOUSE Coiled-coil domain-containing protein 5 with e-value of 3.6e-23 and BLAST sequence identity of 30.0
  misc_feature: SWISSPROT Homolog: CCDC5_RAT Coiled-coil domain-containing protein 5 with e-value of 2.0e-22 and BLAST sequence identity of 29.3
  misc_feature: SWISSPROT Homolog: CCDC5_HUMAN Coiled-coil domain-containing protein 5 Enhancer of invasion-cluster (HEI-C) with e-value of 5.3e-22 and BLAST sequence identity of 27.6
  misc_feature 50454:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature (1)..(318): Functional Homolog of  Ceres CLONE ID no. 11854 at SEQ ID NO. 497 with e-value of 1.79E-112 and BLAST sequence identity of 81.25
MSVTEAKSGGNDAGRIAEVKAWLTSQFDAAGKDVPEFEYTPRSIAHLYNLAAASQAKTQAANIVANDFRQKAVEYRAQAARIREILENVGLAQESLPSNVVSSAQVLANVANFLNIRDTELSRWDVILDTKLHLCSCLFNVTSLNWRNANSFLVAMGDLSLRKTGVEEKRAKVQKESKILLDYTRKAIARLTYLKRTLAQLEDDVPPCEAQMENWKTNLAVMASKERQYLQQYSNYKALLNRVGYTQDISHGMLVEMAEHRQDLEKKTKPIMDTLRSYQDLPPDKALATLAIEDKKRQYAAAEKYLEDVLQSALATTD

SEQ ID NO: 480 - protein, 286 aa, Arabidopsis thaliana
  misc_feature (1)..(286): Ceres CLONE ID no. 11929
  misc_feature (30)..(265): Pfam Name: MIP Pfam Description: Major intrinsic protein
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
MTKEVVGDKRSFSGKDYQDPPPEPLFDATELGKWSFYRALIAEFIATLLFLYVTIMTVIGYKSQTDPALNPDQCTGVGVLGIAWAFGGMIFILVYCTAGISGGHINPAVTFGLLLARKVTLVRAVMYMVAQCLGAICGVALVKAFQSAYFTRYGGGANGLSDGYSIGTGVAAEIIGTFVLVYTVFSATDPKRSARDSHVPVLAPLPIGFAVFIVHLATIPITGTGINPARSLGAAIIYNKDKAWDHHWIFWVGPFAGAAIAAFYHQFVLRAGAIKALGSFRSQPHV

SEQ ID NO: 481 - DNA, 858 bp, Populus balsamifera subsp. trichocarpa
  misc_feature (1)..(858): Ceres ANNOT ID no. 1518415
  misc_feature 50664:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atggcgaaggacatggaagttgcagaggcaggatcattctctgcgaaggactaccatgacccaccaccagcaccattgtttgatgctaaagagttaacaaagtggtcattttacagggccttgattgctgagtttatagcaacactgctctttctttatatcactgttttgactgttattggttacaagagccagattgatggaagtgctgattcttgtggtggggttggtattcttggtattgcctgggcctttggtggcatgatctttgttcttgtatactgcactgctggtatttcagggggtcacattaacccagcagtgacatttgggcttttcctagccaggaaggtctctttgatccgggctgtgatgtacatggtggctcaatgcttaggagccatatgtggcgttgggcttgttaaggccttccaaaagtcttactacaagaagtatggtggtggagccaacactttggccgatgggttcagcaccggcactggattgggtgctgagatcattggcacttttgtcctggtctacactgttttctctgctacagatccaaagaggagtgctagggactcccatgtgcctgttttggctcctcttccaattggatttgctgtgttcatggttcacttggccaccatccccatcactggaactggcatcaaccctgctaggagtctgggagccgctgttatctacaaccaagacaaggcctgggatggccattggatcttctgggttggacccttcgctggtgcagccattgcagctttctaccaccaattcatcttgagagcaggagctgtcaaggctcttggatcattcaggagcgcccaacggttttaa

SEQ ID NO: 482 - protein, 285 aa, Populus balsamifera subsp. trichocarpa
  misc_feature (1)..(285): Ceres ANNOT ID no. 1518415
  misc_feature (31)..(264): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 50772:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(285): Functional Homolog of  Ceres CLONE ID no. 11929 at SEQ ID NO. 502 with e-value of 6.19E-128 and BLAST sequence identity of 84.2
MAKDMEVAEAGSFSAKDYHDPPPAPLFDAKELTKWSFYRALIAEFIATLLFLYITVLTVIGYKSQIDGSADSCGGVGILGIAWAFGGMIFVLVYCTAGISGGHINPAVTFGLFLARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDGHWIFWVGPFAGAAIAAFYHQFILRAGAVKALGSFRSAQRF

SEQ ID NO: 483 - DNA, 858 bp, Populus balsamifera subsp. trichocarpa
  misc_feature (1)..(858): Ceres ANNOT ID no. 1475405
  misc_feature 50866:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atgggcaaggacattgaagttggaggcgagttcagtgccaaggactatcatgaccctccgccagcgccattgatcgatgctgaggaaataacccagtggtctttttatcgggctattattgctgagttcgttgccacgctcttgtttctgtacatcactgttttgaccgtgataggttacaagagccagactgacgttaataaaaacggtgatgaatgtggtggggttggcattcttggcatcgcttgggcctttggtggcatgatttttattcttgtttactgcactgctggtatctcaggtggacatattaacccggctgtgactttcggtttgttcttggctaggaaggtctccttggtgcgtgccattctatacatggtggctcagtgcctgggggccatatgtggatgtggacttgtgaaagcattccaaaagtcttattacacaaactatggtggtggagccaatggacttgctaacggatacagcaagggaactgggttaggtgctgagatcattggcacctttgttcttgtctacactgttttctctgctaccgaccccaagaggaatgcaagggattctcatgttcctgtactggcaccacttcccattggatttgctgttttcatggttcacctggccactattccaatcaccggtactggtatcaaccctgctaggagcttcggagctgcagtgatcttcaacaaggaaaaggcatgggatgaccattggattttctgggttggacctttcattggtgctgcaattgctgccttatatcaccagttcatcttgagagcagctgctgttaaatcccttggatccttccggagctctcccaacatataa

SEQ ID NO: 484 - protein, 285 aa, Populus balsamifera subsp. trichocarpa
  misc_feature (1)..(285): Ceres ANNOT ID no. 1475405
  misc_feature (29)..(264): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 50974:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(285): Functional Homolog of  Ceres CLONE ID no. 11929 at SEQ ID NO. 502 with e-value of 9.99E-126 and BLAST sequence identity of 80.2
MGKDIEVGGEFSAKDYHDPPPAPLIDAEEITQWSFYRAIIAEFVATLLFLYITVLTVIGYKSQTDVNKNGDECGGVGILGIAWAFGGMIFILVYCTAGISGGHINPAVTFGLFLARKVSLVRAILYMVAQCLGAICGCGLVKAFQKSYYTNYGGGANGLANGYSKGTGLGAEIIGTFVLVYTVFSATDPKRNARDSHVPVLAPLPIGFAVFMVHLATIPITGTGINPARSFGAAVIFNKEKAWDDHWIFWVGPFIGAAIAALYHQFILRAAAVKSLGSFRSSPNI

SEQ ID NO: 485 - DNA, 858 bp, Populus balsamifera subsp. trichocarpa
  misc_feature (1)..(858): Ceres ANNOT ID no. 1457917
  misc_feature 51068:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atggcaaaggatactgaagtggcagaggcaggatcattctctgcaaaagattaccaagacccacccccagcaccattgattgatgccgaagagctaacaaagtggtcattttacagggccttgattgctgagtttatagcaactatgctctttctttacatcactgttttgactgttattgggtacaaaagccagattgatggaaatgctgatccttgtggtggggttggtattcttggtattgcttgggcctttggtggcatgatctttgttcttgtttactgcactgctggtatttcagggggtcacattaacccagcagtgacatttgggctgttcttggccaggaaggtgtctttgatcagggctgtgatgtacatggtggcccaatgcgcgggagccatatgtggtgttgggttggtcaaggccttccaaaagtcttactacacaaaatataatggcggagccaacgttttggctgatgggtacagcacaggcactggattgggcgctgagattattgggacttttgtcctggtctacactgtgttctctgctactgatcccaagaggagtgctagggactcccatgtgcctgtattggctcctctcccaattggatttgctgtgttcatggttcacttggccaccatcccaatcacaggaactggcatcaaccctgctaggagttttggagctgctgttatctacaacaacaagaaggcctggcatgaccagtggatcttttgggctggacccttcattggtgcagccatagcagccttctaccaccaattcatcttgagagcaggagctattaaggctctcgggtcattcaggagcaacccgaatgtctaa

SEQ ID NO: 486 - protein, 285 aa, Populus balsamifera subsp. trichocarpa
  misc_feature (1)..(285): Ceres ANNOT ID no. 1457917
  misc_feature (31)..(264): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 51176:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(285): Functional Homolog of  Ceres CLONE ID no. 11929 at SEQ ID NO. 502 with e-value of 2.20E-125 and BLAST sequence identity of 82.0
MAKDTEVAEAGSFSAKDYQDPPPAPLIDAEELTKWSFYRALIAEFIATMLFLYITVLTVIGYKSQIDGNADPCGGVGILGIAWAFGGMIFVLVYCTAGISGGHINPAVTFGLFLARKVSLIRAVMYMVAQCAGAICGVGLVKAFQKSYYTKYNGGANVLADGYSTGTGLGAEIIGTFVLVYTVFSATDPKRSARDSHVPVLAPLPIGFAVFMVHLATIPITGTGINPARSFGAAVIYNNKKAWHDQWIFWAGPFIGAAIAAFYHQFILRAGAIKALGSFRSNPNV

SEQ ID NO: 487 - DNA, 855 bp, Populus balsamifera subsp. trichocarpa
  misc_feature (1)..(855): Ceres ANNOT ID no. 1515353
  misc_feature 51270:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctgtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaa

SEQ ID NO: 488 - protein, 284 aa, Populus balsamifera subsp. trichocarpa
  misc_feature (1)..(284): Ceres ANNOT ID no. 1515353
  misc_feature (30)..(265): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 51378:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(284): Functional Homolog of  Ceres CLONE ID no. 11929 at SEQ ID NO. 502 with e-value of 6.60E-124 and BLAST sequence identity of 80.1
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPVLAPLPIGFAVFMVHLATIPITGTGINPARSFGAAVIFNQSKAWDDHWLFWVGPFIGAAIAAFYHQFILRAAAIKALGSFRSNA

SEQ ID NO: 489 - DNA, 858 bp, Populus balsamifera subsp. trichocarpa
  misc_feature (1)..(858): Ceres ANNOT ID no. 1484925
  misc_feature 51472:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atgggcaaggacattgaagttggaggcgaattcagtgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcttgggggccatatgtggatgtggactcgtgaaagctttccaaaagtcgtattacacaaagtacggtggtggagtcaatgaacttgctacaggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacgaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaa

SEQ ID NO: 490 - protein, 285 aa, Populus balsamifera subsp. trichocarpa
  misc_feature (1)..(285): Ceres ANNOT ID no. 1484925
  misc_feature (29)..(264): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 51580:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(285): Functional Homolog of  Ceres CLONE ID no. 11929 at SEQ ID NO. 502 with e-value of 1.79E-123 and BLAST sequence identity of 79.9
MGKDIEVGGEFSAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGVNELATGFSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 491 - DNA, 858 bp, Populus balsamifera subsp. trichocarpa
  misc_feature (1)..(858): Ceres ANNOT ID no. 1484924
  misc_feature 51674:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atgggcaaggacgttgaagttagaggcgaattcattgccaaggactatcatgaccctccaccagcaccattgattgatgccgaggagctcacccagtggtctttgtatagggccatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcctgggggccatatgtggatgtggactcgtgaaagctttccaaaagtcgtattacacaaagtacggtggtggagccaatgaacttgctactggattcagcaagggcactggattaggtgctgagatcatcggtacctttgttctcgtctacactgtcttctctgctactgacccaaagaggaacgcaagggactcccatgttcccgtgttggcaccacttcccatcggatttgctgtcttcatggttcacttggccactattccaatcactggaactggtatcaacccagctaggagctttggagctgctgtgatatacaacaaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaa

SEQ ID NO: 492 - protein, 285 aa, Populus balsamifera subsp. trichocarpa
  misc_feature (1)..(285): Ceres ANNOT ID no. 1484924
  misc_feature (29)..(264): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 51782:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(285): Functional Homolog of  Ceres CLONE ID no. 11929 at SEQ ID NO. 502 with e-value of 1.79E-123 and BLAST sequence identity of 81.0
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 493 - DNA, 909 bp, Populus balsamifera subsp. trichocarpa
  misc_feature (1)..(909): Ceres ANNOT ID no. 1462053
  misc_feature 51876:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctcatgagggtcgtttcctttctgactttgattgtttttctcatctcgggatcttggtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaa

SEQ ID NO: 494 - protein, 302 aa, Populus balsamifera subsp. trichocarpa
  misc_feature (1)..(302): Ceres ANNOT ID no. 1462053
  misc_feature (30)..(283): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 51986:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(302): Functional Homolog of  Ceres CLONE ID no. 11929 at SEQ ID NO. 502 with e-value of 2.39E-119 and BLAST sequence identity of 80.1
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPHEGRFLSDFDCFSHLGILVLAPLPIGFAVFMVHLATIPITGTGINPARSFGAAVIFNQSKAWDDHWLFWVGPFIGAAIAAFYHQFILRAAAIKALGSFRSNA

SEQ ID NO: 495 - DNA, 840 bp, Populus balsamifera subsp. trichocarpa
  misc_feature (1)..(840): Ceres ANNOT ID no. 1450576
  misc_feature 52083:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
atgtcaaaggaagtgagtgaagtagggcaaactcacgggaaagattatgttgatccaccacctgcaccacttcttgacttgggtgaactcaagctctggtctttctatagagctctcatagctgagttcattgctacccttcttttcctctatgtcactgtggctactgttataggccacaagtcaaacaaagacccttgtgacggagttggtttgcttggcattgcatgggcttttggtggcatgatctttatccttgtttactgcaccgctggtatctctggtggacatattaacccagcagtcacttttgggctgttcttggccaggaaagtatcactgatcagggctgtggcttacatggtggctcaatgcttgggtgctatctgtggtgttggcttggtcaaggccttcatgaagaaaaactacaactctcttggtggtggtgctaacacagtagccatgggatacaacactggcacagctttgggtgctgagattattggcacttttgtgcttgtttacactgttttctctgcaactgaccctaagagaagtgcacgtgactcccacgtccctgtgttggctccacttccaatcgggtttgctgtgttcatggtacacttggccacaatccctataactggtactggcatcaaccctgccaggagcttcggcgctgctgtcatcttcaacaatgaaaaagcctgggatgatcattggattttctgggttgggccatttgtgggagcattagcagctgctgcataccaccagtacattttgagagcggcagcaatcaaggctttgggatctttccgtagcaaccccgccaactaa

SEQ ID NO: 496 - protein, 279 aa, Populus balsamifera subsp. trichocarpa
  misc_feature (1)..(279): Ceres ANNOT ID no. 1450576
  misc_feature (29)..(258): Pfam Name: MIP Pfam Description: Major intrinsic protein
  misc_feature: SWISSPROT Homolog: PIP25_ARATH Probable aquaporin PIP2.5 (Plasma membrane intrinsic protein 2d) (PIP2d) with e-value of 1.3e-153 and BLAST sequence identity of 100.0
  misc_feature: SWISSPROT Homolog: PIP21_ORYSA Probable aquaporin PIP2.1 (Plasma membrane intrinsic protein 2a) (PIP2a) (OsPIP2.1) with e-value of 1.4e-122 and BLAST sequence identity of 82.4
  misc_feature: SWISSPROT Homolog: PIP22_ARATH Aquaporin PIP2.2 (Plasma membrane intrinsic protein 2b) (PIP2b) (TMP2b) with e-value of 1.4e-122 and BLAST sequence identity of 78.7
  misc_feature: SWISSPROT Homolog: PIP21_ARATH Aquaporin PIP2.1 (Plasma membrane intrinsic protein 2a) (PIP2a) with e-value of 2.1e-121 and BLAST sequence identity of 78.0
  misc_feature: SWISSPROT Homolog: PIP26_ARATH Probable aquaporin PIP2.6 (Plasma membrane intrinsic protein 2e) (PIP2e) with e-value of 5.6e-121 and BLAST sequence identity of 78.6
  misc_feature 52191:<222: Transcription Factor
  misc_feature: Phenotype: ROSETTE LEAVES - Curled 2 Useful for making ornamental plants with altered leaf shape
  misc_feature: Phenotype: ROSETTE LEAVES - Other Useful for making ornamental plants with modified leaves
  misc_feature (1)..(279): Functional Homolog of  Ceres CLONE ID no. 11929 at SEQ ID NO. 502 with e-value of 4.80E-114 and BLAST sequence identity of 78.7
MSKEVSEVGQTHGKDYVDPPPAPLLDLGELKLWSFYRALIAEFIATLLFLYVTVATVIGHKSNKDPCDGVGLLGIAWAFGGMIFILVYCTAGISGGHINPAVTFGLFLARKVSLIRAVAYMVAQCLGAICGVGLVKAFMKKNYNSLGGGANTVAMGYNTGTALGAEIIGTFVLVYTVFSATDPKRSARDSHVPVLAPLPIGFAVFMVHLATIPITGTGINPARSFGAAVIFNNEKAWDDHWIFWVGPFVGALAAAAYHQYILRAAAIKALGSFRSNPAN

SEQ ID NO: 497 - protein, 141 aa, Arabidopsis thaliana
  misc_feature (1)..(141): Ceres CLONE ID no. 11938
  misc_feature (1)..(141): Also Known As Ceres CDNA ID no. 23357564
  misc_feature (1)..(141): Also Known As Ceres GEMINI ID 555C9
  misc_feature (35)..(104): Pfam Name: HMG_box Pfam Description: HMG (high mobility group) box
  misc_feature 52305:<222: Transcription Factor
  misc_feature: Phenotype: Activates expression of the gene endogenous to the AtSS1 (SEQ ID NO 4158) regalutory region Useful for modulating Alkaloid Biosynthesis
MKGAKSKAETRSTKLSVTKKPAKGAKGAAKDPNKPKRPSSAFFVFMEDFRVTYKEEHPKNKSVAAVGKAGGEKWKSLSDSEKAPYVAKADKRKVEYEKNMKAYNKKLEEGPKEDEESDKSVSEVNDEDDAEDGSEEEEDDD

SEQ ID NO: 498 - DNA, 531 bp, Populus balsamifera subsp. trichocarpa
  misc_feature (1)..(531): Ceres ANNOT ID no. 1442401
  misc_feature 52357:<222: Transcription Factor
  misc_feature: Phenotype: Activates expression of the gene endogenous to the AtSS1 (SEQ ID NO 4158) regalutory region Useful for modulating Alkaloid Biosynthesis
atgattacttatgtgagagcaaagaagcacaaagagaagcacaaagaggaaagccaaatatcaaagggtttctccatgaaaggaggtagatcaaagtcagataccaagagcgctaagctctctgtgaacaagaaaccaaccaaaggagcagcagcagcagcagcaaagaaatcaggaaaggcagctaaggatccaaacaagcctaagaggcctgcgagcgcatttttcgtcttcatggaggagtttagagagcagtacaagaaggaacaccctaaaaacaaatcagttgctgctgttggaaaagctggaggagataaatggaagtcactgtcagcggctgagaaagcaccctatgttgccaaggctgataaaaggaaagtcgagtatgagaagaagatgaaggcctacaacaaggagcaggctgaagggcccaaggaagaagaggaatccgagaagtcagtgtcggaagtcaatgatgaagatgaagatgacgaggagggcagtgcagaggaggatgacgacgacgagtag

SEQ ID NO: 499 - protein, 176 aa, Populus balsamifera subsp. trichocarpa
  misc_feature (1)..(176): Ceres ANNOT ID no. 1442401
  misc_feature (68)..(137): Pfam Name: HMG_box Pfam Description: HMG (high mobility group) box
  misc_feature: SWISSPROT Homolog: HMGL_SOYBN HMG1/2-like protein (SB11 protein) with e-value of 4.5e-48 and BLAST sequence identity of 68.4
  misc_feature: SWISSPROT Homolog: HMGL_IPONI HMG1/2-like protein with e-value of 1.7e-46 and BLAST sequence identity of 66.9
  misc_feature: SWISSPROT Homolog: MNB1B_MAIZE DNA-binding protein MNB1B (HMG1-like protein) with e-value of 4.3e-43 and BLAST sequence identity of 63.7
  misc_feature: SWISSPROT Homolog: HMGL_VICFA HMG1/2-like protein with e-value of 4.9e-42 and BLAST sequence identity of 64.2
  misc_feature: SWISSPROT Homolog: HMGL_WHEAT HMG1/2-like protein with e-value of 3.6e-39 and BLAST sequence identity of 59.0
  misc_feature 52443:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature (1)..(176): Functional Homolog of  Ceres CLONE ID no. 11938 at SEQ ID NO. 519 with e-value of 3.89E-55 and BLAST sequence identity of 80.1
MITYVRAKKHKEKHKEESQISKGFSMKGGRSKSDTKSAKLSVNKKPTKGAAAAAAKKSGKAAKDPNKPKRPASAFFVFMEEFREQYKKEHPKNKSVAAVGKAGGDKWKSLSAAEKAPYVAKADKRKVEYEKKMKAYNKEQAEGPKEEEESEKSVSEVNDEDEDDEEGSAEEDDDDE

SEQ ID NO: 500 - DNA, 426 bp, Populus balsamifera subsp. trichocarpa
  misc_feature (1)..(426): Ceres ANNOT ID no. 1506142
  misc_feature 52512:<222: Transcription Factor
  misc_feature: Phenotype: Activates expression of the gene endogenous to the AtSS1 (SEQ ID NO 4158) regalutory region Useful for modulating Alkaloid Biosynthesis
atgaaaggaggtagatcaaagtcagatactaagagcgccaagctctctgtgaccaagaaaccaaccaaaggaggaggaggaggagctgcagcccggaaatcaggaaaggcagctaaggatccaaacaagcccaagagggaggagttcagagagcagtacaagagggaacaccctaaaaacaaatccgttgcagctgttggaaaagctggaggagataaatggaagtcactgtcagaggctgagaaagcaccctttgttgccaaagcggacaagaggaaggttgaatatgagaagaagatgaaagcttacaacaaggagcaggctgaagggcccaaggaagaagaggagtctgagaagtcaatgtcagaggtcaatgatgacgatgaagatgatgaagagggaagtggggaggttagtattgcttaa

SEQ ID NO: 501 - protein, 141 aa, Populus balsamifera subsp. trichocarpa
  misc_feature (1)..(141): Ceres ANNOT ID no. 1506142
  misc_feature (44)..(104): Pfam Name: HMG_box Pfam Description: HMG (high mobility group) box
  misc_feature: SWISSPROT Homolog: HMGL_SOYBN HMG1/2-like protein (SB11 protein) with e-value of 4.5e-48 and BLAST sequence identity of 68.4
  misc_feature: SWISSPROT Homolog: HMGL_IPONI HMG1/2-like protein with e-value of 1.7e-46 and BLAST sequence identity of 66.9
  misc_feature: SWISSPROT Homolog: MNB1B_MAIZE DNA-binding protein MNB1B (HMG1-like protein) with e-value of 4.3e-43 and BLAST sequence identity of 63.7
  misc_feature: SWISSPROT Homolog: HMGL_VICFA HMG1/2-like protein with e-value of 4.9e-42 and BLAST sequence identity of 64.2
  misc_feature: SWISSPROT Homolog: HMGL_WHEAT HMG1/2-like protein with e-value of 3.6e-39 and BLAST sequence identity of 59.0
  misc_feature 52596:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature (1)..(141): Functional Homolog of  Ceres CLONE ID no. 11938 at SEQ ID NO. 519 with e-value of 7.49E-45 and BLAST sequence identity of 77.9
MKGGRSKSDTKSAKLSVTKKPTKGGGGGAAARKSGKAAKDPNKPKREEFREQYKREHPKNKSVAAVGKAGGDKWKSLSEAEKAPFVAKADKRKVEYEKKMKAYNKEQAEGPKEEEESEKSMSEVNDDDEDDEEGSGEVSIA

SEQ ID NO: 502 - protein, 234 aa, Arabidopsis thaliana
  misc_feature (1)..(234): Ceres CLONE ID no. 11975
  misc_feature (7)..(79): Pfam Name: GST_N Pfam Description: Glutathione S-transferase, N-terminal domain
  misc_feature (89)..(204): Pfam Name: GST_C Pfam Description: Glutathione S-transferase, C-terminal domain
  misc_feature: Phenotype: ROSETTE LEAVES - Curled 3 Useful for making ornamental plants with altered leaf shape
  misc_feature: Phenotype: WHOLE PLANT - Small Useful for modulating plant size
MGEKQEVKLLGVWYSPYAIRTKIALRLKSVDYDYVEEDLFGSKSELLLKSNPVHKKVPVLLHYNKPIVESLNIVEYIDETWNSSAPSILPSHPYDRALARFWSDFVDNKWFPALRVAAIAKSEDAKAKAMEEVEEGLLQLEDAFVSISKGKPFFGGEVIGFMDICFGSFVVLLKAREKFKAEKLLDESKTPSLCKWADRFLSDETVKNVAPDIEKVAEFLQELEVRAQSAASRS

SEQ ID NO: 503 - DNA, 693 bp, Populus balsamifera subsp. trichocarpa
  misc_feature (1)..(693): Ceres ANNOT ID no. 1460142
  misc_feature 52742:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
atggctaagagtgatgtgaagcttataggggcatggccgagcccttttgtgatgagggcaagaattgcccttaatattaaatctctggggtatgagtttcttgaggaaaaactgggatccaaaagccagcttcttcttgaatcaaaccctgtccataagaaaattccagttctgattcatgatggcaagcccatttgtgaatctcttgtgatagtggagtacattgatgaggtttggtcttctggacctaccatcctcccctctgatccttatgatcgtgcccttgctcggttttgggctgcctatctcgatgagaagtggtttccttcgatgagaagcattgcaacagctaaagaagaggaggctcgaaaggcgttgatagagcaagcaggagaaggggtgatgatgctggaggatgcatttagcaggtgtagcaaagggaagggtttctttggaggagatcagatcgggtaccttgacattgcatttggttcctttttggggtggttgagaaccacagagaagatgaatggagtgaagctgattgatgaaactaagactcctagcttgttgaaatgggcgactagtttttcttcacatcctgctgtgaaggatgttcttccagagacagagaagcttgttgagtttgccaaggttcttgccaaattcaaagcagccagctcgaactcctaa

SEQ ID NO: 504 - protein, 230 aa, Populus balsamifera subsp. trichocarpa
  misc_feature (1)..(230): Ceres ANNOT ID no. 1460142
  misc_feature (6)..(77): Pfam Name: GST_N Pfam Description: Glutathione S-transferase, N-terminal domain
  misc_feature (86)..(201): Pfam Name: GST_C Pfam Description: Glutathione S-transferase, C-terminal domain
  misc_feature: SWISSPROT Homolog: GSTU6_ORYSA Probable glutathione S-transferase GSTU6 (EC 2.5.1.18) (28 kDa cold-induced protein) with e-value of 8.5e-54 and BLAST sequence identity of 49.1
  misc_feature: SWISSPROT Homolog: GSTX1_TOBAC Probable glutathione S-transferase (EC 2.5.1.18) (Auxin-induced protein PGNT1/PCNT110) with e-value of 6.3e-42 and BLAST sequence identity of 44.5
  misc_feature: SWISSPROT Homolog: GSTX6_SOYBN Probable glutathione S-transferase (EC 2.5.1.18) (Heat shock protein 26A) (G2-4) with e-value of 2.7e-41 and BLAST sequence identity of 46.6
  misc_feature: SWISSPROT Homolog: GSTX2_TOBAC Probable glutathione S-transferase (EC 2.5.1.18) (Auxin-induced protein PGNT35/PCNT111) with e-value of 9.2e-41 and BLAST sequence identity of 44.3
  misc_feature: SWISSPROT Homolog: GSTX4_TOBAC Probable glutathione S-transferase (EC 2.5.1.18) (Auxin-induced protein PCNT107) with e-value of 1.9e-40 and BLAST sequence identity of 43.8
  misc_feature 52850:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature (1)..(230): Functional Homolog of  Ceres CLONE ID no. 11975 at SEQ ID NO. 524 with e-value of 6.80E-67 and BLAST sequence identity of 57.4
MAKSDVKLIGAWPSPFVMRARIALNIKSLGYEFLEEKLGSKSQLLLESNPVHKKIPVLIHDGKPICESLVIVEYIDEVWSSGPTILPSDPYDRALARFWAAYLDEKWFPSMRSIATAKEEEARKALIEQAGEGVMMLEDAFSRCSKGKGFFGGDQIGYLDIAFGSFLGWLRTTEKMNGVKLIDETKTPSLLKWATSFSSHPAVKDVLPETEKLVEFAKVLAKFKAASSNS

SEQ ID NO: 505 - DNA, 693 bp, Populus balsamifera subsp. trichocarpa
  misc_feature (1)..(693): Ceres ANNOT ID no. 1483807
  misc_feature 52935:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
atggctaagagtgatgtgaagcttataggggcatggccgagcccttttgtgatgaggccaagaattgcccttaatattaaatctgcggggtatgagtttcttgaggaaacactgggatccaaaagccagcttcttcttgaatcaaaccctgtccataagaaaatcccagttctgattcatgatggcaagcccatttgtgaatctcttgtgatagtggagtacattgatgaggtttggtcttctggacctaccatcctcccctccgatccttatgatcgtgcccttgctcggttttgggctgcctatctcgatgagaagtggtttcctacgatgagaagcattgcaacagctaaagaagaggaggctcgaaaggcgttgatagagcaagcaggagaaggggtgatgatgctggaggatgcatttagcaggtgtagcaaagggaagggtttctttggaggagatcagatcgggtaccttgacattgcatttggttcctttttggggtggttgagagccatagagaagatgaatggagtgaagctgattgatgaaactaagactcctagcctgttgaaatgggcaactagtttttcttcacatcctgctgtgaaggatgtccttccagagacacagaagcttgttgagtttgccaaggttctggccaaattcaaagcacccagctcgaactcctaa

SEQ ID NO: 506 - protein, 230 aa, Populus balsamifera subsp. trichocarpa
  misc_feature (1)..(230): Ceres ANNOT ID no. 1483807
  misc_feature (6)..(77): Pfam Name: GST_N Pfam Description: Glutathione S-transferase, N-terminal domain
  misc_feature (86)..(201): Pfam Name: GST_C Pfam Description: Glutathione S-transferase, C-terminal domain
  misc_feature: SWISSPROT Homolog: GSTU6_ORYSA Probable glutathione S-transferase GSTU6 (EC 2.5.1.18) (28 kDa cold-induced protein) with e-value of 8.5e-54 and BLAST sequence identity of 49.1
  misc_feature: SWISSPROT Homolog: GSTX1_TOBAC Probable glutathione S-transferase (EC 2.5.1.18) (Auxin-induced protein PGNT1/PCNT110) with e-value of 6.3e-42 and BLAST sequence identity of 44.5
  misc_feature: SWISSPROT Homolog: GSTX6_SOYBN Probable glutathione S-transferase (EC 2.5.1.18) (Heat shock protein 26A) (G2-4) with e-value of 2.7e-41 and BLAST sequence identity of 46.6
  misc_feature: SWISSPROT Homolog: GSTX2_TOBAC Probable glutathione S-transferase (EC 2.5.1.18) (Auxin-induced protein PGNT35/PCNT111) with e-value of 9.2e-41 and BLAST sequence identity of 44.3
  misc_feature: SWISSPROT Homolog: GSTX4_TOBAC Probable glutathione S-transferase (EC 2.5.1.18) (Auxin-induced protein PCNT107) with e-value of 1.9e-40 and BLAST sequence identity of 43.8
  misc_feature 53043:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature (1)..(230): Functional Homolog of  Ceres CLONE ID no. 11975 at SEQ ID NO. 524 with e-value of 3.79E-66 and BLAST sequence identity of 57.7
MAKSDVKLIGAWPSPFVMRPRIALNIKSAGYEFLEETLGSKSQLLLESNPVHKKIPVLIHDGKPICESLVIVEYIDEVWSSGPTILPSDPYDRALARFWAAYLDEKWFPTMRSIATAKEEEARKALIEQAGEGVMMLEDAFSRCSKGKGFFGGDQIGYLDIAFGSFLGWLRAIEKMNGVKLIDETKTPSLLKWATSFSSHPAVKDVLPETQKLVEFAKVLAKFKAPSSNS

SEQ ID NO: 507 - protein, 174 aa, Arabidopsis thaliana
  misc_feature (1)..(174): Ceres CLONE ID no. 12071
  misc_feature (53)..(131): Pfam Name: SBP Pfam Description: SBP domain
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 508 - DNA, 753 bp, Populus balsamifera subsp. trichocarpa
  misc_feature (1)..(753): Ceres ANNOT ID no. 1466704
  misc_feature 53210:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
atgtggcttgtggtcctcccaacttttttcaccttttcctcaacacactcttctgcagaccttcatcttagcacttcaagtatccctcctcaccttgctagatatcacgcaataccccaattgtgtgatatcctccctgaaagaattatggatgctaagactcttgaagggaagcgtaactatttgaaagagaaaatgatcaacaaggatgatttcccgatcgaggatgatttggaagatgacatggaagaggatgagggtggggggggctgttttggttttaccgatgatgaaaagaagaaaggagttgggaagagagggactggtggcggcggagcttctccgccgtcttgccaagtagagaagtgtggagctaacttgactgatgctaaaaggtaccacaggagacacaaggtttgcgaggttcatgcgaaatcaccagctgtggttgttgctggcctcaggcagcggttctgtcagcaatgcagcaggatttacttccatggtatgaaaaggttccatgagctactggagtttgatgaaacaaagaggagttgccgtaggcgtttggcaggacacaatgagcggcgccggaagaacacggctgaatcttatggagaaggttcgagccgcaaaggggttggtactcaactgaaagaaagcccgtgcaggcaagctgatgaaagaggaagatatcagatgagcatcccatcccaaggaagttcctcttacaagcgatcccagatcagataa

SEQ ID NO: 509 - protein, 250 aa, Populus balsamifera subsp. trichocarpa
  misc_feature (1)..(250): Ceres ANNOT ID no. 1466704
  misc_feature (117)..(203): Pfam Name: SBP Pfam Description: SBP domain
  misc_feature: SWISSPROT Homolog: SPL4_ARATH Squamosa promoter-binding-like protein 4 with e-value of 7.7e-92 and BLAST sequence identity of 100.0
  misc_feature: SWISSPROT Homolog: SPL5_ARATH Squamosa promoter-binding-like protein 5 with e-value of 2.2e-55 and BLAST sequence identity of 65.1
  misc_feature: SWISSPROT Homolog: SPL3_ARATH Squamosa promoter-binding-like protein 3 with e-value of 5.6e-34 and BLAST sequence identity of 57.6
  misc_feature: SWISSPROT Homolog: SBP1_ANTMA Squamosa promoter-binding protein 1 with e-value of 5.0e-33 and BLAST sequence identity of 57.5
  misc_feature: SWISSPROT Homolog: SBP2_ANTMA Squamosa promoter-binding protein 2 with e-value of 2.2e-31 and BLAST sequence identity of 60.6
  misc_feature 53323:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature (1)..(250): Functional Homolog of  Ceres CLONE ID no. 12071 at SEQ ID NO. 529 with e-value of 3.80E-41 and BLAST sequence identity of 56.6
MWLVVLPTFFTFSSTHSSADLHLSTSSIPPHLARYHAIPQLCDILPERIMDAKTLEGKRNYLKEKMINKDDFPIEDDLEDDMEEDEGGGGCFGFTDDEKKKGVGKRGTGGGGASPPSCQVEKCGANLTDAKRYHRRHKVCEVHAKSPAVVVAGLRQRFCQQCSRIYFHGMKRFHELLEFDETKRSCRRRLAGHNERRRKNTAESYGEGSSRKGVGTQLKESPCRQADERGRYQMSIPSQGSSSYKRSQIR

SEQ ID NO: 510 - protein, 220 aa, Arabidopsis thaliana
  misc_feature (1)..(220): Ceres CLONE ID no. 12250
  misc_feature (1)..(211): Pfam Name: PEX11 Pfam Description: Peroxisomal biogenesis factor 11 (PEX11)
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
MYLNKAEARDKLCRAIQYGSKFLSGGQPGTAQNVDKSTSLARKVFRLFKFVNDLHGLISPVPKGTPLPLVLLGKSKNALLSTFLFLDQIVWLGRSGIYKNKERAELLGRISLFCWMGSSVCTTLVEVGEMGRLSSSMKKIEKGLKNGNKYQDEDYRAKLKKSNERSLALIKSAMDIVVAAGLLQLAPTKITPRVTGAFGFITSIISCYQLLPTRPKIKTP

SEQ ID NO: 511 - DNA, 738 bp, Populus balsamifera subsp. trichocarpa
  misc_feature (1)..(738): Ceres ANNOT ID no. 1497150
  misc_feature 53502:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
atgagtacactcgatgcaactagagcagaacttgctcttatagttctgtatctgaataaggctgaagccagggacaagatttgccgggcaattcaatatggttcaaaattcttgagcgatggacagcctggtactgcccaaaatgttgacaaatcaaccagcttagctcggaaagtttttcgtctttttaagtttgtcaatgacctgcatggtcttattagtccagtttctcaagggacccccttgcctctcgttttattgggaaagtccaaaaatgcgttgttgtcaactttcttgtttcttgatcaaattgtttggcttggaagaagtggcatttacaagaacaaagaacgtgttgacctaattggccgaatatcccttttctgttggatgggatcctcaatttgtactactttggttgaggttggggagcttgggaggctttctgtgtcaatgaagaagttagagaaggagcttaaggatggtgaaaaacatcataatgagcaataccgtgccaaacttaaaaaatcaaatgaaaggtctctagcccttgtcaaatcagccatggacattgtagttgctgttgggctacttcaattggcacccaagaaagtcactcctcgtgttacaggagcttttggagttgttacctctctaatctcttgctaccagattggctatggattgcccgctaaagcatatctcctgcccaatccaagattcaatttcggctcttaa

SEQ ID NO: 512 - protein, 245 aa, Populus balsamifera subsp. trichocarpa
  misc_feature (1)..(245): Ceres ANNOT ID no. 1497150
  misc_feature (11)..(226): Pfam Name: PEX11 Pfam Description: Peroxisomal biogenesis factor 11 (PEX11)
  misc_feature 53566:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature (1)..(245): Functional Homolog of  Ceres CLONE ID no. 12250 at SEQ ID NO. 532 with e-value of 3.00E-96 and BLAST sequence identity of 87.1
MSTLDATRAELALIVLYLNKAEARDKICRAIQYGSKFLSDGQPGTAQNVDKSTSLARKVFRLFKFVNDLHGLISPVSQGTPLPLVLLGKSKNALLSTFLFLDQIVWLGRSGIYKNKERVDLIGRISLFCWMGSSICTTLVEVGELGRLSVSMKKLEKELKDGEKHHNEQYRAKLKKSNERSLALVKSAMDIVVAVGLLQLAPKKVTPRVTGAFGVVTSLISCYQIGYGLPAKAYLLPNPRFNFGS

SEQ ID NO: 513 - DNA, 1185 bp, Populus balsamifera subsp. trichocarpa
  misc_feature (1)..(1185): Ceres ANNOT ID no. 1524446
  misc_feature 53654:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
atgagtacactcgatgcaactagagcagaactggctcttgtagttctgtatctgaataaggctgaagccagggacaagatttgtagggcaattcaatatggttcaaaatttttgagtgacggacaagctggtactgcccaaaatgttgacaaatcaaccagcttagctcggaaagttttccgtctttttaagtttgtcaacgatctgcacggtcttattagtccagttcctcaagggacccccttgcctcttgttttattgggaaagtctaaaaatgcgttgttgtcaactttcttgtttcttgatcaaattgtttggctgggtagaagtggaatttacaagaacaaagaacgtgttgagctaattggccggatttcccttttctgttggatgggatcctcaatttgtactactttggttgaggttggggagcttgggaggctttctgcgtcaatgaagaagttggagaaggagcttaaggagggtgaaaaaaatcataatgagcaatatcgtgctaaacttaaaaaatcaaatgaaaggtcactagcccttgtcaaatcagccatggacattgtagttgctgttgggctacttcaattggcacccaagaaagtcactcctcgagttacaggaggttttgggtttgttagctctcttatctcttgctaccagtttcccaaagttatcggtggttgcttccatcgccacagaagtctaagacaacttgaagacacaacaccgttctggtcaacaactttgttagctgctagtcatcctgagggtgacctagaagatttaagtggtaaagagtgtttgttaatgaggcgtgacacgccgacagacagaaaactcttttttagggtgaaaaaaaaatgcaaaaagcgtatctatgatttggatattagcattttagtgacgaggatgactctgaaagcactggcaaatttattgggtgtggaaatcactaagacaaaaggttattttaaagttttttctcatgtctacaatataatcttcaactacaacgtaggaacagataacaatccagcgttagtgcctacagatggttgccctcaagtgcttccctcttcagccagcaggctagaagcaggaaccgtaaaaaatatcctgaaaccaatctcttctccgaagaatcttatgagctcaccttcaagatcagcctga

SEQ ID NO: 514 - protein, 394 aa, Populus balsamifera subsp. trichocarpa
  misc_feature (1)..(394): Ceres ANNOT ID no. 1524446
  misc_feature (11)..(226): Pfam Name: PEX11 Pfam Description: Peroxisomal biogenesis factor 11 (PEX11)
  misc_feature 53732:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature (1)..(394): Functional Homolog of  Ceres CLONE ID no. 12250 at SEQ ID NO. 532 with e-value of 4.89E-96 and BLAST sequence identity of 87.5
MSTLDATRAELALVVLYLNKAEARDKICRAIQYGSKFLSDGQAGTAQNVDKSTSLARKVFRLFKFVNDLHGLISPVPQGTPLPLVLLGKSKNALLSTFLFLDQIVWLGRSGIYKNKERVELIGRISLFCWMGSSICTTLVEVGELGRLSASMKKLEKELKEGEKNHNEQYRAKLKKSNERSLALVKSAMDIVVAVGLLQLAPKKVTPRVTGGFGFVSSLISCYQFPKVIGGCFHRHRSLRQLEDTTPFWSTTLLAASHPEGDLEDLSGKECLLMRRDTPTDRKLFFRVKKKCKKRIYDLDISILVTRMTLKALANLLGVEITKTKGYFKVFSHVYNIIFNYNVGTDNNPALVPTDGCPQVLPSSASRLEAGTVKNILKPISSPKNLMSSPSRSA

SEQ ID NO: 515 - protein, 385 aa, Arabidopsis thaliana
  misc_feature (1)..(385): Ceres CLONE ID no. 12272
  misc_feature (197)..(272): Pfam Name: SWIB Pfam Description: SWIB/MDM2 domain
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPVSSTAISSTVTLSEPLGKFFGTGETEMADEEIIRRVWEYIKLNNLEDPVNPMAIQCDEKLRDLLGCESISAVGINEMLRRHMYKQS

SEQ ID NO: 516 - DNA, 1104 bp, Populus balsamifera subsp. trichocarpa
  misc_feature (1)..(1104): Ceres ANNOT ID no. 1506387
  misc_feature 54027:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggtgacggaccaggagatagcgaaaggagtagagacggtgctgcggcaagcagacccaagcgccgttacttcattaaacggtgtcgtacagcaacttgaagctaaattagggttagatttgtcacacaaagctgcttttattcgtgaccaaattgaccttctcctccgttcccaccctatcactaccaccgccagtgctacggcccccgcctccgtgaccaccaccgggcatccgccaccacaacatcaagcttttcagttccaacaaggacaagctcttaacttaacccctaaagaccattttgccctccaatttcaacaacaatttcacccttcccattttgaccttaactttaggcagccacaagcggtggtgactcccccagctccaccacctcagctgcaagcacagcagcagcataggcagacacagcatgtgcaaaatgctggggttgttactaatgaagtggcaaaagagagcagtgctccagttggatccaaaagaagaggtggacctggtgggttaaacaaagtatgtggtgtttcacctgaacttcaggccattgttggtgagccagcgctgccaaggactgagattgtgaagcaattgtggcaatacataaggaaaaacaacctccaggatccaagtaacaagaggaagataatttgcgatgatgctttacgtgtggtttttgagacagactgcactgacatgtttaagatgaataagttactggctaaacatatcatcccgcttcaaccatcaagtatgttctatgataattacaaggaatccagtcaagctaagcgagcaaaggtggatgttgagaccccaactgaaaatactgaacctggtgcatcacttgtgggaatatctgaaagacttgctgagtttttggggactactgagagggaaatgacccaaacagaagcatccagacgtgtttgggagtacataaagctaaaacagttggaggatccgttaaattcaatggcgatacaatgtgatacaaagcttcgtgatcttcttggatgtgaaagcatatctgcagtgggggtaggagaggtgttagcacggcatcatttattcaaacggtcatga

SEQ ID NO: 517 - protein, 367 aa, Populus balsamifera subsp. trichocarpa
  misc_feature (1)..(367): Ceres ANNOT ID no. 1506387
  misc_feature (176)..(251): Pfam Name: SWIB Pfam Description: SWIB/MDM2 domain
  misc_feature: SWISSPROT Homolog: YM74_YEAST Hypothetical 26.5 kDa protein in FUS2-RNH1 intergenic region with e-value of 4.3e-14 and BLAST sequence identity of 32.2
  misc_feature 54180:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(367): Functional Homolog of  Ceres CLONE ID no. 12272 at SEQ ID NO. 537 with e-value of 8.19E-110 and BLAST sequence identity of 68.2
MVTDQEIAKGVETVLRQADPSAVTSLNGVVQQLEAKLGLDLSHKAAFIRDQIDLLLRSHPITTTASATAPASVTTTGHPPPQHQAFQFQQGQALNLTPKDHFALQFQQQFHPSHFDLNFRQPQAVVTPPAPPPQLQAQQQHRQTQHVQNAGVVTNEVAKESSAPVGSKRRGGPGGLNKVCGVSPELQAIVGEPALPRTEIVKQLWQYIRKNNLQDPSNKRKIICDDALRVVFETDCTDMFKMNKLLAKHIIPLQPSSMFYDNYKESSQAKRAKVDVETPTENTEPGASLVGISERLAEFLGTTEREMTQTEASRRVWEYIKLKQLEDPLNSMAIQCDTKLRDLLGCESISAVGVGEVLARHHLFKRS

SEQ ID NO: 518 - DNA, 1107 bp, Populus balsamifera subsp. trichocarpa
  misc_feature (1)..(1107): Ceres ANNOT ID no. 1474522
  misc_feature 54359:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggtgacagaccaggaaatagccaaaggagtagagacagtgctgcggcaatcagaccccagcaccgttacttcattaaacggtgtcgtacagcaacttgaagctaaattagggttagatttatcacacaaagctgcttttattcgtgaccaaattaacctgctcctccgcccccaccctaccaccaccgtctccgcctccgtaaccaccaccgcgcatccacaactgacgccacaaccaccaccacctccatcacagcaagcttttcaattccagcaaggacaaactcttcatttgaccccaaaagaccattttgccctccaatttccaacaacaatttcacccttcccattttgcccttcaccctcaccaccaccctcaccagcatcctcagcagcaccaacagcaccagggccgccacctcagttgcaagttcagcagcagcagaggcagacgcagcatgtgcaaaatgttggggatattccacatgaagtggctaaagagagcagtactccagttggatccaaaagaagaggtggacctggtgggttaaacaaagtgtgtggtgtttcacctgaacttcaggtcgttgttggggagccagccttgccaaggactgagattgtgaagcaattgtggcaatacataaggaaaaacaacctccaggatccaagtaacaagaggaagataatttgtgatgatgctttgcgcgtggtttttgagactgactgcactgatatgtttaagatgaataagctgctagctaaacatatcatcccacttcaaccatcaaaggaatctggtcaagccaagcgagcgaaggtggatgttgagaccacaactgaaaataaagaacctgctgcatctcttgtggtaatatctgaaggacttgctgagtttttggggactactgagagggaaatgacccaaacagaagcatccagacgtgtttgggagtacataaagctaaaacagttggaggatccgttaaattcaatggtgatacaatgtgatacaaagcttcgtgatcttcttggatgtgaaagcatatctgctgtgggggtaggagaggtgttagcacgtcatcatttattcaaacggtcatga

SEQ ID NO: 519 - protein, 368 aa, Populus balsamifera subsp. trichocarpa
  misc_feature (1)..(368): Ceres ANNOT ID no. 1474522
  misc_feature (184)..(259): Pfam Name: SWIB Pfam Description: SWIB/MDM2 domain
  misc_feature: SWISSPROT Homolog: YM74_YEAST Hypothetical 26.5 kDa protein in FUS2-RNH1 intergenic region with e-value of 4.3e-14 and BLAST sequence identity of 32.2
  misc_feature 54512:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(368): Functional Homolog of  Ceres CLONE ID no. 12272 at SEQ ID NO. 537 with e-value of 1.19E-108 and BLAST sequence identity of 64.0
MVTDQEIAKGVETVLRQSDPSTVTSLNGVVQQLEAKLGLDLSHKAAFIRDQINLLLRPHPTTTVSASVTTTAHPQLTPQPPPPPSQQAFQFQQGQTLHLTPKDHFALQFPTTISPFPFCPSPSPPPSPASSAAPTAPGPPPQLQVQQQQRQTQHVQNVGDIPHEVAKESSTPVGSKRRGGPGGLNKVCGVSPELQVVVGEPALPRTEIVKQLWQYIRKNNLQDPSNKRKIICDDALRVVFETDCTDMFKMNKLLAKHIIPLQPSKESGQAKRAKVDVETTTENKEPAASLVVISEGLAEFLGTTEREMTQTEASRRVWEYIKLKQLEDPLNSMVIQCDTKLRDLLGCESISAVGVGEVLARHHLFKRS

SEQ ID NO: 520 - protein, 293 aa, Arabidopsis thaliana
  misc_feature (1)..(293): Ceres CLONE ID no. 12993
  misc_feature (86)..(160): Pfam Name: UPF0016 Pfam Description: Uncharacterized protein family UPF0016
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: CAULINE LEAVES - Glossy Useful for making plants with enhanced abiotic stress tolerance
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
MGLISNPTRLILVATIFFLVSSISGQDSVVENNERQESEGSGKELGRRGMVGTERIGVDTVVDNIGALGLNLDLDATAPSVFDALFSSFSMILVTEIGDETFIIAALMAMRHPKATVLSGALSALFVMTILSTGLGRIVPNLISRKHTNSAATVLYAFFGLRLLYIAWRSTDSKSNQKKEMEEVEEKLESGQGKTPFRRLFSRFCTPIFLESFILTFLAEWGDRSQIATIALATHKNAIGVAIGASIGHTVCTSLAVVGGSMLASRISQRTVATVGGLLFLGFSVSSYFYPPL

SEQ ID NO: 521 - DNA, 966 bp, Populus balsamifera subsp. trichocarpa
  misc_feature (1)..(966): Ceres ANNOT ID no. 1479464
  misc_feature 54821:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: CAULINE LEAVES - Glossy Useful for making plants with enhanced abiotic stress tolerance
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
atggggtttcgttcaaaccctagatttatcatccttgtagtagctgctgctgttttgcttctactattgtccttatctcacaccgccgctgcacaggaaaatgagggagatgaatcaagatcctttcaagacctgggccgccgtggcatggtcgttagaaatggagatgatgccaaatctgctggtaatggtcttaaattggaatcggggcttggaatttttgatgctttctttgccagcttgtcaatgattttggtcagcgagattggtgatgagacttttataatagcagctcttatggcaatgcgacaccctaaatctactgtgttatcgggtgctctcaccgccttgattgtcatgacagtactttctactggactaggtagaatcgtgccaaatttaatttcaaggaagcatacaaatagtgcagccaccgttctttatgcattttttggcctgcggctactttacattgcctggagatcggattcaaaatcatcacagaaaaaagaaatggaagaagtagaagaaaagcttgaggctggccaagggaaaacatccttccgccgttacttttcaagattttgcacaccaatatttttggaactgagtggggagaccgtagccagattgctacaattgctgcttatcattggagaaaatctcataaaccaaaccatcatacctgatgcagaaccaaggtttgtcatcacaagatccctggcttttagtcttcaaatgccaacacccactattcacgtgatttcaattttcatgctggcaacacacaaaaatgccatcggcgtagctgtgggggctactttgggacataccatctgcacctccctggcagtggttggtggaagccttctggcgtctaagatctctcaagggacagttgcaaccattggaggcttgcttttcctttgcttttccttgtcgtcttatttctatcctcctctataa

SEQ ID NO: 522 - protein, 321 aa, Populus balsamifera subsp. trichocarpa
  misc_feature (1)..(321): Ceres ANNOT ID no. 1479464
  misc_feature (255)..(312): Pfam Name: UPF0016 Pfam Description: Uncharacterized protein family UPF0016
  misc_feature: SWISSPROT Homolog: YD68_SCHPO Hypothetical UPF0016 protein C17G8.08c in chromosome I with e-value of 4.9e-41 and BLAST sequence identity of 45.5
  misc_feature: SWISSPROT Homolog: PF27_MOUSE Transmembrane protein PFT27 (TPA-regulated locus protein) with e-value of 5.1e-40 and BLAST sequence identity of 41.8
  misc_feature: SWISSPROT Homolog: Y615_SYNY3 Hypothetical UPF0016 protein sll0615 with e-value of 1.2e-38 and BLAST sequence identity of 45.6
  misc_feature: SWISSPROT Homolog: YB37_YEAST Hypothetical UPF0016 protein YBR187w with e-value of 9.8e-35 and BLAST sequence identity of 47.3
  misc_feature 54957:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: CAULINE LEAVES - Glossy Useful for making plants with enhanced abiotic stress tolerance
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
  misc_feature (1)..(321): Functional Homolog of  Ceres CLONE ID no. 12993 at SEQ ID NO. 542 with e-value of 2.49E-85 and BLAST sequence identity of 73.0
MGFRSNPRFIILVVAAAVLLLLLSLSHTAAAQENEGDESRSFQDLGRRGMVVRNGDDAKSAGNGLKLESGLGIFDAFFASLSMILVSEIGDETFIIAALMAMRHPKSTVLSGALTALIVMTVLSTGLGRIVPNLISRKHTNSAATVLYAFFGLRLLYIAWRSDSKSSQKKEMEEVEEKLEAGQGKTSFRRYFSRFCTPIFLELSGETVARLLQLLLIIGENLINQTIIPDAEPRFVITRSLAFSLQMPTPTIHVISIFMLATHKNAIGVAVGATLGHTICTSLAVVGGSLLASKISQGTVATIGGLLFLCFSLSSYFYPPL

SEQ ID NO: 523 - protein, 294 aa, Arabidopsis thaliana
  misc_feature (1)..(294): Ceres CLONE ID no. 12997
  misc_feature (1)..(294): Also Known As Ceres CDNA ID no. 23389866
  misc_feature (1)..(294): Also Known As Ceres GEMINI ID 555E5
  misc_feature 55109:<222: Transcription Factor
  misc_feature: Phenotype: Activates expression of the gene endogenous to the AtDXPR (SEQ ID NO 4143) regalutory region Useful for modulating Terpenoid Biosynthesis
MAVEARHMNLFSSQYITNRECVKSQTNMNNGQQIAGGGFPLTIGDRNLQYIDPINSFNKSESELTAISKRQRDSTFDSDALIASQKRRAIAFSPASLIDAELVSQIQQQNSEIDRFVAQQTETLRIELEARQRTQTRMLASAVQNAILKKLKAKDEEIIRMGKLNWVLQERVKNLYVENQIWRDLAQTNEATANNLRSNLEQVLAQVDDLDAFRRPLVEEADDAESSCGSCDGGDVTAVVNGGCKRCGQLTASVLVLPCRHLCLCTVCGSSALLRTCPVCDMVMTASVHVNMSS

SEQ ID NO: 524 - DNA, 1005 bp, Populus balsamifera subsp. trichocarpa
  misc_feature (1)..(1005): Ceres ANNOT ID no. 1483367
  misc_feature 55191:<222: Transcription Factor
  misc_feature: Phenotype: Activates expression of the gene endogenous to the AtDXPR (SEQ ID NO 4143) regalutory region Useful for modulating Terpenoid Biosynthesis
atggcagttgaagctcctcatacaaaccttaatttcccttcacatcttctcacaaacagggattttgcgaaagtaaatcaagcaaacatgagtttgtacaatacccagatggattctggccttgtttttaatgaaccaatgcctgaaacactcttgtcgttctatcaatcctctcttggttgtgacccagtttctgctaaagcttctaataaagatgatagtgggctcacctacaatgttcctgctgttgttgctccaagaaagaggtctagagattcaatcaatgacaactttgatgcttttcatgcctctcagaagaccaaagtctgccctttttcttcttttattgatcaagacatcatctttcagatccaacaacaacaatctgaaattgaccgcttcattgctgaacataatcagaaagttagaatggaacttgaagacaggagaaagaggcagtcaagaatgctggtatcggcaatacaaggagggatggtgaggaaattaatagagaaagatgaagagattcaaaggatgggaaaattgaactgggttcttcaagaaaaagtgaagagcttatacgttgagactcaaatttggagggatttagctcaagccaatgaggctacagcaaattcattacgcagcaatttagaacaagttttggcgcacgttagcgaggaccgctacataaatggtggtggtgccacggtggcagatgacgcggaatccagttgtggaagtagtgatcatgggaggtgcccgttagcaggtggagaagagggcgcggtgaaggataagttggtggtggtgaaggataacaatagcagcaaaaatattaaccacaaccggatgtgtaaaaagtgtggggagagggaatcaagtgtgttgctgctgccatgcaggcatctgtgcctgtgtacattatgtgggtccaatctgattggtacttgcccagtatgtgattctgtcatggatgctagtgtacatgttaacatggcttga

SEQ ID NO: 525 - protein, 334 aa, Populus balsamifera subsp. trichocarpa
  misc_feature (1)..(334): Ceres ANNOT ID no. 1483367
  misc_feature 55250:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(334): Functional Homolog of  Ceres CLONE ID no. 12997 at SEQ ID NO. 545 with e-value of 2.19E-68 and BLAST sequence identity of 59.3
MAVEAPHTNLNFPSHLLTNRDFAKVNQANMSLYNTQMDSGLVFNEPMPETLLSFYQSSLGCDPVSAKASNKDDSGLTYNVPAVVAPRKRSRDSINDNFDAFHASQKTKVCPFSSFIDQDIIFQIQQQQSEIDRFIAEHNQKVRMELEDRRKRQSRMLVSAIQGGMVRKLIEKDEEIQRMGKLNWVLQEKVKSLYVETQIWRDLAQANEATANSLRSNLEQVLAHVSEDRYINGGGATVADDAESSCGSSDHGRCPLAGGEEGAVKDKLVVVKDNNSSKNINHNRMCKKCGERESSVLLLPCRHLCLCTLCGSNLIGTCPVCDSVMDASVHVNMA

SEQ ID NO: 526 - DNA, 981 bp, Populus balsamifera subsp. trichocarpa
  misc_feature (1)..(981): Ceres ANNOT ID no. 1474088
  misc_feature 55346:<222: Transcription Factor
  misc_feature: Phenotype: Activates expression of the gene endogenous to the AtDXPR (SEQ ID NO 4143) regalutory region Useful for modulating Terpenoid Biosynthesis
atggcagttgaaactcctcatatgagcctcaatttcccttcacaacttatcacaaacagggatcttgtgaaagcaaatcacgcaaacatgaatttatacaatacccagatggattctggccttgttttcaatgaaccagtgcctgaaacactcatgtcgttctatcagtcttctcttggttgtgacccaatttctgctgctaaggcttctaataaagatgatagtagtctcacctacaatgttcctgctgttgctgctccaagaaagagggctagagactcgatcaatgatgacaactttgatgcttttcatgcctctcaaaagaccaaagtctctcctttatcttctttcattgatcacgatatcctctttcagatccaacaacagcaatctgaaatcgaccgtttcattgatgatcataatcagaaagttagaatggaacttgaagagaggaaaaagaggcaatcaagaatgttggtatcagcaatacaagaaggaatgattaagaaagtgaaagagaaagacgaagagattcaaagaatgggaaaaataaactggtttcttcaagaaaaagcgaagagtttatacgtagagaatcaaatttggagggatttagcacaagccaatgaggccacagcaaattcattacggagcaatttagaacaagtcttggcgcacgcaagtggtggcgctgccactctggcagatgatgcagaatccagttgctgtggaagtagtgatcatgggaggtgcacgttagctggtggagaagagggtgcggtgaaggataagatggtagtggttaaggataatcttaaccacaacaggatgtgtaaaaagtgtggggagagggagtcaagtgtgctgctgctgccgtgcaggcatctttgcctgtgtacattatgtgggtccaatctgattggttcttgcccagtatgtgattctgtcatgactgctagtgtccatgttaacatgtcttga

SEQ ID NO: 527 - protein, 326 aa, Populus balsamifera subsp. trichocarpa
  misc_feature (1)..(326): Ceres ANNOT ID no. 1474088
  misc_feature 55405:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(326): Functional Homolog of  Ceres CLONE ID no. 12997 at SEQ ID NO. 545 with e-value of 6.80E-67 and BLAST sequence identity of 60.5
MAVETPHMSLNFPSQLITNRDLVKANHANMNLYNTQMDSGLVFNEPVPETLMSFYQSSLGCDPISAAKASNKDDSSLTYNVPAVAAPRKRARDSINDDNFDAFHASQKTKVSPLSSFIDHDILFQIQQQQSEIDRFIDDHNQKVRMELEERKKRQSRMLVSAIQEGMIKKVKEKDEEIQRMGKINWFLQEKAKSLYVENQIWRDLAQANEATANSLRSNLEQVLAHASGGAATLADDAESSCCGSSDHGRCTLAGGEEGAVKDKMVVVKDNLNHNRMCKKCGERESSVLLLPCRHLCLCTLCGSNLIGSCPVCDSVMTASVHVNMS

SEQ ID NO: 528 - protein, 173 aa, Arabidopsis thaliana
  misc_feature (1)..(173): Ceres CLONE ID no. 13092
  misc_feature (13)..(122): Pfam Name: GSHPx Pfam Description: Glutathione peroxidase
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
MGASSSSSVSEKSIHQFTVKDSSGKEVDLSVYQGKVLLVVNVASKCGFTESNYTQLTELYRKYKDQGFVVLAFPCNQFLSQEPGTSEEAHQFACTRFKAEYPVFQKVRVNGQNAAPVYKFLKSKKPSFLGSRIKWNFTKFLVGKDGQVIDRYGTTVSPLSIQKDIEKALAQEL

SEQ ID NO: 529 - DNA, 513 bp, Populus balsamifera subsp. trichocarpa
  misc_feature (1)..(513): Ceres ANNOT ID no. 1471785
  misc_feature 55583:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
atggggtcttctccatcggtaccagagaaatcaatccatgaattcactgtcaaggataacagaggtcaggacgtgaaccttggtatctataaagggaaggttcttcttgtggttaacgtcgcctctaaatgtggatttacagattcaaattacacccagttgactgatctttataaaaattacaaggacaaaggtttggaaatcttggcgtttccatgtaaccagtttttgaatcaagagcctgggacaagcgaggatgctcaaaactttgcttgtactaggtacaaggctgactatccaattttccacaaggttcgtgttaatggaccaaatgctgcacctgtatacaagttcctcaaggcaagtaaacctggatttctgggaaataggataaagtggaattttaccaagttcttggttgacaaggacgggcatgtccttggtcgctatagcacaatcactgctcctatggccattgaggctgatatcaagaaagcactgggagagatgtga

SEQ ID NO: 530 - protein, 170 aa, Populus balsamifera subsp. trichocarpa
  misc_feature (1)..(170): Ceres ANNOT ID no. 1471785
  misc_feature (11)..(120): Pfam Name: GSHPx Pfam Description: Glutathione peroxidase
  misc_feature: SWISSPROT Homolog: GPX5_ARATH Probable glutathione peroxidase 5 (EC 1.11.1.9) with e-value of 5.6e-89 and BLAST sequence identity of 100.0
  misc_feature: SWISSPROT Homolog: GPX4_ARATH Probable glutathione peroxidase 4 (EC 1.11.1.9) with e-value of 8.9e-75 and BLAST sequence identity of 82.8
  misc_feature: SWISSPROT Homolog: GPX4_SPIOL Probable phospholipid hydroperoxide glutathione peroxidase (EC 1.11.1.12) (PHGPx) with e-value of 7.0e-59 and BLAST sequence identity of 64.5
  misc_feature: SWISSPROT Homolog: GPX6_ARATH Probable phospholipid hydroperoxide glutathione peroxidase 6, mitochondrial precursor (EC 1.11.1.12) (PHGPx) (AtGPX1) with e-value of 1.9e-58 and BLAST sequence identity of 66.3
  misc_feature: SWISSPROT Homolog: GPX4_NICSY Probable phospholipid hydroperoxide glutathione peroxidase (EC 1.11.1.12) (PHGPx) (6P229) with e-value of 2.7e-57 and BLAST sequence identity of 64.2
  misc_feature 55693:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature (1)..(170): Functional Homolog of  Ceres CLONE ID no. 13092 at SEQ ID NO. 550 with e-value of 6.09E-66 and BLAST sequence identity of 71.8
MGSSPSVPEKSIHEFTVKDNRGQDVNLGIYKGKVLLVVNVASKCGFTDSNYTQLTDLYKNYKDKGLEILAFPCNQFLNQEPGTSEDAQNFACTRYKADYPIFHKVRVNGPNAAPVYKFLKASKPGFLGNRIKWNFTKFLVDKDGHVLGRYSTITAPMAIEADIKKALGEM

SEQ ID NO: 531 - protein, 199 aa, Arabidopsis thaliana
  misc_feature (1)..(199): Ceres CLONE ID no. 13186
  misc_feature (9)..(109): Pfam Name: DUF260 Pfam Description: Protein of unknown function DUF260
  misc_feature: Phenotype: ROSETTE LEAVES - Cup-shaped Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: COTYLEDONS - Cup-shaped Useful for modifying seed structure and composition
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPS

SEQ ID NO: 532 - DNA, 663 bp, Populus balsamifera subsp. trichocarpa
  misc_feature (1)..(663): Ceres ANNOT ID no. 1464566
  misc_feature 55959:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: COTYLEDONS - Cup-shaped Useful for modifying seed structure and composition
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
atggcttcgtcgtcgaattctccgtgtgctgcctgtaagtttctgcgccgtaaatgtcaacctgaatgtgtctttgctccctacttcccacctgaccagccacaaaaattctctaatgtccataaagtttttggggcaagcaatgtcacaaaacttctcaacgaattgcacccttctcagcgtgaagatgctgtcaattccttggcctatgaggctgacatgcgcctccgtgacccagtttatggctgcgttggagtcatttcactccttcagcaccaacttcgccaactgcagatagatcttagctgtgcaaaatcagaactctccaaatatcagaacttgggcatcactggccatgctggatcactaattgcggccgcagcagctgcagcgacagccacggcaacaacccatcatcaccaccatccgcaaaaccttgggatcaatttgattggagcaggaggtggaagtagggatcaccactaccaccatcagttctttccaaaggatcagcaacagatgatgagaagcttcgatgctgggaataactatgatgcaagccttcttgcaatgaatgtctctgcaagtattggacaacttagtcatttccagcaacctagagccgctgctggggatgaccgccgcaccattgacccctcttag

SEQ ID NO: 533 - protein, 220 aa, Populus balsamifera subsp. trichocarpa
  misc_feature (1)..(220): Ceres ANNOT ID no. 1464566
  misc_feature (8)..(108): Pfam Name: DUF260 Pfam Description: Protein of unknown function DUF260
  misc_feature: SWISSPROT Homolog: LBD6_ARATH LOB domain protein 6 (ASYMMETRIC LEAVES2) with e-value of 2.3e-106 and BLAST sequence identity of 100.0
  misc_feature: SWISSPROT Homolog: ASL2_ARATH Protein ASYMMETRIC LEAVES2 (LOB domain protein 36) with e-value of 3.4e-43 and BLAST sequence identity of 62.8
  misc_feature: SWISSPROT Homolog: LOB_ARATH Protein LATERAL ORGAN BOUNDARIES with e-value of 1.5e-42 and BLAST sequence identity of 73.7
  misc_feature: SWISSPROT Homolog: LBD25_ARATH LOB domain protein 25 with e-value of 2.2e-39 and BLAST sequence identity of 68.2
  misc_feature: SWISSPROT Homolog: LBD10_ARATH Putative LOB domain protein 10 with e-value of 3.7e-37 and BLAST sequence identity of 68.9
  misc_feature 56163:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: COTYLEDONS - Cup-shaped Useful for modifying seed structure and composition
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature (1)..(220): Functional Homolog of  Ceres CLONE ID no. 13186 at SEQ ID NO. 553 with e-value of 4.10E-76 and BLAST sequence identity of 85.4
MASSSNSPCAACKFLRRKCQPECVFAPYFPPDQPQKFSNVHKVFGASNVTKLLNELHPSQREDAVNSLAYEADMRLRDPVYGCVGVISLLQHQLRQLQIDLSCAKSELSKYQNLGITGHAGSLIAAAAAAATATATTHHHHHPQNLGINLIGAGGGSRDHHYHHQFFPKDQQQMMRSFDAGNNYDASLLAMNVSASIGQLSHFQQPRAAAGDDRRTIDPS

SEQ ID NO: 534 - DNA, 669 bp, Populus balsamifera subsp. trichocarpa
  misc_feature (1)..(669): Ceres ANNOT ID no. 1458408
  misc_feature 56350:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: COTYLEDONS - Cup-shaped Useful for modifying seed structure and composition
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
atggcttcttcatcaaattctccatgtgcagcctgcaaatttctgcggcgcaaatgccaacctgaatgcgtatttgccccttacttcccacctgaccagccacaaaaattttccaatgtccataaagttttcggggcaagcaatgtcacaaaacttctcaacgaattgcacccttctcagcgtgaagatgctgtcaattccttggcctacgaggccgacatgcgcctccgtgacccggtttatggctgtgttggggtcatttcactccttcagcaccaacttcgccagctgcagatggatcttagctgtgcaaaatctgaactctccaaatatcagaacttgggcatcaatggccatgctggatcactaattgcggccgcagccgctgcagctacagccacggcaacaacgcatcaccaccaccaccacccacaaaatctggggatcaatttgattggagctggagggggaggatctagggatcatcactaccaccaccagttttttcctagggatcagcaacagatgatgaggagctttgactcggggaataactatgacgcaagccttcttgctatgaatgtctctgcaagtattgggcaacttagtcagttccagcaaccaagagccgctactggagatgaccgtcgcaccatcgacccctcttag

SEQ ID NO: 535 - protein, 222 aa, Populus balsamifera subsp. trichocarpa
  misc_feature (1)..(222): Ceres ANNOT ID no. 1458408
  misc_feature (8)..(108): Pfam Name: DUF260 Pfam Description: Protein of unknown function DUF260
  misc_feature: SWISSPROT Homolog: LBD6_ARATH LOB domain protein 6 (ASYMMETRIC LEAVES2) with e-value of 2.3e-106 and BLAST sequence identity of 100.0
  misc_feature: SWISSPROT Homolog: ASL2_ARATH Protein ASYMMETRIC LEAVES2 (LOB domain protein 36) with e-value of 3.4e-43 and BLAST sequence identity of 62.8
  misc_feature: SWISSPROT Homolog: LOB_ARATH Protein LATERAL ORGAN BOUNDARIES with e-value of 1.5e-42 and BLAST sequence identity of 73.7
  misc_feature: SWISSPROT Homolog: LBD25_ARATH LOB domain protein 25 with e-value of 2.2e-39 and BLAST sequence identity of 68.2
  misc_feature: SWISSPROT Homolog: LBD10_ARATH Putative LOB domain protein 10 with e-value of 3.7e-37 and BLAST sequence identity of 68.9
  misc_feature: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: COTYLEDONS - Cup-shaped Useful for modifying seed structure and composition
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature (1)..(222): Functional Homolog of  Ceres CLONE ID no. 13186 at SEQ ID NO. 553 with e-value of 1.10E-75 and BLAST sequence identity of 84.9
MASSSNSPCAACKFLRRKCQPECVFAPYFPPDQPQKFSNVHKVFGASNVTKLLNELHPSQREDAVNSLAYEADMRLRDPVYGCVGVISLLQHQLRQLQMDLSCAKSELSKYQNLGINGHAGSLIAAAAAAATATATTHHHHHHPQNLGINLIGAGGGGSRDHHYHHQFFPRDQQQMMRSFDSGNNYDASLLAMNVSASIGQLSQFQQPRAATGDDRRTIDPS

SEQ ID NO: 536 - protein, 240 aa, Arabidopsis thaliana
  misc_feature (1)..(240): Ceres CLONE ID no. 13263
  misc_feature (16)..(201): Pfam Name: YABBY Pfam Description: YABBY protein
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: WHOLE PLANT - High Anthocyanin Useful for modulating anthocyanin content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 537 - DNA, 639 bp, Populus balsamifera subsp. trichocarpa
  misc_feature (1)..(639): Ceres ANNOT ID no. 1470919
  misc_feature 56894:<222: Transcription Factor
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: WHOLE PLANT - High Anthocyanin Useful for modulating anthocyanin content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
atggcatcctcttcagctgccttttcaccggatcacctctcttcatcagaccagctttgttatgtccattgcaacttctgtgacactgtcctcgcggtgagtgtaccttgctctagcttgttcaagactgttacggttcgatgtggtcactgcaccaacctattttctgtgaacatgcgtagcctacttcctgcagctaatcaattttaccttggtcatggtttcttcaatcctcagattaatatcctggagggaatgaggagtactggagcaccgccaagtttgatgatcaatcagccaaatccaaatgaatctgttatgccaattcgaggtgttgaggagatccctaaaccaccagtggttaatagacctccagaaaagagacaaagagtcccatctgcctacaaccgctttatcaaggacgagatccaacgtatcaaagcaggaaaccctgatataagtcacagagaagcatttagcgcagctgcaaagaattgggcccattttccacatatccatttcggacttatgcctgatcaacccgtgaagaaaactaacgtgcgccaacaggaaggagaggacgtgctcatgaaagatgggtttttcgctcctgcaaatgtgggtgtcactccctactga

SEQ ID NO: 538 - protein, 212 aa, Populus balsamifera subsp. trichocarpa
  misc_feature (1)..(212): Ceres ANNOT ID no. 1470919
  misc_feature (10)..(176): Pfam Name: YABBY Pfam Description: YABBY protein
  misc_feature: SWISSPROT Homolog: YAB3_ARATH Axial regulator YABBY3 with e-value of 2.0e-132 and BLAST sequence identity of 100.0
  misc_feature: SWISSPROT Homolog: YAB1_ARATH Axial regulator YABBY1 (Protein ABNORMAL FLORAL ORGANS) (Protein FILAMENTOUS FLOWER) (Protein antherless) (Fl-54) with e-value of 1.2e-68 and BLAST sequence identity of 61.1
  misc_feature: SWISSPROT Homolog: YAB5_ARATH Axial regulator YABBY5 with e-value of 3.4e-42 and BLAST sequence identity of 82.1
  misc_feature: SWISSPROT Homolog: YAB1_ORYSA Protein YABBY (OsYAB1) (Filamentous flower protein 1) with e-value of 1.3e-36 and BLAST sequence identity of 67.9
  misc_feature: SWISSPROT Homolog: YAB4_ARATH Axial regulator YABBY4 (Protein INNER NO OUTER) with e-value of 4.6e-30 and BLAST sequence identity of 41.8
  misc_feature 57062:<222: Transcription Factor
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: WHOLE PLANT - High Anthocyanin Useful for modulating anthocyanin content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature (1)..(212): Functional Homolog of  Ceres CLONE ID no. 13263 at SEQ ID NO. 558 with e-value of 1.09E-68 and BLAST sequence identity of 73.9
MASSSAAFSPDHLSSSDQLCYVHCNFCDTVLAVSVPCSSLFKTVTVRCGHCTNLFSVNMRSLLPAANQFYLGHGFFNPQINILEGMRSTGAPPSLMINQPNPNESVMPIRGVEEIPKPPVVNRPPEKRQRVPSAYNRFIKDEIQRIKAGNPDISHREAFSAAAKNWAHFPHIHFGLMPDQPVKKTNVRQQEGEDVLMKDGFFAPANVGVTPY

SEQ ID NO: 539 - protein, 77 aa, Arabidopsis thaliana
  misc_feature (1)..(77): Ceres CLONE ID no. 13391
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
MAEPKQSSLSEVKTNVIGSRKEEKESMFHGKETHGRSEDIDEKTRVDDVKGPGVLGRMMEEMEAIVDAVTPNKSSDK

SEQ ID NO: 540 - DNA, 291 bp, Populus balsamifera subsp. trichocarpa
  misc_feature (1)..(291): Ceres ANNOT ID no. 1445555
  misc_feature 57265:<222: Transcription Factor
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
atggcagaaccaaaagcagaccaaaaatatccttcaccatcagaagaaaaggatgtaaaagcgccaaatgtgattgaaatatccaaggaagagatagaggcaatcgttcatggtggaaaatctccacgccattataaggaaacacatggaagaagtgatgatattgatgaggatacccccatagatgaagttaaaggaccaagtgtgtttgaacgaatcaaggaagagatcgaagcccttgttggggctattcatcctaagaaggacaagagtgacgtgtcttcttcttag

SEQ ID NO: 541 - protein, 96 aa, Populus balsamifera subsp. trichocarpa
  misc_feature (1)..(96): Ceres ANNOT ID no. 1445555
  misc_feature 57314:<222: Transcription Factor
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
  misc_feature (1)..(96): Functional Homolog of  Ceres CLONE ID no. 13391 at SEQ ID NO. 561 with e-value of 1.09E-13 and BLAST sequence identity of 57.5
MAEPKADQKYPSPSEEKDVKAPNVIEISKEEIEAIVHGGKSPRHYKETHGRSDDIDEDTPIDEVKGPSVFERIKEEIEALVGAIHPKKDKSDVSSS

SEQ ID NO: 542 - DNA, 285 bp, Populus balsamifera subsp. trichocarpa
  misc_feature (1)..(285): Ceres ANNOT ID no. 1502315
  misc_feature 57382:<222: Transcription Factor
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
atggcagaaccaaaaggagacccaaaaagtccatcatcatcagcagaaaaggatgtaaaagcagaaccaaatgtgatggaaaaggagttagaagcaatgactcatagtggaaaatctccacaccatcatcaagaaacgcacggaagaagtgatgatattgatgaggatactccgattgatgaaattaaaggaccaggtgtgtttggacgaatcaaggaagagatcgaggcccttgttggggcaattcattctaagaaggacaagagtgaccaatcatcttcttag

SEQ ID NO: 543 - protein, 94 aa, Populus balsamifera subsp. trichocarpa
  misc_feature (1)..(94): Ceres ANNOT ID no. 1502315
  misc_feature 57431:<222: Transcription Factor
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
  misc_feature (1)..(94): Functional Homolog of  Ceres CLONE ID no. 13391 at SEQ ID NO. 561 with e-value of 4.09E-12 and BLAST sequence identity of 50.0
MAEPKGDPKSPSSSAEKDVKAEPNVMEKELEAMTHSGKSPHHHQETHGRSDDIDEDTPIDEIKGPGVFGRIKEEIEALVGAIHSKKDKSDQSSS

SEQ ID NO: 544 - protein, 105 aa, Arabidopsis thaliana
  misc_feature (1)..(105): Ceres CLONE ID no. 13625
  misc_feature: Utility: MSX Useful for making plants tolerant to low nitrogen
  misc_feature: Phenotype: ROSETTE LEAVES - Curled 3 Useful for making ornamental plants with altered leaf shape
  misc_feature: Phenotype: WHOLE PLANT - MSX Useful for making plants tolerant to low nitrogen
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
MEDFGRQRPYGDGGMQIQPYHGNQGGDFRSYSASYGTRENNIYDVKKEKSIARSKSWGITDPELQRKKRVASYKMYGVEGKVKGSFRNSFRWLKQRYTQVVYGWW

SEQ ID NO: 545 - DNA, 393 bp, Populus balsamifera subsp. trichocarpa
  misc_feature (1)..(393): Ceres ANNOT ID no. 1455211
  misc_feature: Utility: MSX Useful for making plants tolerant to low nitrogen
  misc_feature 57607:<222: Transcription Factor
  misc_feature: Phenotype: ROSETTE LEAVES - Curled 3 Useful for making ornamental plants with altered leaf shape
  misc_feature: Phenotype: WHOLE PLANT - MSX Useful for making plants tolerant to low nitrogen
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
atggaagattacaacagatcaaaatcgtattcttattctcatgggaatgatatgatgcagatggagagttataatggtccacaaaggccaccaacttcttcttatgagctcaggtcctatagcacttcctacgctcagactcaggtggccaacggcaactataacaccaacaatttcggcaacaacagggactttaaggctaagaaaggaaagggctatactggttcatcttcttcgaagtcttggagctttgatgatcctgagtttcaaaggaagaagagggttgctagctataaaatgtatagtgttgaaggtaaagtgaaagggactttcaggaagagcttcaggtggattaaagataggtgcacacaagtgatgtatggatggtggtga

SEQ ID NO: 546 - protein, 130 aa, Populus balsamifera subsp. trichocarpa
  misc_feature (1)..(130): Ceres ANNOT ID no. 1455211
  misc_feature: Utility: MSX Useful for making plants tolerant to low nitrogen
  misc_feature 57708:<222: Transcription Factor
  misc_feature: Phenotype: ROSETTE LEAVES - Curled 3 Useful for making ornamental plants with altered leaf shape
  misc_feature: Phenotype: WHOLE PLANT - MSX Useful for making plants tolerant to low nitrogen
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature (1)..(130): Functional Homolog of  Ceres CLONE ID no. 13625 at SEQ ID NO. 566 with e-value of 9.20E-24 and BLAST sequence identity of 60.0
MEDYNRSKSYSYSHGNDMMQMESYNGPQRPPTSSYELRSYSTSYAQTQVANGNYNTNNFGNNRDFKAKKGKGYTGSSSSKSWSFDDPEFQRKKRVASYKMYSVEGKVKGTFRKSFRWIKDRCTQVMYGWW

SEQ ID NO: 547 - protein, 117 aa, Arabidopsis thaliana
  misc_feature (1)..(117): Ceres CLONE ID no. 13704
  misc_feature (1)..(73): Pfam Name: RNA_pol_Rpb5_N Pfam Description: RNA polymerase Rpb5, N-terminal domain
  misc_feature: Utility: ABA Useful for making plants with enhanced tolerance to drought
  misc_feature: Phenotype: WHOLE PLANT - ABA Useful for making plants with enhanced tolerance to drought
MQMLRDRGYFIADSELTMTKQQFIRKHGDNMKREDLVTLKAKRNDNSDQLYIFFPDEAKVGVKTMKMYTNRMKSENVFRAILVVQQNLTPFARTCISEISSKFHLEVFQGGGNASEH

SEQ ID NO: 548 - DNA, 621 bp, Populus balsamifera subsp. trichocarpa
  misc_feature (1)..(621): Ceres ANNOT ID no. 1481636
  misc_feature: Utility: ABA Useful for making plants with enhanced tolerance to drought
  misc_feature 57888:<222: Transcription Factor
  misc_feature: Phenotype: WHOLE PLANT - ABA Useful for making plants with enhanced tolerance to drought
atgactttaacagaagaagaaatcaagaggctgttaagaattagaaagacagtgatgcaaatgctcaaggatagaggttattttgttggagactttgaaattaaaatgacaagagagcaatttgaatccaaatatggtaataacatgaaaagggaagatcttgttattaacaagaccaagcgaaacgatagttctgatcagatttatgttttctttccggaggaagctaaagttggtgttaaaacaatgaagacatacactaatcgcatgaaatccgagaatgtttttagagcaatcttggttgttcaacagaatttgaccccatttgctcgaacttgtatcaatgagatctctacaaaattccacttggaggtctttcaggaggctgagctgttggttaacatcaaagagcatgttcttgtccctgaacatcaagttctttcaaatgaagagaagaagactttgttggagagatacacagtgaaagaaacacagctgcctcgcattcagataactgatccaatcgcaagatactacgggctgaagcgtggacaagttgttaagattatcaggccaagtgaaacagcaggacgatatgttacctaccgatatgttatataa

SEQ ID NO: 549 - protein, 206 aa, Populus balsamifera subsp. trichocarpa
  misc_feature (1)..(206): Ceres ANNOT ID no. 1481636
  misc_feature (133)..(206): Pfam Name: RNA_pol_Rpb5_C Pfam Description: RNA polymerase Rpb5, C-terminal domain
  misc_feature (2)..(91): Pfam Name: RNA_pol_Rpb5_N Pfam Description: RNA polymerase Rpb5, N-terminal domain
  misc_feature: SWISSPROT Homolog: RPB5_HUMAN DNA-directed RNA polymerase II 23 kDa polypeptide (EC 2.7.7.6) RPB25  RPB5 (RPABC1) (XAP4) with e-value of 1.1e-21 and BLAST sequence identity of 42.5
  misc_feature: SWISSPROT Homolog: RPB5_MOUSE DNA-directed RNA polymerase II 23 kDa polypeptide (EC 2.7.7.6) RPB5 (RPABC1) with e-value of 1.1e-21 and BLAST sequence identity of 42.5
  misc_feature: SWISSPROT Homolog: RPB5_PONPY DNA-directed RNA polymerase II 23 kDa polypeptide (EC 2.7.7.6) RPB5 (RPABC1) with e-value of 1.1e-21 and BLAST sequence identity of 42.5
  misc_feature: SWISSPROT Homolog: RPB5_CAEEL DNA-directed RNA polymerases II 24 kDa polypeptide (EC 2.7.7.6) (RNA polymerase II subunit 5) with e-value of 1.4e-19 and BLAST sequence identity of 39.8
  misc_feature: SWISSPROT Homolog: RPB5_SCHPO DNA-directed RNA polymerases II 24 kDa polypeptide (EC 2.7.7.6) (RNA polymerase II subunit 5) with e-value of 3.8e-12 and BLAST sequence identity of 33.0
  misc_feature: Utility: ABA Useful for making plants with enhanced tolerance to drought
  misc_feature 57993:<222: Transcription Factor
  misc_feature: Phenotype: WHOLE PLANT - ABA Useful for making plants with enhanced tolerance to drought
  misc_feature (1)..(206): Functional Homolog of  Ceres CLONE ID no. 13704 at SEQ ID NO. 569 with e-value of 2.00E-44 and BLAST sequence identity of 76.9
MTLTEEEIKRLLRIRKTVMQMLKDRGYFVGDFEIKMTREQFESKYGNNMKREDLVINKTKRNDSSDQIYVFFPEEAKVGVKTMKTYTNRMKSENVFRAILVVQQNLTPFARTCINEISTKFHLEVFQEAELLVNIKEHVLVPEHQVLSNEEKKTLLERYTVKETQLPRIQITDPIARYYGLKRGQVVKIIRPSETAGRYVTYRYVI

SEQ ID NO: 550 - protein, 246 aa, Arabidopsis thaliana
  misc_feature (1)..(246): Ceres CLONE ID no. 13741
  misc_feature (68)..(234): Pfam Name: AUX_IAA Pfam Description: AUX/IAA family
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 551 - DNA, 909 bp, Populus balsamifera subsp. trichocarpa
  misc_feature (1)..(909): Ceres ANNOT ID no. 1462963
  misc_feature 58162:<222: Transcription Factor
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
atggaaggctgtcttggtttacttggtggcggtggttcttctggagcctccacgaataagtccacactgtcaaaagtggaggtgatcgaggctgaggcaagttcatatccagtggaagctgagctagagttgggtctggggctgagtcttggtagtggtggaggaggaaagggtaaggcaaatgcatggggtgagtgtggtagaatcttgactgccaaggactttccttcggtggtctctcagcctcaaaggcccaacaacaacaactctatgccttctacctgtgttgttggtgctgtttctgggactaagagagctgctgactctgtctcccatgagggtggatcccctactgctggcagtcaggttgtggggtggcctcctataagggcttatcggatgaatagcttggtgagccaagcaaaggctgcgagagctgaagaagaaaagggaattggtgagaaggataaatctaaggagaatttgaagaagaaaatctgtaatggtaacaagaccaatgctactggtaatgaaaaggggcatcttggatttgtcaaggtgaatatggatggagttccaattggaaggaaggtagatttgaatgcccatgcttgttatgaaacattagcccaggcattagaggaaatgttcttcaggtccaccaccactatcaattccatcggtggacagaagccactatcaaagttctctaagctattggatgggtcgtctgagtttgtgctcacttatgaagataaagagggagactggatgctcgtgggagatgttccttgggggatgttcctcacctctgtaaaaaggcttcgaatcatgaggacctcagaggccaatggacttgctccaagactccaggataggaatgagaaacaaagaagcaagcctgtttag

SEQ ID NO: 552 - protein, 302 aa, Populus balsamifera subsp. trichocarpa
  misc_feature (1)..(302): Ceres ANNOT ID no. 1462963
  misc_feature (116)..(290): Pfam Name: AUX_IAA Pfam Description: AUX/IAA family
  misc_feature: SWISSPROT Homolog: IAA13_ARATH Auxin-responsive protein IAA13 (Indoleacetic acid-induced protein 13) with e-value of 2.7e-128 and BLAST sequence identity of 99.6
  misc_feature: SWISSPROT Homolog: IAA12_ARATH Auxin-responsive protein IAA12 Indoleacetic acid-induced protein 12 (BODENLOS protein) with e-value of 1.2e-86 and BLAST sequence identity of 72.2
  misc_feature: SWISSPROT Homolog: IAA10_ORYSA Auxin-responsive protein IAA10 (Indoleacetic acid-induced protein 10) with e-value of 1.9e-43 and BLAST sequence identity of 53.9
  misc_feature: SWISSPROT Homolog: IAA11_ARATH Auxin-responsive protein IAA11 (Indoleacetic acid-induced protein 11) with e-value of 2.4e-42 and BLAST sequence identity of 48.4
  misc_feature: SWISSPROT Homolog: IAA10_ARATH Auxin-responsive protein IAA10 (Indoleacetic acid-induced protein 10) with e-value of 3.3e-36 and BLAST sequence identity of 44.2
  misc_feature 58286:<222: Transcription Factor
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature (1)..(302): Functional Homolog of  Ceres CLONE ID no. 13741 at SEQ ID NO. 572 with e-value of 4.19E-67 and BLAST sequence identity of 69.4
MEGCLGLLGGGGSSGASTNKSTLSKVEVIEAEASSYPVEAELELGLGLSLGSGGGGKGKANAWGECGRILTAKDFPSVVSQPQRPNNNNSMPSTCVVGAVSGTKRAADSVSHEGGSPTAGSQVVGWPPIRAYRMNSLVSQAKAARAEEEKGIGEKDKSKENLKKKICNGNKTNATGNEKGHLGFVKVNMDGVPIGRKVDLNAHACYETLAQALEEMFFRSTTTINSIGGQKPLSKFSKLLDGSSEFVLTYEDKEGDWMLVGDVPWGMFLTSVKRLRIMRTSEANGLAPRLQDRNEKQRSKPV

SEQ ID NO: 553 - DNA, 924 bp, Populus balsamifera subsp. trichocarpa
  misc_feature (1)..(924): Ceres ANNOT ID no. 1459563
  misc_feature 58397:<222: Transcription Factor
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
atggcaggtggtcttggttcactcggcggcggcggcggctcttccggggcctccacaaatgactccacaatgtcaaaagtggaggtggtggaggctgaggcaagttcatatccagtggaagctgagctggagctggggctgagtcttggtagtggtggtcgtggtggtggtggtggagggaagggtaaggcaaatgcacggggtgagcgtggcagaatcttgactgccaaggactttccttcggtggtctcccagcctcaaaggcctaacaacaacacttctatttcctctgcttgcgttgttggtgctgtttctgggactaagagagctgctgactctgtctcccatgagggtggatcccctactgctggcagtcaggttgtggggtggcctcctataagggcttatcggatgaatagcttggtgaaccaagcaaaggctgcaagagctgaagaagacaagggaattggtgagaaggatatatctaaggataatttgaagaagaaaatctgtaatggtaacaagaccagtgctcctagtaatgaaaaggggcatcttggatttgtcaaggtgaatatggatgggattccaattggaaggaaggtagatttgaatgctcatgcttgctatgagacattagctcaagcattggaggaaatgtttttcaggtccgccacaactatcaattccattggtggcgagaagcggcaagtaacgaagccctccaagttattggatggattgtccgagttcctactcacttatgaagataaagagggagactggatgcttgtgggagatgttccgtgggggatgttcctcaactcagtaaaaaggcttaggatcatgaggacctcggaggccaatggacttgctccaagattccaggataggaatgagaaacaaagaataaagcctgtttag

SEQ ID NO: 554 - protein, 284 aa, Populus balsamifera subsp. trichocarpa
  misc_feature (1)..(284): Ceres ANNOT ID no. 1459563
  misc_feature (17)..(272): Pfam Name: AUX_IAA Pfam Description: AUX/IAA family
  misc_feature: SWISSPROT Homolog: IAA13_ARATH Auxin-responsive protein IAA13 (Indoleacetic acid-induced protein 13) with e-value of 2.7e-128 and BLAST sequence identity of 99.6
  misc_feature: SWISSPROT Homolog: IAA12_ARATH Auxin-responsive protein IAA12 Indoleacetic acid-induced protein 12 (BODENLOS protein) with e-value of 1.2e-86 and BLAST sequence identity of 72.2
  misc_feature: SWISSPROT Homolog: IAA10_ORYSA Auxin-responsive protein IAA10 (Indoleacetic acid-induced protein 10) with e-value of 1.9e-43 and BLAST sequence identity of 53.9
  misc_feature: SWISSPROT Homolog: IAA11_ARATH Auxin-responsive protein IAA11 (Indoleacetic acid-induced protein 11) with e-value of 2.4e-42 and BLAST sequence identity of 48.4
  misc_feature: SWISSPROT Homolog: IAA10_ARATH Auxin-responsive protein IAA10 (Indoleacetic acid-induced protein 10) with e-value of 3.3e-36 and BLAST sequence identity of 44.2
  misc_feature 58521:<222: Transcription Factor
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature (1)..(284): Functional Homolog of  Ceres CLONE ID no. 13741 at SEQ ID NO. 572 with e-value of 9.99E-66 and BLAST sequence identity of 62.8
MSKVEVVEAEASSYPVEAELELGLSLGSGGRGGGGGGKGKANARGERGRILTAKDFPSVVSQPQRPNNNTSISSACVVGAVSGTKRAADSVSHEGGSPTAGSQVVGWPPIRAYRMNSLVNQAKAARAEEDKGIGEKDISKDNLKKKICNGNKTSAPSNEKGHLGFVKVNMDGIPIGRKVDLNAHACYETLAQALEEMFFRSATTINSIGGEKRQVTKPSKLLDGLSEFLLTYEDKEGDWMLVGDVPWGMFLNSVKRLRIMRTSEANGLAPRFQDRNEKQRIKPV

SEQ ID NO: 555 - protein, 499 aa, Arabidopsis thaliana
  misc_feature (1)..(499): Ceres CLONE ID no. 13745
  misc_feature (30)..(494): Pfam Name: p450 Pfam Description: Cytochrome P450
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
MDLLLIIAGLVAAAAFFFLRSTTKKSLRLPPGPKGLPIIGNLHQMEKFNPQHFLFRLSKLYGPIFTMKIGGRRLAVISSAELAKELLKTQDLNFTARPLLKGQQTMSYQGRELGFGQYTAYYREMRKMCMVNLFSPNRVASFRPVREEECQRMMDKIYKAADQSGTVDLSELLLSFTNCVVCRQAFGKRYNEYGTEMKRFIDILYETQALLGTLFFSDLFPYFGFLDNLTGLSARLKKAFKELDTYLQELLDETLDPNRPKQETESFIDLLMQIYKDQPFSIKFTHENVKAMILDIVVPGTDTAAAVVVWAMTYLIKYPEAMKKAQDEVRSVIGDKGYVSEEDIPNLPYLKAVIKESLRLEPVIPILLHRETIADAKIGGYDIPAKTIIQVNAWAVSRDTAAWGDNPNEFIPERFMNEHKGVDFKGQDFELLPFGSGRRMCPAMHLGIAMVEIPFANLLYKFDWSLPKGIKPEDIKMDVMTGLAMHKKEHLVLAPTKHI

SEQ ID NO: 556 - DNA, 1515 bp, Populus balsamifera subsp. trichocarpa
  misc_feature (1)..(1515): Ceres ANNOT ID no. 1442604
  misc_feature 58774:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggcattactcatattcgtaattctcttcctctccatcattttcttgtttcttctcaagaaaaacaaaatctctaaaagagcttgtttccctcctggccccaacggtcttcccttgataggtaacttgcaccagcttgatagctcaaaccttcaaacgcaattatggaaactatctcaaaaatatggccccctcatgtccttaaagctaggtttcaagcgaaccctcgtcatctcttcagccaaaatggctgaagaggtactgaaaacccatgatcttgaattttgtagcaggcctctcttgactggccagcaaaaattttcctacaatggtttagacttggccttttcaccatatggtgcttattggagggagatgaaaaaaatatgtgtcgttcatctcctcaactcgacacgagtgcaaagttttcgtaccaacagagaagatgaggtatcgcatatgattgaaaaaatttccaaagcagctcttgcttctaaacccttcaacttgactgaaggaatgctgtctcttacaagcacagccatatgcagaactgcctttggaaaaaggtacgaggatggaggaattgaaggaagtaggttccttgcgttgcttaatgaaaccgaagccctgtttacgatgttttttctttctgattattttccatacatgggatgggttgatagactcacgggacgcgcccatcgtcttgaaaaaaatttcagagagtttgatgttttctaccaacaaattattgatgaacatcttgatccagagcgaccaaagccagaccatgaggacatacttgacgttttgcttcaaatatacaaggatcgcacttttaaagttcaactaacgcttgatcacatcaaagcaattctaatgaacatatttgttggtgggactgatacagctgctgctactgtgatctgggccatgagccttctaatgaaaaaccctgaagcaatgagaaaagctcaagaagaagttcgaaaggtgataggagataaaggttttgtgtacgaagatgatgttcaacaattgccttaccttaaagctgtggttaaagagaccatgagattgcaaccaacagcaccactactagtcccaagagaaacaactacggagtgtaacataggtgggtacgaaataccagccaagaccttagtttacgtcaatgcgtgggctattggaagggacacagaagtttgggagaacccgtatgtgttcattcctgataggttcttgggcagttctattgatttgaaaggacaagattttgagctgataccatttggtgcgggtcgaagaatttgtcctggtatatatatgggaattgccaccgtggagctttcactttctaatcttctctacaaattcgactgggaaatgcctggtgggatgaagagggaagacatagacgttgatcatacgcaacccggtcttgctatgcatacgagggacgctctctgcctcgtgcctaaggcgtatgctgtgatgggcaatgatgcgtaa

SEQ ID NO: 557 - protein, 504 aa, Populus balsamifera subsp. trichocarpa
  misc_feature (1)..(504): Ceres ANNOT ID no. 1442604
  misc_feature (31)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 58918:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(504): Functional Homolog of  Ceres CLONE ID no. 13745 at SEQ ID NO. 577 with e-value of 5.60E-143 and BLAST sequence identity of 53.9
MALLIFVILFLSIIFLFLLKKNKISKRACFPPGPNGLPLIGNLHQLDSSNLQTQLWKLSQKYGPLMSLKLGFKRTLVISSAKMAEEVLKTHDLEFCSRPLLTGQQKFSYNGLDLAFSPYGAYWREMKKICVVHLLNSTRVQSFRTNREDEVSHMIEKISKAALASKPFNLTEGMLSLTSTAICRTAFGKRYEDGGIEGSRFLALLNETEALFTMFFLSDYFPYMGWVDRLTGRAHRLEKNFREFDVFYQQIIDEHLDPERPKPDHEDILDVLLQIYKDRTFKVQLTLDHIKAILMNIFVGGTDTAAATVIWAMSLLMKNPEAMRKAQEEVRKVIGDKGFVYEDDVQQLPYLKAVVKETMRLQPTAPLLVPRETTTECNIGGYEIPAKTLVYVNAWAIGRDTEVWENPYVFIPDRFLGSSIDLKGQDFELIPFGAGRRICPGIYMGIATVELSLSNLLYKFDWEMPGGMKREDIDVDHTQPGLAMHTRDALCLVPKAYAVMGNDA

SEQ ID NO: 558 - DNA, 1542 bp, Populus balsamifera subsp. trichocarpa
  misc_feature (1)..(1542): Ceres ANNOT ID no. 1442612
  misc_feature 59068:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggctttatccgacttcctaattctatctgtccccattttcctcttgtttcttctgatcaagagaaacaaaaccactaaaaaagcctgtttgcctcctggtcctgatggtcttcccttcataggtaacttacaccagcttggcaattccaaccttcatcagtatctatggaagctctctcaaaaacatggccccctcatgcacttgaggctaggattcaagccagccctgatagtctcttcagccaaaatggctagagagatattgaaaactcatgacctcgaattttgtagcaggcctgccttgactgccacgaaaaaaatgacctacaatggcttagacttggctttcgcaccatatggagcttattggagggaggtgaaaaaaatatgtgtcgttcgtgtctttagctcaattcgagcacaaagtttccgtcccattagagaagatgaggtttctcgtatgattgaaaacatatccaaatcagctcttgcttctaaaccattcaacttgactgaagaattggtgtctctcacaagcacaacaatatgcagagttgcctttggaaaaaggtatgaaattggaggaagcgataaaaataggttcctagagttgcttcacgaaatccaggctatggcttcaagctttttcctttcggattattttccttgcttgggctggctcgtcgataaactaaccggactgtcctatcgtctggaaaagagtttcaaagaatttgatgctttctacaaaggaatcattgatgacaatattgatccaaataggcctaagcccgagagggaggatactatacttgattttttgcttcagatatacaaggagggctcatttaaagttcagctaaccctggatcacatcaaagcaattctaatggacatatttcttgcggggacagacacaagtgcagttactatgaattgggccatgacctttctaatgaagaatcctaaagcaatgcgaaaagctcaagaagaagttagaaatttatttggaaataaaggttttgtggatgaagatgatgttcaacaattgccttacctgaaagctgtggttaaagagaccatgagattgcaaccaacagcaccactactaatcccaagagaaacaaccaaggagtgttgcgtaggtgggtacgaaataccagccaagaccttggtttacgtgagtgcttgggctgttggaagggacccggaagcttgggagaacccatatgagttcaatcctgatagattcttgggcagttccattgatctgaaaggaaatgattttgagcttataccatttggtgctggtcgaagaatttgtcctgggatatttattgcactcgccactgtggagctttcacttgcgaatcttcttcataaatttgactgggaaatgccatctggggtggaagatatagacatggatgatgtgctacccggtcttgttcctcatatgagggatgctctctgccttgtgcctaagcttgtgtgtgatggggaaatagggcataaaggcaccgcagttcatgattattag

SEQ ID NO: 559 - protein, 513 aa, Populus balsamifera subsp. trichocarpa
  misc_feature (1)..(513): Ceres ANNOT ID no. 1442612
  misc_feature (32)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 59212:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(513): Functional Homolog of  Ceres CLONE ID no. 13745 at SEQ ID NO. 577 with e-value of 5.29E-131 and BLAST sequence identity of 48.7
MALSDFLILSVPIFLLFLLIKRNKTTKKACLPPGPDGLPFIGNLHQLGNSNLHQYLWKLSQKHGPLMHLRLGFKPALIVSSAKMAREILKTHDLEFCSRPALTATKKMTYNGLDLAFAPYGAYWREVKKICVVRVFSSIRAQSFRPIREDEVSRMIENISKSALASKPFNLTEELVSLTSTTICRVAFGKRYEIGGSDKNRFLELLHEIQAMASSFFLSDYFPCLGWLVDKLTGLSYRLEKSFKEFDAFYKGIIDDNIDPNRPKPEREDTILDFLLQIYKEGSFKVQLTLDHIKAILMDIFLAGTDTSAVTMNWAMTFLMKNPKAMRKAQEEVRNLFGNKGFVDEDDVQQLPYLKAVVKETMRLQPTAPLLIPRETTKECCVGGYEIPAKTLVYVSAWAVGRDPEAWENPYEFNPDRFLGSSIDLKGNDFELIPFGAGRRICPGIFIALATVELSLANLLHKFDWEMPSGVEDIDMDDVLPGLVPHMRDALCLVPKLVCDGEIGHKGTAVHDY

SEQ ID NO: 560 - DNA, 1542 bp, Populus balsamifera subsp. trichocarpa
  misc_feature (1)..(1542): Ceres ANNOT ID no. 1442608
  misc_feature 59365:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggctttattcgacttcctaattctatctgtccccattttcctcttgtttcttctgatcaagagaaacaaaaccactaaaaaagcctgtttgcctcctggtcctgatggtcttcccttcataggtaacttacaccagcttggcaattccaaccttcatcagtatctatggaaactctctcaaaaacatggccccctcgtgtacttgaggctaggtttcaagccagccctgatagtctcttcagccaaaatggctagagagatattgaaaactcatgacctcgaattttgtagcaggcctgccttgacggtcatgaaaaaattttcctacaatggcttagacttggctttggcaccatatggagcttattggagggaggtgaaaaaaatatgtgtcgttcgtgtctttagctcaattcgagcacaaagtttccgtcccattagagaagatgaggtttctcgtatgattgaaaacatatccaaatcagctcttgcttctaaaccattcaacttgactgaagaattggtgtctctcacaagcacaacaatatgcagagttgcctttggaaaaaggtatgaaattggaggaagcgataaaaataggttcctagagttgcttcacgaaatccaggcaatggtttcaagctttttcctttcggattattttccttgcttgggctggctcgtcgataaactaaccggactgtcctatcgtctggaaaagagtttcaaagaatttgatgctttcttcaaaggaataattgatgataagcttgatccaaataggcctaagcccgagagggaggatactatacttgactttttgcttcagatatacaaggatggctcatttaaagttcagctaaccctggatcacatcaaagcaattctaatggacatatttcttgcggggacagacacaagtgcagttactatgaattgggccatgacctttctaatgaagaatcctaaagcaatgcgaaaagctcaagaagaagttagaaatttatttggaaataaaggttttgtgcatgaagatgatgttcaacaattgccttacctgaaagctgtggttaaagagaccatgagattgcaaccaacagcaccactactaatcccaagagaaacaaccaaggagtgttgcgtaggtgggtacgaaataccagccaagaccttggtttacgtgagtgcttgggctgttggaagggacccggaagcttgggagaacccatatgagttcaatcctgatagattcttgggcagttccattgatctgaaaggaaatgattttgagcttataccatttggtgctggtcgaagaatttgtcctgggatatttattgcactcgccactgtggagctttcacttgcgaatcttcttcataaatttgactgggaaatgccatctggggtggaagatatagacatggatgatgtgctacccggtcttgttcctcatatgagggatgctctctgccttgtgcctaagtttgtgtgtgatggggaaacagggcataaaggcaccgcagttcatgattattag

SEQ ID NO: 561 - protein, 513 aa, Populus balsamifera subsp. trichocarpa
  misc_feature (1)..(513): Ceres ANNOT ID no. 1442608
  misc_feature (32)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 59509:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(513): Functional Homolog of  Ceres CLONE ID no. 13745 at SEQ ID NO. 577 with e-value of 1.39E-130 and BLAST sequence identity of 48.9
MALFDFLILSVPIFLLFLLIKRNKTTKKACLPPGPDGLPFIGNLHQLGNSNLHQYLWKLSQKHGPLVYLRLGFKPALIVSSAKMAREILKTHDLEFCSRPALTVMKKFSYNGLDLALAPYGAYWREVKKICVVRVFSSIRAQSFRPIREDEVSRMIENISKSALASKPFNLTEELVSLTSTTICRVAFGKRYEIGGSDKNRFLELLHEIQAMVSSFFLSDYFPCLGWLVDKLTGLSYRLEKSFKEFDAFFKGIIDDKLDPNRPKPEREDTILDFLLQIYKDGSFKVQLTLDHIKAILMDIFLAGTDTSAVTMNWAMTFLMKNPKAMRKAQEEVRNLFGNKGFVHEDDVQQLPYLKAVVKETMRLQPTAPLLIPRETTKECCVGGYEIPAKTLVYVSAWAVGRDPEAWENPYEFNPDRFLGSSIDLKGNDFELIPFGAGRRICPGIFIALATVELSLANLLHKFDWEMPSGVEDIDMDDVLPGLVPHMRDALCLVPKFVCDGETGHKGTAVHDY

SEQ ID NO: 562 - DNA, 1584 bp, Populus balsamifera subsp. trichocarpa
  misc_feature (1)..(1584): Ceres ANNOT ID no. 1452827
  misc_feature 59662:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggcaatgtttttcttccttggagctttctttatcttcgtcttgtttcttctccaaacttacagaaccaaaagaaaaattcttcttccgcctggtccctatggacttcctttaatcggtaacttgcatcaatttgtacagtacaaatcaccccctcaccattacctgtggcaactctcgcacaaatacgggccgctcatgtccttgagacgaggttttgtgccaactctggtagtttcttcagctaaaatggccaaagaggttatgggaaagcattatctggagttctctggtaggccttccttacatggccagcaaaaattgtcttataacggcctagacttggcttttacaccatatggtgattattggagggagatgaggaagatttgtgttcttcgactctttaacttgaaacgagtgcaatcttttcattccattcgtgaaaatgaggtttcttgtatgattcaaaaaataaggaaagcagccgatgcttccaggactgccaacttgagtgaagcagtgactgcccttacaagcttcatagtttgtagagttgcctttgggaagagttatgaggatcaaggtagtgaaagaagtaaatttcataaccttcttaatgaagcacaggccatggcggctagtctttttgtttcggattatcttcctttcatgggatggattgataaactcactggattgatggctcgcctggaaaagaatttcagcgaatttgatgttttctaccaagaaataattgacgagcacctggatccaaagagaaccaaacctgagaaagaggacatcattgacgtgttacttcgcctgaaaaaggaacgctcatttgcatttgatctcaatcgggatcacatcaaagcagtgctaatggtcatcaataagtttctcaattcattttacacaagtgcaggcaccttggagtgggccatgacagctctaatgaaggaacctagagtgatgaacaaagtccaagaagaagttagaaatttagttggtgacagaaaactcgtgaaagaagacgatctcttaagattaccatgtctgaaggcagtggtgaaagagacatggagattgcatccagcggctccattgctactcccacgagaaacaatacaaaattgcaacatagatgggtatgatataccagctagaactctagtttttgtgaatgcgtgggcaattggaagggatcctgaagcgtgggaaatcccagaagagttctatcctgaaagattctttggcaagtctgtagactttaaaggacaagattatgaactgataccatttggtaccggtcgaagaggctgtccagggatacatatgggagctgtgactgtggagcttgcacttgctaatcttctttacaactttgactgggaaatgccgcaaggattgaaagctgaagacatagacatggacgttctgccgggtctcagcacgcacaagaaaaacgctttatgtgccttatgcctaggaactattttcatatatcaagtgtttgatgttgtaatgtactatacggagccatatcaatctgtctcgttttatccacacaaacaggggtag

SEQ ID NO: 563 - protein, 525 aa, Populus balsamifera subsp. trichocarpa
  misc_feature (1)..(525): Ceres ANNOT ID no. 1452827
  misc_feature (28)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 59808:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(525): Functional Homolog of  Ceres CLONE ID no. 13745 at SEQ ID NO. 577 with e-value of 1.30E-125 and BLAST sequence identity of 50.6
MFFFLGAFFIFVLFLLQTYRTKRKILLPPGPYGLPLIGNLHQFVQYKSPPHHYLWQLSHKYGPLMSLRRGFVPTLVVSSAKMAKEVMGKHYLEFSGRPSLHGQQKLSYNGLDLAFTPYGDYWREMRKICVLRLFNLKRVQSFHSIRENEVSCMIQKIRKAADASRTANLSEAVTALTSFIVCRVAFGKSYEDQGSERSKFHNLLNEAQAMAASLFVSDYLPFMGWIDKLTGLMARLEKNFSEFDVFYQEIIDEHLDPKRTKPEKEDIIDVLLRLKKERSFAFDLNRDHIKAVLMVINKFLNSFYTSAGTLEWAMTALMKEPRVMNKVQEEVRNLVGDRKLVKEDDLLRLPCLKAVVKETWRLHPAAPLLLPRETIQNCNIDGYDIPARTLVFVNAWAIGRDPEAWEIPEEFYPERFFGKSVDFKGQDYELIPFGTGRRGCPGIHMGAVTVELALANLLYNFDWEMPQGLKAEDIDMDVLPGLSTHKKNALCALCLGTIFIYQVFDVVMYYTEPYQSVSFYPHKQG

SEQ ID NO: 564 - protein, 299 aa, Arabidopsis thaliana
  misc_feature (1)..(299): Ceres CLONE ID no. 13757
  misc_feature (22)..(131): Pfam Name: B3 Pfam Description: B3 DNA binding domain
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: FLOWER - Small Useful for making ornamental plants with modified flowers
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: WHOLE PLANT - High Anthocyanin Useful for modulating anthocyanin content
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: WHOLE PLANT - Standing Rosette Shaped Useful for making plants with increased biomass and foliage
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVIMQRRAQVASMASRGEKRLRLFGVDMECGGGGGSVNSTEEESSSSGGSMPRGRVSMVGAGSLLQLRLVSSDDESLVAMEAASLEDHHFFTKKGKSSLSFDLDR

SEQ ID NO: 565 - DNA, 1218 bp, Populus balsamifera subsp. trichocarpa
  misc_feature (1)..(1218): Ceres ANNOT ID no. 1471425
  misc_feature 60221:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: FLOWER - Small Useful for making ornamental plants with modified flowers
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: WHOLE PLANT - High Anthocyanin Useful for modulating anthocyanin content
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: WHOLE PLANT - Standing Rosette Shaped Useful for making plants with increased biomass and foliage
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaactttgttggaggagaaagagggtattttgataaagaagaacaagaagaagaggaagccatgtcaagtaagcttccctttgcttctccttgtacatcatcatcttctagcaaatacaaaaattttcttcctgagcaccagaatctgtggcctcgtttatttgatcagccacggcaagatagcgaaacccaagaaccatctctcaattttgtcaagaagctagagttcatggaattatctttgggaaataacaacgaaagtgagagctctagtactgatgctggtggcggtgctagtgagtctattgagagagagcacatgtttgacaaagtagtgaccccaagtgatgtaggcaaactaaatcgtcttgttataccaaagcaacacgcagagaggtacttccctcttgattcttcatcgaatgaaaaaggcctcctcttgaactttgaagaccggaacggcaagccatggcggttcagatactcgtattggaatagtagtcaaagctatgtaatgaccaaaggctggagcaggtttgtcaaagagaaaaggctttatgcaggtgatattgtgtcgttccaacgcggtgttggtgagacaggcaagcaccgtcttttcatagactggcgacgcaggcctaatgcaccagatccaacatcattctcacatttagagctccaaaatcagctacactatccacaatccttgcggtggggcaggctgtactccatgccccaatctaatttacccatgcagcaacctcaattgcaacatttgaattacagcattcatccttatcaacaacatcaacaccataatcatcagtatcattatcatcaaccgtccaacattagttatggcaatgcagcgcagtattacttaaggccgccggcgagtacacttccaattggggcagtgcatgaacaaggaggaagtcatgtgccagtggtgatagactcagtgccagttgttcatggtaagactgtggggaagcggctcaggctgtttggtgtaaacatggagtgtcctacacaaaatgacccgtcatcttcggttacaatgatcagacatggcacattggattcactctcacctcgtttggcttcctcttctctccctcctcctttccaagtaagggaacccactggtgctccaatgcaagctgagttttcaaagaaaggaaaggcttccttatcttttgatttggatctttga

SEQ ID NO: 566 - protein, 328 aa, Populus balsamifera subsp. trichocarpa
  misc_feature (1)..(328): Ceres ANNOT ID no. 1471425
  misc_feature (31)..(139): Pfam Name: B3 Pfam Description: B3 DNA binding domain
  misc_feature: SWISSPROT Homolog: RAV1_ARATH DNA-binding protein RAV1 with e-value of 3.7e-37 and BLAST sequence identity of 68.8
  misc_feature: SWISSPROT Homolog: ARFD_ARATH Auxin response factor 4 with e-value of 1.6e-10 and BLAST sequence identity of 37.1
  misc_feature: SWISSPROT Homolog: ARFQ_ARATH Auxin response factor 17 with e-value of 2.3e-10 and BLAST sequence identity of 33.6
  misc_feature: SWISSPROT Homolog: ARFT_ARATH Putative auxin response factor 20 with e-value of 2.1e-09 and BLAST sequence identity of 41.3
  misc_feature: SWISSPROT Homolog: ARFC_ARATH Auxin response factor 3 (Protein ETTIN) with e-value of 2.7e-09 and BLAST sequence identity of 39.3
  misc_feature 60505:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: FLOWER - Small Useful for making ornamental plants with modified flowers
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: WHOLE PLANT - High Anthocyanin Useful for modulating anthocyanin content
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: WHOLE PLANT - Standing Rosette Shaped Useful for making plants with increased biomass and foliage
  misc_feature: Phenotype: CAULINE LEAVES - Lanceolate Shaped Useful for making plants with increased biomass and foliage
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(328): Functional Homolog of  Ceres CLONE ID no. 13757 at SEQ ID NO. 586 with e-value of 5.40E-58 and BLAST sequence identity of 59.2
MELSLGNNNESESSSTDAGGGASESIEREHMFDKVVTPSDVGKLNRLVIPKQHAERYFPLDSSSNEKGLLLNFEDRNGKPWRFRYSYWNSSQSYVMTKGWSRFVKEKRLYAGDIVSFQRGVGETGKHRLFIDWRRRPNAPDPTSFSHLELQNQLHYPQSLRWGRLYSMPQSNLPMQQPQLQHLNYSIHPYQQHQHHNHQYHYHQPSNISYGNAAQYYLRPPASTLPIGAVHEQGGSHVPVVIDSVPVVHGKTVGKRLRLFGVNMECPTQNDPSSSVTMIRHGTLDSLSPRLASSSLPPPFQVREPTGAPMQAEFSKKGKASLSFDLDL

SEQ ID NO: 567 - protein, 339 aa, Arabidopsis thaliana
  misc_feature (1)..(339): Ceres CLONE ID no. 13767
  misc_feature (97)..(307): Pfam Name: AA_kinase Pfam Description: Amino acid kinase family
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
MAIPLPLTSCSPISTSSSISRTSFVPLTLRNRTFFSNQNYSRRVLISCSSSLSSDNGSSPDSMNGNGNGNGSSLNGQSSFPRLPSFDGTSKPPLKWRRVLLKVSGEALAGDEEQNIDPKVTMAIAREVAAVTRLGIEVAIVVGGGNIFRGSTWAGCSGLDRSSADYIGMLATVMNAIFLQATMESIGIPTRVQTAFRMSEVAEPYIRRRAIRHLEKGRVVIFAAGTGNPFFTTDTAAALRCAEINAEVVLKATNVDGVFDDDPKRNPNARLLDSLTYQEITSKDLSVMDMTAITLCQENNIPVVVFNLSEPGNIAKAIKGERVGTLIGGTWNSIVTTTS

SEQ ID NO: 568 - DNA, 825 bp, Populus balsamifera subsp. trichocarpa
  misc_feature (1)..(825): Ceres ANNOT ID no. 1542158
  misc_feature 60898:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
atgggtccgacttcagaccccataaatctaaggcagcctcaaatgtcatcagtggctccctttggggtgacaatgaatgagcaatcttatagatggcaaagggttttgcttaaagtaagtggagaagcacttgcaggagaccaaatgcagaatattgaccccaaggttacaatggcgattgcaagggaggttgcaactgtgacacgccttggcatcgaggttgcaattgttgttggtggggggaatatcttccgtggatcttcatgggcaggatgcagtggtcttgaccggtcatcagctgattacattgggatgctggcaactgtcatgaatgctatatttcttcaagcaacaatggagagtattggcatcccaacaagggttcaaactgcatttcgcatgtcagaggttgcagaaccatatatccgtagaagggctgtaaggcatttagaaaaaggaagggttgtgatttttgcagctggaactgggaatccatttttcaccacagatactgctgcagcactacgttgtgcagaaattaatgcacaggttgtgttgaaagctacaaatgttgatggagtttatgatgatgatccaaagcgtaatccaaatgctcgtcttcttgaagatctaacttaccacgaggtgacttcaaaagatctttcagtgatggacatgactgccattactttgtgccaagaaaataatattccagttgttgtcttcaatctatccaaaccgggtaacattgcaaaagcaataaagggagaaagggttggcacgttgattggagggacatgcaattcaacagtagcaaggacatga

SEQ ID NO: 569 - protein, 250 aa, Populus balsamifera subsp. trichocarpa
  misc_feature (1)..(250): Ceres ANNOT ID no. 1542158
  misc_feature (9)..(219): Pfam Name: AA_kinase Pfam Description: Amino acid kinase family
  misc_feature: SWISSPROT Homolog: PYRH_SYNY3 Uridylate kinase (EC 2.7.4.-) (UK) (Uridine monophosphate kinase) (UMP kinase) with e-value of 1.4e-78 and BLAST sequence identity of 65.5
  misc_feature: SWISSPROT Homolog: PYRH_ANASP Uridylate kinase (EC 2.7.4.-) (UK) (Uridine monophosphate kinase) (UMP kinase) with e-value of 3.2e-77 and BLAST sequence identity of 64.3
  misc_feature: SWISSPROT Homolog: PYRH_OCEIH Uridylate kinase (EC 2.7.4.-) (UK) (Uridine monophosphate kinase) (UMP kinase) with e-value of 1.7e-71 and BLAST sequence identity of 59.7
  misc_feature: SWISSPROT Homolog: PYRH_AQUAE Uridylate kinase (EC 2.7.4.-) (UK) (Uridine monophosphate kinase) (UMP kinase) with e-value of 8.5e-70 and BLAST sequence identity of 57.3
  misc_feature: SWISSPROT Homolog: PYRH_CHLTE Uridylate kinase (EC 2.7.4.-) (UK) (Uridine monophosphate kinase) (UMP kinase) with e-value of 3.7e-69 and BLAST sequence identity of 56.2
  misc_feature 61025:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (1)..(250): Functional Homolog of  Ceres CLONE ID no. 13767 at SEQ ID NO. 589 with e-value of 5.10E-117 and BLAST sequence identity of 92.6
MNEQSYRWQRVLLKVSGEALAGDQMQNIDPKVTMAIAREVATVTRLGIEVAIVVGGGNIFRGSSWAGCSGLDRSSADYIGMLATVMNAIFLQATMESIGIPTRVQTAFRMSEVAEPYIRRRAVRHLEKGRVVIFAAGTGNPFFTTDTAAALRCAEINAQVVLKATNVDGVYDDDPKRNPNARLLEDLTYHEVTSKDLSVMDMTAITLCQENNIPVVVFNLSKPGNIAKAIKGERVGTLIGGTCNSTVART

SEQ ID NO: 570 - DNA, 801 bp, Populus balsamifera subsp. trichocarpa
  misc_feature (1)..(801): Ceres ANNOT ID no. 1488730
  misc_feature 61134:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
atgggtccgacttcagaccccataaatctaaggcagcctcaaatgtcatcagtggctccctttggggtgacaatgaatgagcaatcttatagatggcaaagggttttgcttaaagtaagtggagaagcacttgcaggagaccaaatgcagaatattgaccccaaggttacaatggcgattgcaagggaggttgcaactgtgacacgccttggcatcgaggttgcaattgttgttggtggggggaatatcttccgtggatcttcatgggcaggatgcagtggtcttgaccggtcatcagctgattacattgggatgctggcaactgtcatgaatgctatatttcttcaagcaacaatggagagtattggcatcccaacaagggttcaaactgcatttcgcatgtcagaggttgcagaaccatatatccgtagaagggctgtaaggcatttagaaaaaggaagggttgtgatttttgcagctggaactgggaatccatttttcaccacagatactgctgcagcactacgttgtgcagaaattaatgcacaggttgtgttgaaagctacaaatgttgatggagtttatgatgatgatccaaagcgtaatccaaatgctcgtcttcttgaagatctaacttaccacgaggtgacttcaaaagatctttcagtgatggacatgactgccattactttgtgccaagaaaataatattccagcatttatgggtgaaatgagtcaggtggctgccttagagaggtgcactgggtcacttgtactcagggaagctaaattgttaccataa

SEQ ID NO: 571 - protein, 242 aa, Populus balsamifera subsp. trichocarpa
  misc_feature (1)..(242): Ceres ANNOT ID no. 1488730
  misc_feature (9)..(219): Pfam Name: AA_kinase Pfam Description: Amino acid kinase family
  misc_feature: SWISSPROT Homolog: PYRH_SYNY3 Uridylate kinase (EC 2.7.4.-) (UK) (Uridine monophosphate kinase) (UMP kinase) with e-value of 1.4e-78 and BLAST sequence identity of 65.5
  misc_feature: SWISSPROT Homolog: PYRH_ANASP Uridylate kinase (EC 2.7.4.-) (UK) (Uridine monophosphate kinase) (UMP kinase) with e-value of 3.2e-77 and BLAST sequence identity of 64.3
  misc_feature: SWISSPROT Homolog: PYRH_OCEIH Uridylate kinase (EC 2.7.4.-) (UK) (Uridine monophosphate kinase) (UMP kinase) with e-value of 1.7e-71 and BLAST sequence identity of 59.7
  misc_feature: SWISSPROT Homolog: PYRH_AQUAE Uridylate kinase (EC 2.7.4.-) (UK) (Uridine monophosphate kinase) (UMP kinase) with e-value of 8.5e-70 and BLAST sequence identity of 57.3
  misc_feature: SWISSPROT Homolog: PYRH_CHLTE Uridylate kinase (EC 2.7.4.-) (UK) (Uridine monophosphate kinase) (UMP kinase) with e-value of 3.7e-69 and BLAST sequence identity of 56.2
  misc_feature 61261:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (1)..(242): Functional Homolog of  Ceres CLONE ID no. 13767 at SEQ ID NO. 589 with e-value of 9.30E-102 and BLAST sequence identity of 90.7
MNEQSYRWQRVLLKVSGEALAGDQMQNIDPKVTMAIAREVATVTRLGIEVAIVVGGGNIFRGSSWAGCSGLDRSSADYIGMLATVMNAIFLQATMESIGIPTRVQTAFRMSEVAEPYIRRRAVRHLEKGRVVIFAAGTGNPFFTTDTAAALRCAEINAQVVLKATNVDGVYDDDPKRNPNARLLEDLTYHEVTSKDLSVMDMTAITLCQENNIPAFMGEMSQVAALERCTGSLVLREAKLLP

SEQ ID NO: 572 - protein, 344 aa, Arabidopsis thaliana
  misc_feature (1)..(344): Ceres CLONE ID no. 13800
  misc_feature (129)..(260): Pfam Name: EIF_2_alpha Pfam Description: Eukaryotic translation initiation factor 2 alpha subunit
  misc_feature (17)..(92): Pfam Name: S1 Pfam Description: S1 RNA binding domain
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: COTYLEDONS - Other Useful for modifying seed structure and composition
MASQTPNLECRMYEAKYPEVDMAVMIQVKNIADMGAYVSLLEYNNIEGMILFSELSRRRIRSVSSLIKVGRIEPVMVLRVDKEKGYIDLSKRKVSEEDIQTCEERYNKSKLVHSIMRHVAETLSIDLEDLYVNIGWPLYRRHGHAFEAFKILVTDPDSVLGPLTREIKEVGPDGQEVTKVVPAVTEEVKDALVKNIRRRMTPQPMKIRADIELKCFQFDGVVHIKEAMKNAEAAGNEDCPVKIKLVAPPLYVLTTQTLDKEQGIEILNKAIAACTETIETHKGKLVVKEGARAVSERDEKMLTEHMAKLRLDNEEMSGDEDSGDEEEDTGMGEVDLDAGAGIIE

SEQ ID NO: 573 - DNA, 1032 bp, Populus balsamifera subsp. trichocarpa
  misc_feature (1)..(1032): Ceres ANNOT ID no. 1458335
  misc_feature 61522:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: COTYLEDONS - Other Useful for modifying seed structure and composition
atggcgacgcactcaccaaatctggagtgtcgcatgtacgaagcgcgatacccagaggttgatatggcagttatgattcaagtgaaaaacatcgccgacatgggcgcttatgtttctttactcgagtacaacaacatcgagggtatgatcttgttttcggagctgtctcgccgtcggattcggagtgttagtagtttgattaaggttggccgcatcgagcctgtcatggtcttacgtgtcgataaagagaaaggctatattgatttgagtaagagaagagttagtgaagaggatattcagacttgtgaagagaggtataataagagcaagcttgttcattctatcatgcgacatgtcgctgagactctgggtattgatttggaggaattgtatgtcaatattggctggcctttgtacaggaaacatggacatgcttttgaggcattcaaaatcatggtgactgaccctgattcagttgtgggttccctcactcgtgaagtcaaggaaactggccctgacggacaggaggtaaccaaggtagtgcctgctgtgtcagaggaaatcaaagaagccttgatcaggaatattaggagaagaatgaccccacagccactgaagatacgggctgatattgagatgaaatgtttccagtttgatggcgttctccacattaaggatgcaatgcggaaagctgaggctgttggcaatgcagattgtcctgtgaaaatcaaactggttgcccctcctctttatgttctcaccacacaaaccctagacaaggaacaaggaatacaaattctcagccaagcaattgctgcttgcactgaagcaatagaggggcagaaggggaaacttgttgtgaaggagccaccgagagcagtgagcgaacgagatgataaattacttgctgagcacatgcttaagctacggagtgccaatgaagagatcagtggcgatgaagagagtggcgatgaagaagacacagggatgggagatgctgatgtggagaactcagcgggcatagtggaatga

SEQ ID NO: 574 - protein, 343 aa, Populus balsamifera subsp. trichocarpa
  misc_feature (1)..(343): Ceres ANNOT ID no. 1458335
  misc_feature (129)..(260): Pfam Name: EIF_2_alpha Pfam Description: Eukaryotic translation initiation factor 2 alpha subunit
  misc_feature (17)..(92): Pfam Name: S1 Pfam Description: S1 RNA binding domain
  misc_feature: SWISSPROT Homolog: IF2A_SCHPO Eukaryotic translation initiation factor 2 alpha subunit (eIF-2-alpha) with e-value of 2.6e-84 and BLAST sequence identity of 66.7
  misc_feature: SWISSPROT Homolog: IF2A_BOVIN Eukaryotic translation initiation factor 2 subunit 1 eIF-2-alpha (EIF-2alpha) (EIF-2A) with e-value of 4.0e-72 and BLAST sequence identity of 46.5
  misc_feature: SWISSPROT Homolog: IF2A_HUMAN Eukaryotic translation initiation factor 2 subunit 1 eIF-2-alpha (EIF-2alpha) (EIF-2A) with e-value of 4.0e-72 and BLAST sequence identity of 46.5
  misc_feature: SWISSPROT Homolog: IF2A_MOUSE Eukaryotic translation initiation factor 2 subunit 1 eIF-2-alpha (EIF-2alpha) (EIF-2A) with e-value of 4.0e-72 and BLAST sequence identity of 46.5
  misc_feature: SWISSPROT Homolog: IF2A_RAT Eukaryotic translation initiation factor 2 subunit 1 eIF-2-alpha (EIF-2alpha) (EIF-2A) with e-value of 4.0e-72 and BLAST sequence identity of 46.5
  misc_feature 61685:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: COTYLEDONS - Other Useful for modifying seed structure and composition
  misc_feature (1)..(343): Functional Homolog of  Ceres CLONE ID no. 13800 at SEQ ID NO. 601 with e-value of 1.69E-157 and BLAST sequence identity of 85.7
MATHSPNLECRMYEARYPEVDMAVMIQVKNIADMGAYVSLLEYNNIEGMILFSELSRRRIRSVSSLIKVGRIEPVMVLRVDKEKGYIDLSKRRVSEEDIQTCEERYNKSKLVHSIMRHVAETLGIDLEELYVNIGWPLYRKHGHAFEAFKIMVTDPDSVVGSLTREVKETGPDGQEVTKVVPAVSEEIKEALIRNIRRRMTPQPLKIRADIEMKCFQFDGVLHIKDAMRKAEAVGNADCPVKIKLVAPPLYVLTTQTLDKEQGIQILSQAIAACTEAIEGQKGKLVVKEPPRAVSERDDKLLAEHMLKLRSANEEISGDEESGDEEDTGMGDADVENSAGIVE

SEQ ID NO: 575 - DNA, 1032 bp, Populus balsamifera subsp. trichocarpa
  misc_feature (1)..(1032): Ceres ANNOT ID no. 1464663
  misc_feature 61833:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: COTYLEDONS - Other Useful for modifying seed structure and composition
atggcgacgcactcaccaaatctggagtgtcgcatgtacgaatcgcgatacccagaggtggacatggcagttatgattcaagtgaaaaacatcgccgacatgggtgcctatgtgtctttactcgagtacaacaacatcgagggtatgatcttgttctcggagctttctcgccgtcggattcggagtgttagtagcttgattaaggttggccgcatcgagcctgtcatggtcttgcgtgttgataaagagaaggggtatattgatttgagtaagagaagggtcagtgaggaggatattcagacttgcgaagagaggtataataagagcaagcttgttcactctatcatgagacatgtcgctgaaactctgggtattgatttggaggaactgtatgtcaatattggctggcctctgtacaggaaatatggacatgcttttgaggcattcaaaatcatggtgaatgaccctgattcagttttggatcccctcactcgtgaagtcaaagaaactggccctgatggacaggaggtaaccaaggtagtgcctgctgtgtcagaggaaatcaaagaagctttgattaggaatatcaggagaagaatgaccccacagccactgaagataagggctgatattgagatgaaatgtttccagtttgatggtgttctccacattaaggatgcaatgcggaaagctgaggctgctggaaatgcagactgccctgtgaaaattaaactggttgctcctccactttatgttctcaccacacaaaccctagacaaggatcaaggaatatcaattctcacccaagcaattgctgcatgcactgaagcaatagaggcgcagaaagggaaacttgttgtgaaggagccaccgagagcagtgagcgaacgagatgataaattgcttaccgagcacatgcttaagttgcggagtgccaatgaagagatcagtggcgatgaagatagtgaagaagaagaagatacggggttgggagatgctgatgtggagaacgcagtaggtataatggagtga

SEQ ID NO: 576 - protein, 343 aa, Populus balsamifera subsp. trichocarpa
  misc_feature (1)..(343): Ceres ANNOT ID no. 1464663
  misc_feature (129)..(260): Pfam Name: EIF_2_alpha Pfam Description: Eukaryotic translation initiation factor 2 alpha subunit
  misc_feature (17)..(92): Pfam Name: S1 Pfam Description: S1 RNA binding domain
  misc_feature: SWISSPROT Homolog: IF2A_SCHPO Eukaryotic translation initiation factor 2 alpha subunit (eIF-2-alpha) with e-value of 2.6e-84 and BLAST sequence identity of 66.7
  misc_feature: SWISSPROT Homolog: IF2A_BOVIN Eukaryotic translation initiation factor 2 subunit 1 eIF-2-alpha (EIF-2alpha) (EIF-2A) with e-value of 4.0e-72 and BLAST sequence identity of 46.5
  misc_feature: SWISSPROT Homolog: IF2A_HUMAN Eukaryotic translation initiation factor 2 subunit 1 eIF-2-alpha (EIF-2alpha) (EIF-2A) with e-value of 4.0e-72 and BLAST sequence identity of 46.5
  misc_feature: SWISSPROT Homolog: IF2A_MOUSE Eukaryotic translation initiation factor 2 subunit 1 eIF-2-alpha (EIF-2alpha) (EIF-2A) with e-value of 4.0e-72 and BLAST sequence identity of 46.5
  misc_feature: SWISSPROT Homolog: IF2A_RAT Eukaryotic translation initiation factor 2 subunit 1 eIF-2-alpha (EIF-2alpha) (EIF-2A) with e-value of 4.0e-72 and BLAST sequence identity of 46.5
  misc_feature 61996:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: COTYLEDONS - Other Useful for modifying seed structure and composition
  misc_feature (1)..(343): Functional Homolog of  Ceres CLONE ID no. 13800 at SEQ ID NO. 601 with e-value of 6.59E-156 and BLAST sequence identity of 84.8
MATHSPNLECRMYESRYPEVDMAVMIQVKNIADMGAYVSLLEYNNIEGMILFSELSRRRIRSVSSLIKVGRIEPVMVLRVDKEKGYIDLSKRRVSEEDIQTCEERYNKSKLVHSIMRHVAETLGIDLEELYVNIGWPLYRKYGHAFEAFKIMVNDPDSVLDPLTREVKETGPDGQEVTKVVPAVSEEIKEALIRNIRRRMTPQPLKIRADIEMKCFQFDGVLHIKDAMRKAEAAGNADCPVKIKLVAPPLYVLTTQTLDKDQGISILTQAIAACTEAIEAQKGKLVVKEPPRAVSERDDKLLTEHMLKLRSANEEISGDEDSEEEEDTGLGDADVENAVGIME

SEQ ID NO: 577 - protein, 326 aa, Arabidopsis thaliana
  misc_feature (1)..(326): Ceres CLONE ID no. 13930
  misc_feature (1)..(326): Also Known As Ceres CDNA ID no. 23369276
  misc_feature (1)..(326): Also Known As Ceres GEMINI ID 535G10
  misc_feature (271)..(304): Pfam Name: TPR_2 Pfam Description: Tetratricopeptide repeat
  misc_feature 62164:<222: Transcription Factor
  misc_feature: Phenotype: Activates expression of the gene endogenous to the AtHMGS (SEQ ID NO 4144) regalutory region Useful for modulating Terpenoid Biosynthesis
MVSLAKFHYCDQTLHLRLDTHRKPQPKPVSYRILHKPPPSRVIRASSFSSNPKPSFLKTTCVTLTTAAALLSASLHLSTKPVTAATLVSPPPPPSTAADLTSDQISSRPKEEEEEAALEKHLTKNPNDVEALQSLMKIKFQTKNIDHALEILNRLIEIQPEEQEWRILKAQVQTYGGDFDSATKGFEEVLSKDPFRVEAYHGLVMAYSESESKLSEIESRINEAIEKCKKENKKDFRDFMLLIAQIRVIKGNPIEALRVYQELVKDEPKDFRPYLCQGLIYTLMKKKDEAEKQFAEFRRLVPENHPYKEYLDANVLNTNKLFAKNQ

SEQ ID NO: 578 - DNA, 1023 bp, Populus balsamifera subsp. trichocarpa
  misc_feature (1)..(1023): Ceres ANNOT ID no. 1475265
  misc_feature 62252:<222: Transcription Factor
  misc_feature: Phenotype: Activates expression of the gene endogenous to the AtHMGS (SEQ ID NO 4144) regalutory region Useful for modulating Terpenoid Biosynthesis
atggagtcagttgctaaactgcactgccgtcaccaacccttcaacctctcactcaatccccaccgtccatcatttccaaaacccatcatttccctctccttcaaaaccccacctccctcatcatcgtcacccttcaaactctcctctacctccatcagagcctcctcctcctcctcctcccgcatcaccccactcaataaaaaccttggcaccatcatcaaaatcacttcaatcactctcaccgcggcagccgctttattcttcactcgcctcaatatcaaaccagcaatcgcctccccgcttaccgcgtcatccacagtagaccccacagaggaatcttcgaaagaaaatgtttcgtatgaagaacaagagagagctcttcaagattatctgtctcaaaaccccaatgatattgaagctctacggtctctcatggaggtgaggatcaaatcaaagaaacttgttgaagcaattgaagttgttgatcgattaatcgagctggagccaaatgaagatgaatggccattgttgaaatcacaaatttacacttacagtggagattttgagtctgctaaagatgggtttgaagcgattttaaaaaaagatccacttcgcgtggaggcttatcacggccttgtaatggcgaattcggaatccggtggttccttggaagttgtgttgaaaagaatagagagtgcaatggataaatgtaaaaaagaaaagaagacttcggatttgcgggattttaagttgttggttgcgcaagttagagtaatggaggagaagtatcttgatgcattgaaggtttatgaggagttggtgaaagaggaaccgagggattttaggccgtatttgtgtcaagggatcatttatactttgttaaggaagaaagatgaagcggagaaaaagtttgagcagtttaaaaagcttgttccgaagaatcatccttatagggagtatttggttgataatatgtttgctactaagttcttttcggacaaggtagagagggagaggagttga

SEQ ID NO: 579 - protein, 340 aa, Populus balsamifera subsp. trichocarpa
  misc_feature (1)..(340): Ceres ANNOT ID no. 1475265
  misc_feature (281)..(314): Pfam Name: TPR_2 Pfam Description: Tetratricopeptide repeat
  misc_feature 62319:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(340): Functional Homolog of  Ceres CLONE ID no. 13930 at SEQ ID NO. 606 with e-value of 1.50E-78 and BLAST sequence identity of 52.6
MESVAKLHCRHQPFNLSLNPHRPSFPKPIISLSFKTPPPSSSSPFKLSSTSIRASSSSSSRITPLNKNLGTIIKITSITLTAAAALFFTRLNIKPAIASPLTASSTVDPTEESSKENVSYEEQERALQDYLSQNPNDIEALRSLMEVRIKSKKLVEAIEVVDRLIELEPNEDEWPLLKSQIYTYSGDFESAKDGFEAILKKDPLRVEAYHGLVMANSESGGSLEVVLKRIESAMDKCKKEKKTSDLRDFKLLVAQVRVMEEKYLDALKVYEELVKEEPRDFRPYLCQGIIYTLLRKKDEAEKKFEQFKKLVPKNHPYREYLVDNMFATKFFSDKVERERS

SEQ ID NO: 580 - DNA, 990 bp, Populus balsamifera subsp. trichocarpa
  misc_feature (1)..(990): Ceres ANNOT ID no. 1455046
  misc_feature 62418:<222: Transcription Factor
  misc_feature: Phenotype: Activates expression of the gene endogenous to the AtHMGS (SEQ ID NO 4144) regalutory region Useful for modulating Terpenoid Biosynthesis
atggagtccattgctaaacaaccccttaatctctctctcaatccccaccgtccatcatttccaaaccccatcgtttccctcaccttcaaaaccccacctccctcgtcatcacccttcaaactctccacctctatcagagcctcatcctcctcccgcatcaccccactcaatcaatctctcaccaccatcatcaaaacgacttccatcactctcaccgccgctgccgtattattcttcacgcgcttcaactccaaacccgcaatcgcctctccggtcgccgcgtcgtcatccactgcagaccccacaaaagaatcgtccaaagaaaatgtttcgtttgaagaacaagaaagagctcttcaagatcatctggctcaaaaccccagtgatgtcgaagctttacggtctctcatggaggtgaggatcaaatcaaagaaacttcaagaggcaattgaagttgttgaccgattaatcgagctggaaccaaatgaagatgaatggccattgttgaaatcgcaaatttatacttacagtggagattttgagtctgctaaagatgggtttgaagcagttttgcaaaaagacccacttcgggtcgaggcttatcatggccttgtaatggcgaattcggaatccggtggttcgttggaagttgtgttgaaaagaattgagagtgcaatgaataaatgtaagaaagaaaagaagaactcggatttgagggattttaagttattgattgcgcaagttagagtaatggaggagaagtattttgatgcgttgaaggtttatgaggagttggtgaaagaggaaccgagggattttaggccgtatttgtgtcaagggatgatttatactttattgaggaagaaagatgaagcagaaaagaagtttgagcagtttaaaaagcttgttccgaagaatcatccttatagggagtatttggttgaaaatatgtttgctactaacttcttttcggagaaggtagagagatag

SEQ ID NO: 581 - protein, 329 aa, Populus balsamifera subsp. trichocarpa
  misc_feature (1)..(329): Ceres ANNOT ID no. 1455046
  misc_feature (273)..(306): Pfam Name: TPR_2 Pfam Description: Tetratricopeptide repeat
  misc_feature 62483:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(329): Functional Homolog of  Ceres CLONE ID no. 13930 at SEQ ID NO. 606 with e-value of 3.99E-78 and BLAST sequence identity of 54.7
MESIAKQPLNLSLNPHRPSFPNPIVSLTFKTPPPSSSPFKLSTSIRASSSSRITPLNQSLTTIIKTTSITLTAAAVLFFTRFNSKPAIASPVAASSSTADPTKESSKENVSFEEQERALQDHLAQNPSDVEALRSLMEVRIKSKKLQEAIEVVDRLIELEPNEDEWPLLKSQIYTYSGDFESAKDGFEAVLQKDPLRVEAYHGLVMANSESGGSLEVVLKRIESAMNKCKKEKKNSDLRDFKLLIAQVRVMEEKYFDALKVYEELVKEEPRDFRPYLCQGMIYTLLRKKDEAEKKFEQFKKLVPKNHPYREYLVENMFATNFFSEKVER

SEQ ID NO: 582 - protein, 281 aa, Arabidopsis thaliana
  misc_feature (1)..(281): Ceres CLONE ID no. 14033
  misc_feature (64)..(162): Pfam Name: Ribosomal_L15 Pfam Description: Ribosomal protein L15 amino terminal region
  misc_feature: Phenotype: WHOLE PLANT - Small Useful for modulating plant size
MLRRRLLSIISTSLINSSFHQTAKPRFIISSPLLQCRPSPISTQIPTSTSRALSFQGIRAYSLLSLNDLRDNVPRKLKTRKGRGIGSGKGKTAGRGHKGQKARGTMKFGFEGGQTPLRRRLPKRGFKNKFKLHFQPVGLGKIAKLINAGKIDSHELITMKTLKDVGAIGKQIEDGVRLMGRGADDIKWPLHFEVSRVTVRAKEVVEAAGGSVRRVYYNKLGLRALLKPEWFEKKGRLLPKAARPPPKQQDKVDSIGRLPAPKKPIPFFAAEETKVESPVES

SEQ ID NO: 583 - DNA, 822 bp, Populus balsamifera subsp. trichocarpa
  misc_feature (1)..(822): Ceres ANNOT ID no. 1480322
  misc_feature 62661:<222: Transcription Factor
  misc_feature: Phenotype: WHOLE PLANT - Small Useful for modulating plant size
atgataagaagaagattactctcttcactgatctcatcaacctcactcctaacccccaaaaccaccttaattcccacattctctcaaattcaacccttcaaagaatcaaactttaacaattattttgcaaatggggcatctgggtttatgggttttagggcatatagtttgttgagtttgaatgatttgagggacaatgttccaaggaagcaaaagacaagaaagggtcgtggcattgggtctggtaaaggaaagactgcagggagaggtcataaaggacagaaagccagagggactatgaagtttggttttgaaggtgggcagactccaatgcgaaggcgtttgcccaaaagggggtttaagaatccctttagtctcacttttcagccagtagggttgggaaagattgcaagacttattaatgcagggaagatagattcccatgaattaatcacaatgaaaacgctaaaggagactggggccatcgggaagcagataaaagatggcgtaagactgatggggcgtggtgcggagaagatccaatggcctattcatctggaggtgtcaagagtgactgtcagggcaaagcaagcagttgaagcggctggtggatctgtcagacgagtgcattacaaccagttgggtttgcgggcattgctcaagcctgagtggtttgaaaagaaggggaggttgttgccaaaggctgctaggcctccaccaaagctaagaggtaaagttgatagcatcggccgtttgcctgccccaaccaaacctattcctttttatactgaagagaaggaggcggcctctactcctgcctag

SEQ ID NO: 584 - protein, 273 aa, Populus balsamifera subsp. trichocarpa
  misc_feature (1)..(273): Ceres ANNOT ID no. 1480322
  misc_feature (171)..(204): Pfam Name: L15 Pfam Description: Ribosomal protein L15
  misc_feature (58)..(156): Pfam Name: Ribosomal_L15 Pfam Description: Ribosomal protein L15 amino terminal region
  misc_feature: SWISSPROT Homolog: RL15_BRUAB 50S ribosomal protein L15 with e-value of 4.0e-31 and BLAST sequence identity of 49.0
  misc_feature: SWISSPROT Homolog: RL15_BRUME 50S ribosomal protein L15 with e-value of 4.0e-31 and BLAST sequence identity of 49.0
  misc_feature: SWISSPROT Homolog: RL15_BRUSU 50S ribosomal protein L15 with e-value of 4.0e-31 and BLAST sequence identity of 49.0
  misc_feature: SWISSPROT Homolog: RM10_YEAST 60S ribosomal protein L10, (YmL10/YmL18) with e-value of 4.6e-30 and BLAST sequence identity of 39.2
  misc_feature: SWISSPROT Homolog: RL15_RHOPA 50S ribosomal protein L15 (RRP-L15) with e-value of 9.7e-30 and BLAST sequence identity of 47.4
  misc_feature 62763:<222: Transcription Factor
  misc_feature: Phenotype: WHOLE PLANT - Small Useful for modulating plant size
  misc_feature (1)..(273): Functional Homolog of  Ceres CLONE ID no. 14033 at SEQ ID NO. 611 with e-value of 2.10E-104 and BLAST sequence identity of 76.8
MIRRRLLSSLISSTSLLTPKTTLIPTFSQIQPFKESNFNNYFANGASGFMGFRAYSLLSLNDLRDNVPRKQKTRKGRGIGSGKGKTAGRGHKGQKARGTMKFGFEGGQTPMRRRLPKRGFKNPFSLTFQPVGLGKIARLINAGKIDSHELITMKTLKETGAIGKQIKDGVRLMGRGAEKIQWPIHLEVSRVTVRAKQAVEAAGGSVRRVHYNQLGLRALLKPEWFEKKGRLLPKAARPPPKLRGKVDSIGRLPAPTKPIPFYTEEKEAASTPA

SEQ ID NO: 585 - DNA, 810 bp, Populus balsamifera subsp. trichocarpa
  misc_feature (1)..(810): Ceres ANNOT ID no. 1493735
  misc_feature 62850:<222: Transcription Factor
  misc_feature: Phenotype: WHOLE PLANT - Small Useful for modulating plant size
atgataaggagaagattactctcttcattgctctcatcaaccccactcttaactcccaaaaccacctcaatttccactttcactgcaattcaaactctcaaagactcaaactttgcaaatggggcatctggatttatgggttttagggcttatagtttgttaagtttgaatgatttgagggacaatgtgccaaggaagcagaagacaagaaagggtcgtggtattgggtctggtaaaggaaagacggcagggagaggtcataaaggacagaaagctagagggactatgaagtttggttttgaaggtggacagactccaatgcgaaggcgtttgcccaaaagggggtttaagaacccctttagtctcacttttcagccagtaggtttgggaaagattgcaaaacttatcaatgcagggaagatagattcccatgaattaatcacaatgaaaatcctcaaggatactgcggccattgggaagcagataaaagatggagtaagactgatgggacgtggcgcggagaagatccaatggcctattcatctagaggtgtcaagagttactgtcagggcaaaggaagcagttgaagctgctggtggatccgtcagacgagtgcattacaataagctgggtttccgggcattgcttaagcctgagtggtttgaaaagaagggcaggttgttgccaaaggctgccaggcctccaccaaagctgaaagataaagttgatagcataggccgcttgcctgccccgactaaacctattcccttttacactgaagaaaaggaggcagcctctgctcctacctag

SEQ ID NO: 586 - protein, 269 aa, Populus balsamifera subsp. trichocarpa
  misc_feature (1)..(269): Ceres ANNOT ID no. 1493735
  misc_feature (167)..(200): Pfam Name: L15 Pfam Description: Ribosomal protein L15
  misc_feature (54)..(152): Pfam Name: Ribosomal_L15 Pfam Description: Ribosomal protein L15 amino terminal region
  misc_feature: SWISSPROT Homolog: RL15_BRUAB 50S ribosomal protein L15 with e-value of 4.0e-31 and BLAST sequence identity of 49.0
  misc_feature: SWISSPROT Homolog: RL15_BRUME 50S ribosomal protein L15 with e-value of 4.0e-31 and BLAST sequence identity of 49.0
  misc_feature: SWISSPROT Homolog: RL15_BRUSU 50S ribosomal protein L15 with e-value of 4.0e-31 and BLAST sequence identity of 49.0
  misc_feature: SWISSPROT Homolog: RM10_YEAST 60S ribosomal protein L10, (YmL10/YmL18) with e-value of 4.6e-30 and BLAST sequence identity of 39.2
  misc_feature: SWISSPROT Homolog: RL15_RHOPA 50S ribosomal protein L15 (RRP-L15) with e-value of 9.7e-30 and BLAST sequence identity of 47.4
  misc_feature 62952:<222: Transcription Factor
  misc_feature: Phenotype: WHOLE PLANT - Small Useful for modulating plant size
  misc_feature (1)..(269): Functional Homolog of  Ceres CLONE ID no. 14033 at SEQ ID NO. 611 with e-value of 8.99E-104 and BLAST sequence identity of 77.6
MIRRRLLSSLLSSTPLLTPKTTSISTFTAIQTLKDSNFANGASGFMGFRAYSLLSLNDLRDNVPRKQKTRKGRGIGSGKGKTAGRGHKGQKARGTMKFGFEGGQTPMRRRLPKRGFKNPFSLTFQPVGLGKIAKLINAGKIDSHELITMKILKDTAAIGKQIKDGVRLMGRGAEKIQWPIHLEVSRVTVRAKEAVEAAGGSVRRVHYNKLGFRALLKPEWFEKKGRLLPKAARPPPKLKDKVDSIGRLPAPTKPIPFYTEEKEAASAPT

SEQ ID NO: 587 - protein, 240 aa, Arabidopsis thaliana
  misc_feature (1)..(240): Ceres CLONE ID no. 14105
  misc_feature (17)..(140): Pfam Name: DUF862 Pfam Description: Eukaryotic protein of unknown function (DUF862)
  misc_feature: Phenotype: ROSETTE LEAVES - Curled 3 Useful for making ornamental plants with altered leaf shape
MLCFKGSVKRKKQSGSVPVYLNVYDLTPMNAYGYWLGLGVFHSGVEVHGVEYAFGAHESSSTGIFEVEPKKCPGFTFRKSILVGKTDLVAKEVRVFMEKLAEEYQGNKYHLITRNCNHFCNEVCLKLAQKSIPRWVNRLARLGVLCNCVLPPRLNEAKVRRVGKGELSESEKKKLRNRSRSDPLLSSSPSSSTPDNHRSHIRAKSSGNHPSSSSSSSSGSKKNRRPKAQDQKSPSVSIKT

SEQ ID NO: 588 - DNA, 696 bp, Populus balsamifera subsp. trichocarpa
  misc_feature (1)..(696): Ceres ANNOT ID no. 1455669
  misc_feature 63112:<222: Transcription Factor
  misc_feature: Phenotype: ROSETTE LEAVES - Curled 3 Useful for making ornamental plants with altered leaf shape
atggtgatgttgaaccggaaaaagaaaacagggacagttccggtttacttaaatgtttatgatttgacaactgttaatggttacgcttactgggttggtctcggggtctatcattctggtgtacaagttcacggtgttgaatatagttttggagcacatgatcatgagacaacggggatttttgaggttgagccgaagcaatgcccgggatttatgtttaggaaatctatattgattggaagaaccgatttgggtcctaaagaagttcgggccttcatggagaaattagctcaggagtatcctgggaatacttaccatcttattactaagaactgcaatcacttctgtaatgatgtgtgtttcaagctgactgggaaaacaattccacaatgggttaatcgtcttgctcgtttaggttttctttgcaattgtgttcttccagcagagttgaatcaaacaaaaattcgccaagttagatcagaagaaagtgcacgagagggagagaagaagaaattgaggagccggtcgactaggttcatttcttcttctaaccctgtaaatacttccccttcattgacatcttacccttcaagttctgaaagcagaagtggtagacagaaacgatccattcctgtgtctccaagatcttttgttcacgatgaatcttcatcatcgacatggagcttgaaggcttaa

SEQ ID NO: 589 - protein, 229 aa, Populus balsamifera subsp. trichocarpa
  misc_feature (1)..(229): Ceres ANNOT ID no. 1455669
  misc_feature (11)..(134): Pfam Name: DUF862 Pfam Description: Eukaryotic protein of unknown function (DUF862)
  misc_feature: SWISSPROT Homolog: CG146_ARATH UPF0326 protein At4g17486 with e-value of 1.0e-48 and BLAST sequence identity of 50.0
  misc_feature: SWISSPROT Homolog: CG146_HUMAN UPF0326 protein CGI-146 with e-value of 5.3e-29 and BLAST sequence identity of 37.4
  misc_feature: SWISSPROT Homolog: CG146_MOUSE UPF0326 protein CGI-146 homolog with e-value of 8.7e-29 and BLAST sequence identity of 37.2
  misc_feature: SWISSPROT Homolog: CG146_PONPY UPF0326 protein CGI-146 homolog with e-value of 8.7e-29 and BLAST sequence identity of 38.0
  misc_feature: SWISSPROT Homolog: HAG1_SCHPO UPF0326 protein hag1 with e-value of 2.8e-23 and BLAST sequence identity of 41.2
  misc_feature 63202:<222: Transcription Factor
  misc_feature: Phenotype: ROSETTE LEAVES - Curled 3 Useful for making ornamental plants with altered leaf shape
  misc_feature (1)..(229): Functional Homolog of  Ceres CLONE ID no. 14105 at SEQ ID NO. 616 with e-value of 8.20E-71 and BLAST sequence identity of 64.2
MLNRKKKTGTVPVYLNVYDLTTVNGYAYWVGLGVYHSGVQVHGVEYSFGAHDHETTGIFEVEPKQCPGFMFRKSILIGRTDLGPKEVRAFMEKLAQEYPGNTYHLITKNCNHFCNDVCFKLTGKTIPQWVNRLARLGFLCNCVLPAELNQTKIRQVRSEESAREGEKKKLRSRSTRFISSSNPVNTSPSLTSYPSSSESRSGRQKRSIPVSPRSFVHDESSSSTWSLKA

SEQ ID NO: 590 - DNA, 699 bp, Populus balsamifera subsp. trichocarpa
  misc_feature (1)..(699): Ceres ANNOT ID no. 1477732
  misc_feature 63280:<222: Transcription Factor
  misc_feature: Phenotype: ROSETTE LEAVES - Curled 3 Useful for making ornamental plants with altered leaf shape
atgctgcgtagaatggtgatgttgaaccagaaaaagaaaactgggacggttccagtttacttaaatgtttatgatttgacgacgattaatggttacgcttactgggttggtctcgggatctaccattccggtgtacaagttcacggtgttgaatatggttttggagcacatgatcatccgacaacggggatttttgaggttgagccgaagcaatgcccgggatttatgtttaggaaatcaatattgattggaagaactgatttgggtcctaaagaagttcgggtgttcatggagaaattagctcaggagtttcctgggaatacttaccatcttatcactaagaactgcaatcacttctgtaatgatgtgtgcctcaagttgactgggaaaaaaattccacgatgggttaatcgtcttgctcgtataggttttctttgcaactgtgttcttccagtggagttgaatcaaacaaaaatccgccaagttagatccgatgatattgtacaagagaagaagaaattgagaagccgttcgactaggttcccatcttcttctaatccggtaacttccccttcattgacaccttgcccttcaagttctggaagcagaagtggtagacagagacgttttattcctctgacttcaagatcttttgttcatgatgactctacgtcctcgtcatggagcttgaaggcttaa

SEQ ID NO: 591 - protein, 226 aa, Populus balsamifera subsp. trichocarpa
  misc_feature (1)..(226): Ceres ANNOT ID no. 1477732
  misc_feature (11)..(134): Pfam Name: DUF862 Pfam Description: Eukaryotic protein of unknown function (DUF862)
  misc_feature: SWISSPROT Homolog: CG146_ARATH UPF0326 protein At4g17486 with e-value of 1.0e-48 and BLAST sequence identity of 50.0
  misc_feature: SWISSPROT Homolog: CG146_HUMAN UPF0326 protein CGI-146 with e-value of 5.3e-29 and BLAST sequence identity of 37.4
  misc_feature: SWISSPROT Homolog: CG146_MOUSE UPF0326 protein CGI-146 homolog with e-value of 8.7e-29 and BLAST sequence identity of 37.2
  misc_feature: SWISSPROT Homolog: CG146_PONPY UPF0326 protein CGI-146 homolog with e-value of 8.7e-29 and BLAST sequence identity of 38.0
  misc_feature: SWISSPROT Homolog: HAG1_SCHPO UPF0326 protein hag1 with e-value of 2.8e-23 and BLAST sequence identity of 41.2
  misc_feature 63370:<222: Transcription Factor
  misc_feature: Phenotype: ROSETTE LEAVES - Curled 3 Useful for making ornamental plants with altered leaf shape
  misc_feature (1)..(226): Functional Homolog of  Ceres CLONE ID no. 14105 at SEQ ID NO. 616 with e-value of 2.49E-69 and BLAST sequence identity of 66.1
MLNQKKKTGTVPVYLNVYDLTTINGYAYWVGLGIYHSGVQVHGVEYGFGAHDHPTTGIFEVEPKQCPGFMFRKSILIGRTDLGPKEVRVFMEKLAQEFPGNTYHLITKNCNHFCNDVCLKLTGKKIPRWVNRLARIGFLCNCVLPVELNQTKIRQVRSDDIVQEKKKLRSRSTRFPSSSNPVTSPSLTPCPSSSGSRSGRQRRFIPLTSRSFVHDDSTSSSWSLKA

SEQ ID NO: 592 - DNA, 681 bp, Populus balsamifera subsp. trichocarpa
  misc_feature (1)..(681): Ceres ANNOT ID no. 1508866
  misc_feature 63448:<222: Transcription Factor
  misc_feature: Phenotype: ROSETTE LEAVES - Curled 3 Useful for making ornamental plants with altered leaf shape
atgttgtgcagaatggtgatgttgaaccggaaaaagaaaacagggacagttccggtttacttaaatgtttatgatttgacaactgttaatggttacgcttactgggttggtctcggggtctatcattctggtgtacaagttcacggtgttgaatatagttttggagcacatgatcatgagacaacggggatttttgaggttgagccgaagcaatgcccgggatttatgtttaggaaatctatattgattggaagaaccgatttgggtcctaaagaagttcgggccttcatggagaaattagctcaggagtatcctgggaatacttaccatcttattactaagaactgcaatcacttctgtaatgatgtgtgtttcaagctgactgggaaaacaattccacaatgggttaatcgtcttgctcgtttagcagagttgaatcaaacaaaaattcgccaagttagatcagaagaaagtgcacgagagggagagaagaagaaattgaggagccggtcgactaggttcatttcttcttctaaccctgtaaatacttccccttcattgacatcttacccttcaagttctgaaagcagaagtggtagacagaaacgatccattcctgtgtctccaagatcttttgttcacgatgaatcttcatcatcgacatggagcttgaaggcttaa

SEQ ID NO: 593 - protein, 226 aa, Populus balsamifera subsp. trichocarpa
  misc_feature (1)..(226): Ceres ANNOT ID no. 1508866
  misc_feature (17)..(140): Pfam Name: DUF862 Pfam Description: Eukaryotic protein of unknown function (DUF862)
  misc_feature: SWISSPROT Homolog: CG146_ARATH UPF0326 protein At4g17486 with e-value of 1.0e-48 and BLAST sequence identity of 50.0
  misc_feature: SWISSPROT Homolog: CG146_HUMAN UPF0326 protein CGI-146 with e-value of 5.3e-29 and BLAST sequence identity of 37.4
  misc_feature: SWISSPROT Homolog: CG146_MOUSE UPF0326 protein CGI-146 homolog with e-value of 8.7e-29 and BLAST sequence identity of 37.2
  misc_feature: SWISSPROT Homolog: CG146_PONPY UPF0326 protein CGI-146 homolog with e-value of 8.7e-29 and BLAST sequence identity of 38.0
  misc_feature: SWISSPROT Homolog: HAG1_SCHPO UPF0326 protein hag1 with e-value of 2.8e-23 and BLAST sequence identity of 41.2
  misc_feature 63538:<222: Transcription Factor
  misc_feature: Phenotype: ROSETTE LEAVES - Curled 3 Useful for making ornamental plants with altered leaf shape
  misc_feature (1)..(226): Functional Homolog of  Ceres CLONE ID no. 14105 at SEQ ID NO. 616 with e-value of 2.99E-64 and BLAST sequence identity of 62.5
MLCRMVMLNRKKKTGTVPVYLNVYDLTTVNGYAYWVGLGVYHSGVQVHGVEYSFGAHDHETTGIFEVEPKQCPGFMFRKSILIGRTDLGPKEVRAFMEKLAQEYPGNTYHLITKNCNHFCNDVCFKLTGKTIPQWVNRLARLAELNQTKIRQVRSEESAREGEKKKLRSRSTRFISSSNPVNTSPSLTSYPSSSESRSGRQKRSIPVSPRSFVHDESSSSTWSLKA

SEQ ID NO: 594 - protein, 184 aa, Arabidopsis thaliana
  misc_feature (1)..(184): Ceres CLONE ID no. 14234
  misc_feature (1)..(184): Also Known As Ceres CDNA ID no. 23367680
  misc_feature (1)..(184): Also Known As Ceres GEMINI ID 535F2
  misc_feature (20)..(40): Pfam Name: MMR_HSR1 Pfam Description: GTPase of unknown function
  misc_feature 63636:<222: Transcription Factor
  misc_feature: Phenotype: Activates expression of the gene endogenous to the AtHMGS (SEQ ID NO 4144) regalutory region Useful for modulating Terpenoid Biosynthesis
MGLWDSLLNWLRSLFFKQEMELSLVGLQNAGKTSLVNAIATGGYSEDMIPTVGFNMRKVTKGNVTIKIWDLGGQRRFRTMWERYCRGVSAIVYVIDAADRDSVPISRSELNDLLTKPSLNGIPLLILGNKIDKSEALSKQALVDQLGLESVTDREVCCYMISCKDSINIDAVIDWLIKHSRTAT

SEQ ID NO: 595 - DNA, 564 bp, Populus balsamifera subsp. trichocarpa
  misc_feature (1)..(564): Ceres ANNOT ID no. 1502448
  misc_feature 63697:<222: Transcription Factor
  misc_feature: Phenotype: Activates expression of the gene endogenous to the AtHMGS (SEQ ID NO 4144) regalutory region Useful for modulating Terpenoid Biosynthesis
atgggtctcttggattcccttctaaactggctcaggagcttattctttaaacaagaaatggagctatcccttgtaggccttcagaatgctggaaagacatctcttgttaattccattgctacaggtggctacagtgaggacatgattccaactgttggattcaacatgcgaaaagttacaaaaggcaatgtaacgataaagctttgggatctcggagggcagcggaggtttcgtacaatgtgggagcgttattgtcgtggggtcactgcgattctgtatgtagttgatgcagctgatagagacagcgttcccatttcaagaagtgagttacatgacctcctaacaaaaccttctttaagtggaatccctttgcttgttgttggcaacaaaattgacaagtcagaagctctgtccaagcaagctttggtggatcacggtcttgaatcaatcgcagatagagaggtgtgctgctatatgatctcatgcaaggactccataaacataggcatggtcatcgactggcttatcaagcactcaaaaacagcaaattcatcagcagtttga

SEQ ID NO: 596 - protein, 187 aa, Populus balsamifera subsp. trichocarpa
  misc_feature (1)..(187): Ceres ANNOT ID no. 1502448
  misc_feature (51)..(132): Pfam Name: MMR_HSR1 Pfam Description: GTPase of unknown function
  misc_feature: SWISSPROT Homolog: ARL8B_HUMAN ADP-ribosylation factor-like protein 8B with e-value of 5.7e-64 and BLAST sequence identity of 64.3
  misc_feature: SWISSPROT Homolog: ARL8B_HUMAN ADP-ribosylation factor-like protein 10C ( Novel small G protein indispensable for equal chromosome segregation 1)
  misc_feature: SWISSPROT Homolog: ARL8B_MOUSE ADP-ribosylation factor-like protein 8B with e-value of 5.7e-64 and BLAST sequence identity of 64.3
  misc_feature: SWISSPROT Homolog: ARL8B_MOUSE ADP-ribosylation factor-like protein 10C ( Novel small G protein indispensable for equal chromosome segregation 1)
  misc_feature: SWISSPROT Homolog: ARL8B_RAT ADP-ribosylation factor-like protein 8B with e-value of 5.7e-64 and BLAST sequence identity of 64.3
  misc_feature: SWISSPROT Homolog: ARL8B_BRARE ADP-ribosylation factor-like protein 8B with e-value of 1.2e-63 and BLAST sequence identity of 63.7
  misc_feature: SWISSPROT Homolog: ARL8B_BOVIN ADP-ribosylation factor-like protein 8B with e-value of 1.5e-63 and BLAST sequence identity of 63.7
  misc_feature 63801:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(187): Functional Homolog of  Ceres CLONE ID no. 14234 at SEQ ID NO. 623 with e-value of 8.09E-87 and BLAST sequence identity of 91.2
MGLLDSLLNWLRSLFFKQEMELSLVGLQNAGKTSLVNSIATGGYSEDMIPTVGFNMRKVTKGNVTIKLWDLGGQRRFRTMWERYCRGVTAILYVVDAADRDSVPISRSELHDLLTKPSLSGIPLLVVGNKIDKSEALSKQALVDHGLESIADREVCCYMISCKDSINIGMVIDWLIKHSKTANSSAV

SEQ ID NO: 597 - DNA, 510 bp, Populus balsamifera subsp. trichocarpa
  misc_feature (1)..(510): Ceres ANNOT ID no. 1498406
  misc_feature 63870:<222: Transcription Factor
  misc_feature: Phenotype: Activates expression of the gene endogenous to the AtHMGS (SEQ ID NO 4144) regalutory region Useful for modulating Terpenoid Biosynthesis
atgggtctctttgattcccttctaaactggctcaggagcttattctttaaacaagaaatggagctatcccttgtaggccttcagaatgctggaaagacatctcttgttaattccattgctgttggattcaacatgcgaaaagttacaaaaggcaatgtgacgataaagctttgggatcttggagggcagcggaggtttcgtacaatgtgggagcgttattgtcgtggagtctctgcgattctggacagcgttcccctatctagaagtgagttacatgacctcctaaccaaaccttccttaagcggaatccctttgcttgtcgttggcaacaaaattgacaagccagaagctttttccaagcaagctttggtggatcagctaggtcttgaatcaatcacagatagagaggtttgctgctacatgatctcatgcaaggactccacaaacatagacattgtcattgattggcttatcaagcactcaaaaacagcaacaggatctgtagcttga

SEQ ID NO: 598 - protein, 169 aa, Populus balsamifera subsp. trichocarpa
  misc_feature (1)..(169): Ceres ANNOT ID no. 1498406
  misc_feature (20)..(40): Pfam Name: MMR_HSR1 Pfam Description: GTPase of unknown function
  misc_feature: SWISSPROT Homolog: ARL8B_HUMAN ADP-ribosylation factor-like protein 8B with e-value of 5.7e-64 and BLAST sequence identity of 64.3
  misc_feature: SWISSPROT Homolog: ARL8B_HUMAN ADP-ribosylation factor-like protein 10C ( Novel small G protein indispensable for equal chromosome segregation 1)
  misc_feature: SWISSPROT Homolog: ARL8B_MOUSE ADP-ribosylation factor-like protein 8B with e-value of 5.7e-64 and BLAST sequence identity of 64.3
  misc_feature: SWISSPROT Homolog: ARL8B_MOUSE ADP-ribosylation factor-like protein 10C ( Novel small G protein indispensable for equal chromosome segregation 1)
  misc_feature: SWISSPROT Homolog: ARL8B_RAT ADP-ribosylation factor-like protein 8B with e-value of 5.7e-64 and BLAST sequence identity of 64.3
  misc_feature: SWISSPROT Homolog: ARL8B_BRARE ADP-ribosylation factor-like protein 8B with e-value of 1.2e-63 and BLAST sequence identity of 63.7
  misc_feature: SWISSPROT Homolog: ARL8B_BOVIN ADP-ribosylation factor-like protein 8B with e-value of 1.5e-63 and BLAST sequence identity of 63.7
  misc_feature 63972:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(169): Functional Homolog of  Ceres CLONE ID no. 14234 at SEQ ID NO. 623 with e-value of 1.80E-73 and BLAST sequence identity of 90.9
MGLFDSLLNWLRSLFFKQEMELSLVGLQNAGKTSLVNSIAVGFNMRKVTKGNVTIKLWDLGGQRRFRTMWERYCRGVSAILDSVPLSRSELHDLLTKPSLSGIPLLVVGNKIDKPEAFSKQALVDQLGLESITDREVCCYMISCKDSTNIDIVIDWLIKHSKTATGSVA

SEQ ID NO: 599 - DNA, 498 bp, Populus balsamifera subsp. trichocarpa
  misc_feature (1)..(498): Ceres ANNOT ID no. 1441275
  misc_feature 64038:<222: Transcription Factor
  misc_feature: Phenotype: Activates expression of the gene endogenous to the AtHMGS (SEQ ID NO 4144) regalutory region Useful for modulating Terpenoid Biosynthesis
atggagctgtctcttataggacttcagaatgctgggaaaacttctcttgtaaatgttgtcgctactggtggatatagcgaagacatgatcccaacagttggatttaacatgaggaaggttacaaaaggcaatgtcacaataaagttgtgggatcttggaggtcaaccaaggttccgcagtatgtgggagagatattgtcgcgcagtttcagccattgtatatgtcgtggatgccgctgattttgataatttatctgtctcgagaagtgaacttcacgatcttttaagtaaaccctctctgagtggtatccctttgctggtactgggaaataagattgacaaaccaggagccttgtccaaggaagatttcatggaacaaatggggcttaagtccatcaccgacagagaagtatgctgctacatgatctcatgcaagaactcaaccaacatcgacacagttattgactggcttgtaaaacattcaaaatcgaagacttga

SEQ ID NO: 600 - protein, 165 aa, Populus balsamifera subsp. trichocarpa
  misc_feature (1)..(165): Ceres ANNOT ID no. 1441275
  misc_feature (67)..(113): Pfam Name: MMR_HSR1 Pfam Description: GTPase of unknown function
  misc_feature: SWISSPROT Homolog: ARL8B_HUMAN ADP-ribosylation factor-like protein 8B with e-value of 5.7e-64 and BLAST sequence identity of 64.3
  misc_feature: SWISSPROT Homolog: ARL8B_HUMAN ADP-ribosylation factor-like protein 10C ( Novel small G protein indispensable for equal chromosome segregation 1)
  misc_feature: SWISSPROT Homolog: ARL8B_MOUSE ADP-ribosylation factor-like protein 8B with e-value of 5.7e-64 and BLAST sequence identity of 64.3
  misc_feature: SWISSPROT Homolog: ARL8B_MOUSE ADP-ribosylation factor-like protein 10C ( Novel small G protein indispensable for equal chromosome segregation 1)
  misc_feature: SWISSPROT Homolog: ARL8B_RAT ADP-ribosylation factor-like protein 8B with e-value of 5.7e-64 and BLAST sequence identity of 64.3
  misc_feature: SWISSPROT Homolog: ARL8B_BRARE ADP-ribosylation factor-like protein 8B with e-value of 1.2e-63 and BLAST sequence identity of 63.7
  misc_feature: SWISSPROT Homolog: ARL8B_BOVIN ADP-ribosylation factor-like protein 8B with e-value of 1.5e-63 and BLAST sequence identity of 63.7
  misc_feature 64140:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(165): Functional Homolog of  Ceres CLONE ID no. 14234 at SEQ ID NO. 623 with e-value of 1.00E-70 and BLAST sequence identity of 79.3
MELSLIGLQNAGKTSLVNVVATGGYSEDMIPTVGFNMRKVTKGNVTIKLWDLGGQPRFRSMWERYCRAVSAIVYVVDAADFDNLSVSRSELHDLLSKPSLSGIPLLVLGNKIDKPGALSKEDFMEQMGLKSITDREVCCYMISCKNSTNIDTVIDWLVKHSKSKT

SEQ ID NO: 601 - DNA, 540 bp, Populus balsamifera subsp. trichocarpa
  misc_feature (1)..(540): Ceres ANNOT ID no. 1445426
  misc_feature 64206:<222: Transcription Factor
  misc_feature: Phenotype: Activates expression of the gene endogenous to the AtHMGS (SEQ ID NO 4144) regalutory region Useful for modulating Terpenoid Biosynthesis
atggagctatcccttgtaggccttcagaatgctggaaagacatctcttgttaattccattgctacaggtggctacagtgaggacatgattccaactgtaggttggattcaacatgcgaaaagttacaaaaggcaatgtgacgataaagctttgggatcttggagggcagcggaggctactgaatcttttgccccaatagagctttggcttttgttagctcaatcgatgacgttgtttgaaatagacagatatgtagttgatgcagctgacagggacagcgttcccctatctagaagtgagttacatgacctcctaaccaaaccttccttaagcggaatccctttgcttgtcgttggcaacaaaattgacaagccagaagctttttccaagcaagctttggtggatcagctaggtcttgaatcaatcacagatagagaggtttgctgctacatgatctcatgcaaggactccacaaacatagacattgtcattgattggcttatcaagcactcaaaaacagcaacaggatctgtagcttga

SEQ ID NO: 602 - protein, 179 aa, Populus balsamifera subsp. trichocarpa
  misc_feature (1)..(179): Ceres ANNOT ID no. 1445426
  misc_feature (1)..(21): Pfam Name: MMR_HSR1 Pfam Description: GTPase of unknown function
  misc_feature (84)..(148): Pfam Name: Arf Pfam Description: ADP-ribosylation factor family
  misc_feature: SWISSPROT Homolog: ARL8B_HUMAN ADP-ribosylation factor-like protein 8B with e-value of 5.7e-64 and BLAST sequence identity of 64.3
  misc_feature: SWISSPROT Homolog: ARL8B_HUMAN ADP-ribosylation factor-like protein 10C ( Novel small G protein indispensable for equal chromosome segregation 1)
  misc_feature: SWISSPROT Homolog: ARL8B_MOUSE ADP-ribosylation factor-like protein 8B with e-value of 5.7e-64 and BLAST sequence identity of 64.3
  misc_feature: SWISSPROT Homolog: ARL8B_MOUSE ADP-ribosylation factor-like protein 10C ( Novel small G protein indispensable for equal chromosome segregation 1)
  misc_feature: SWISSPROT Homolog: ARL8B_RAT ADP-ribosylation factor-like protein 8B with e-value of 5.7e-64 and BLAST sequence identity of 64.3
  misc_feature: SWISSPROT Homolog: ARL8B_BRARE ADP-ribosylation factor-like protein 8B with e-value of 1.2e-63 and BLAST sequence identity of 63.7
  misc_feature: SWISSPROT Homolog: ARL8B_BOVIN ADP-ribosylation factor-like protein 8B with e-value of 1.5e-63 and BLAST sequence identity of 63.7
  misc_feature 64316:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(179): Functional Homolog of  Ceres CLONE ID no. 14234 at SEQ ID NO. 623 with e-value of 1.50E-53 and BLAST sequence identity of 72.1
MELSLVGLQNAGKTSLVNSIATGGYSEDMIPTVGWIQHAKSYKRQCDDKALGSWRAAEATESFAPIELWLLLAQSMTLFEIDRYVVDAADRDSVPLSRSELHDLLTKPSLSGIPLLVVGNKIDKPEAFSKQALVDQLGLESITDREVCCYMISCKDSTNIDIVIDWLIKHSKTATGSVA

SEQ ID NO: 603 - protein, 329 aa, Arabidopsis thaliana
  misc_feature (1)..(329): Ceres CLONE ID no. 14246
  misc_feature (1)..(329): Also Known As Ceres CDNA ID no. 23657254
  misc_feature (1)..(329): Also Known As Ceres GEMINI ID 532D11
  misc_feature (118)..(189): Pfam Name: RRM_1 Pfam Description: RNA recognition motif. (a.k.a. RRM RBD, or RNP domain)
  misc_feature 64406:<222: Transcription Factor
  misc_feature: Phenotype: Activates expression of the gene endogenous to the AtATTPS3 (SEQ ID NO 4165) regalutory region Useful for modulating Terpenoid Biosynthesis
MSSAYCSSAVAVSAAATASSAATFNPLLSSHSNSQLFYRFTPKSFKLVANCPNPLILHSNIRRHRFFCAAETEASSADDEIQASVEEEEEVEEEGDEGEEEVEEEKQTTQASGEEGRLYVGNLPYTITSSELSQIFGEAGTVVDVQIVYDKVTDRSRGFGFVTMGSIEEAKEAMQMFNSSQIGGRTVKVNFPEVPRGGENEVMRTKIRDNNRSYVDSPHKVYAGNLGWNLTSQGLKDAFGDQPGVLGAKVIYERNTGRSRGFGFISFESAENVQSALATMNGVEVEGRALRLNLASEREKPTVSPPSVEEGETEEASLESNEVLSNVSA

SEQ ID NO: 604 - DNA, 981 bp, Populus balsamifera subsp. trichocarpa
  misc_feature (1)..(981): Ceres ANNOT ID no. 1454534
  misc_feature 64494:<222: Transcription Factor
  misc_feature: Phenotype: Activates expression of the gene endogenous to the AtATTPS3 (SEQ ID NO 4165) regalutory region Useful for modulating Terpenoid Biosynthesis
atgtcagctttctccatggcagcttcaactataacttcctctccattacacacaaagctttcaaacctctccttcactcactctccacttccactcccttcccacttctcatcaaaacccttacttaaacctctaaaacccccccaactcaacaaccacgactctaattccctttctctcctctccctccctcatttccatggcatttttgctgcctcctctgacagttttgaatctggaacagaagaaaacaccacagctctagatgacccacaaagtgaaacggacgaatttgaccaagaaattgtagaagaagaaggagatgtggaggccataaaagcaactgaagaaggcaagctttatgtgggaaatctaccatattcaatgacttcttcggaattgactgaggtttttgaggaagctggtcgtgttttcagtgctgaggttatttatgatcgagttacggataggagcaggggctttgggtttgttaccatgggaagtgttgaagaagctaaaaaggcgattcagatgttcaatggaacacaatttggaggtcgatctgtgagggtgaacttcccagaagtgccaaggggaggtgagagggaagtaatgggaccaaggatacagagtggctacaaggggtttatagacagcgaacacaagatatatgcaggaaaccttggttggcgcctcacatctgagggtcttagagacgcatttgctaaccagccaggggtattaagtgccaaagtcatctacgagagggactcaagaagatcacgaggttttggctttgtctcttttgaatctgctgagaatgcagaagctgctttagaagccatgaatggagaggaggtggaagggcggcctatgcgattgaatttggccggagaaagatcacctcctccttcagccaaggaaaataacacagaaaacaatcttgagagcggtgaattgctgtccagctttggaacctga

SEQ ID NO: 605 - protein, 326 aa, Populus balsamifera subsp. trichocarpa
  misc_feature (1)..(326): Ceres ANNOT ID no. 1454534
  misc_feature (120)..(191): Pfam Name: RRM_1 Pfam Description: RNA recognition motif. (a.k.a. RRM RBD, or RNP domain)
  misc_feature (272)..(298): Pfam Name: DbpA Pfam Description: DbpA RNA binding domain
  misc_feature: SWISSPROT Homolog: ROC5_NICSY 33 kDa ribonucleoprotein, chloroplast precursor with e-value of 1.9e-79 and BLAST sequence identity of 51.8
  misc_feature: SWISSPROT Homolog: ROC1_NICPL 30 kDa ribonucleoprotein, chloroplast precursor (CP-RBP30) with e-value of 6.3e-43 and BLAST sequence identity of 41.9
  misc_feature: SWISSPROT Homolog: ROC2_NICSY 29 kDa ribonucleoprotein B, chloroplast precursor (CP29B) with e-value of 1.7e-42 and BLAST sequence identity of 45.3
  misc_feature: SWISSPROT Homolog: ROC2_NICPL 31 kDa ribonucleoprotein, chloroplast precursor (CP-RBP31) with e-value of 2.7e-42 and BLAST sequence identity of 45.3
  misc_feature: SWISSPROT Homolog: ROC1_NICSY 29 kDa ribonucleoprotein A, chloroplast precursor (CP29A) with e-value of 1.3e-41 and BLAST sequence identity of 42.7
  misc_feature 64605:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(326): Functional Homolog of  Ceres CLONE ID no. 14246 at SEQ ID NO. 632 with e-value of 6.30E-80 and BLAST sequence identity of 55.0
MSAFSMAASTITSSPLHTKLSNLSFTHSPLPLPSHFSSKPLLKPLKPPQLNNHDSNSLSLLSLPHFHGIFAASSDSFESGTEENTTALDDPQSETDEFDQEIVEEEGDVEAIKATEEGKLYVGNLPYSMTSSELTEVFEEAGRVFSAEVIYDRVTDRSRGFGFVTMGSVEEAKKAIQMFNGTQFGGRSVRVNFPEVPRGGEREVMGPRIQSGYKGFIDSEHKIYAGNLGWRLTSEGLRDAFANQPGVLSAKVIYERDSRRSRGFGFVSFESAENAEAALEAMNGEEVEGRPMRLNLAGERSPPPSAKENNTENNLESGELLSSFGT

SEQ ID NO: 606 - DNA, 966 bp, Populus balsamifera subsp. trichocarpa
  misc_feature (1)..(966): Ceres ANNOT ID no. 1507701
  misc_feature 64701:<222: Transcription Factor
  misc_feature: Phenotype: Activates expression of the gene endogenous to the AtATTPS3 (SEQ ID NO 4165) regalutory region Useful for modulating Terpenoid Biosynthesis
atggcagcttcaactataacttcctctccattacacacaaagctttcaaacctctccttcactcactctccacttccactcccttcccacttctcatcaaaacccttacttaaacctctaaaacccccccaactcaacaaccacgactctaattccctttctctcctctccctccctcatttccatggcatttttgctgcctcctctgacagttttgaatctggaacagaagaaaacaccacagctctagatgacccacaaagtgaaacggacgaatttgaccaagaaattgtagaagaagaaggagatgtggaggccataaaagcaactgaagaaggcaagctttatgtgggaaatctaccatattcaatgacttcttcggaattgactgaggtttttgaggaagctggtcgtgttttcagtgctgaggttatttatgatcgagttacggataggagcaggggctttgggtttgttaccatgggaagtgttgaagaagctaaaaaggcgattcagatgttcaatggaacacaatttggaggtcgatctgtgagggtgaacttcccagaagtgccaaggggaggtgagagggaagtaatgggaccaaggatacagagtggctacaaggggtttatagacagcgaacacaagatatatgcaggaaaccttggttggcgcctcacatctgagggtcttagagacgcatttgctaaccagccaggggtattaagtgccaaagtcatctacgagagggactcaagaagatcacgaggttttggctttgtctcttttgaatctgctgagaatgcagaagctgctttagaagccatgaatggagaggaggtggaagggcggcctatgcgattgaatttggccggagaaagatcacctcctccttcagccaaggaaaataacacagaaaacaatcttgagagcggtgaattgctgtccagctttggaacctga

SEQ ID NO: 607 - protein, 321 aa, Populus balsamifera subsp. trichocarpa
  misc_feature (1)..(321): Ceres ANNOT ID no. 1507701
  misc_feature (115)..(186): Pfam Name: RRM_1 Pfam Description: RNA recognition motif. (a.k.a. RRM RBD, or RNP domain)
  misc_feature (267)..(293): Pfam Name: DbpA Pfam Description: DbpA RNA binding domain
  misc_feature: SWISSPROT Homolog: ROC5_NICSY 33 kDa ribonucleoprotein, chloroplast precursor with e-value of 1.9e-79 and BLAST sequence identity of 51.8
  misc_feature: SWISSPROT Homolog: ROC1_NICPL 30 kDa ribonucleoprotein, chloroplast precursor (CP-RBP30) with e-value of 6.3e-43 and BLAST sequence identity of 41.9
  misc_feature: SWISSPROT Homolog: ROC2_NICSY 29 kDa ribonucleoprotein B, chloroplast precursor (CP29B) with e-value of 1.7e-42 and BLAST sequence identity of 45.3
  misc_feature: SWISSPROT Homolog: ROC2_NICPL 31 kDa ribonucleoprotein, chloroplast precursor (CP-RBP31) with e-value of 2.7e-42 and BLAST sequence identity of 45.3
  misc_feature: SWISSPROT Homolog: ROC1_NICSY 29 kDa ribonucleoprotein A, chloroplast precursor (CP29A) with e-value of 1.3e-41 and BLAST sequence identity of 42.7
  misc_feature 64812:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(321): Functional Homolog of  Ceres CLONE ID no. 14246 at SEQ ID NO. 632 with e-value of 7.99E-80 and BLAST sequence identity of 55.4
MAASTITSSPLHTKLSNLSFTHSPLPLPSHFSSKPLLKPLKPPQLNNHDSNSLSLLSLPHFHGIFAASSDSFESGTEENTTALDDPQSETDEFDQEIVEEEGDVEAIKATEEGKLYVGNLPYSMTSSELTEVFEEAGRVFSAEVIYDRVTDRSRGFGFVTMGSVEEAKKAIQMFNGTQFGGRSVRVNFPEVPRGGEREVMGPRIQSGYKGFIDSEHKIYAGNLGWRLTSEGLRDAFANQPGVLSAKVIYERDSRRSRGFGFVSFESAENAEAALEAMNGEEVEGRPMRLNLAGERSPPPSAKENNTENNLESGELLSSFGT

SEQ ID NO: 608 - protein, 269 aa, Arabidopsis thaliana
  misc_feature (1)..(269): Ceres CLONE ID no. 14555
  misc_feature (18)..(186): Pfam Name: adh_short Pfam Description: short chain dehydrogenase
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVNNVGTSIFKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 609 - DNA, 801 bp, Populus balsamifera subsp. trichocarpa
  misc_feature (1)..(801): Ceres ANNOT ID no. 1511392
  misc_feature 65036:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
atggcagagagcagcagattcaaagactcgagatggtctctccatggaatgactgctcttgtcactggtggcactcgtggaatcgggaatgcaacagtggaggaacttgcagggtttggagcgagggtgcatacgtgttcaagaaacgaggaagagctcaataagtgcttgaaagaatgggaggctaaaggttttgtggttactggttcagtttgtgatgcatcttctcgtgtccagagagagaagcttatcgaggaagttggttctgtttttcatggcaaactcaacattctggtaaacaatgttggtacaaatatcaggaagccaaccactggttattctgctgaggaattttcaaacctcttagcaaccaactttgaatctgcataccatttgtctcaaattgcacatcctcttctaaaagaatctggagctggaagcgttgtgtttatttcctctgttgcaggtcttttgcatataggtagcggatcaatttatggagcaagtaaaggtgcaataaatcaacttacaaaaaatctggcttgtgagtgggcaaaagacaatatcaggaccaactgtgttgcaccctggtatatcagaacctcgcttgtggaacatttgctcgatgacaaggtgtttctagacaaaataatctctcgaacccctctccagcgcgttggagatccaaaggaagtctcatccctggtgggattcctttgcctacctgctgctgcttacatcaccggacaagttatttctgttgatgggggatttactgtgaatggatttaacccggtatag

SEQ ID NO: 610 - protein, 266 aa, Populus balsamifera subsp. trichocarpa
  misc_feature (1)..(266): Ceres ANNOT ID no. 1511392
  misc_feature (17)..(185): Pfam Name: adh_short Pfam Description: short chain dehydrogenase
  misc_feature: SWISSPROT Homolog: TRNH1_ARATH Putative tropinone reductase homolog At1g07440 (EC 1.1.1.-) with e-value of 8.9e-91 and BLAST sequence identity of 66.3
  misc_feature: SWISSPROT Homolog: TRNH_DATST Tropinone reductase homolog (EC 1.1.1.-) (P29X) with e-value of 1.6e-77 and BLAST sequence identity of 58.5
  misc_feature: SWISSPROT Homolog: TRN1_DATST Tropinone reductase 1 (EC 1.1.1.206) (Tropinone reductase-I) TR-I (Tropine dehydrogenase) with e-value of 4.5e-71 and BLAST sequence identity of 56.0
  misc_feature: SWISSPROT Homolog: TRN2_DATST Tropinone reductase 2 (EC 1.1.1.236) (Tropinone reductase-II) (TR-II) with e-value of 1.1e-67 and BLAST sequence identity of 53.3
  misc_feature: SWISSPROT Homolog: TRN2_HYONI Tropinone reductase 2 (EC 1.1.1.236) (Tropinone reductase-II) (TR-II) with e-value of 1.0e-66 and BLAST sequence identity of 52.9
  misc_feature 65184:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(266): Functional Homolog of  Ceres CLONE ID no. 14555 at SEQ ID NO. 637 with e-value of 7.90E-89 and BLAST sequence identity of 66.0
MAESSRFKDSRWSLHGMTALVTGGTRGIGNATVEELAGFGARVHTCSRNEEELNKCLKEWEAKGFVVTGSVCDASSRVQREKLIEEVGSVFHGKLNILVNNVGTNIRKPTTGYSAEEFSNLLATNFESAYHLSQIAHPLLKESGAGSVVFISSVAGLLHIGSGSIYGASKGAINQLTKNLACEWAKDNIRTNCVAPWYIRTSLVEHLLDDKVFLDKIISRTPLQRVGDPKEVSSLVGFLCLPAAAYITGQVISVDGGFTVNGFNPV

SEQ ID NO: 611 - DNA, 783 bp, Populus balsamifera subsp. trichocarpa
  misc_feature (1)..(783): Ceres ANNOT ID no. 1469356
  misc_feature 65317:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
atggagaagagatggtctctccaaggaatgacggctcttgtcactggtggaaccaaagggattggttatgctgttgtggatgagttggcagcgctaggggcaatcgtgcatacatgtgcgaggaaccaagaccagctcaatgaacgcatccgtgaatggaatgagaagggttttaaagttactggttcagtctgtgatgtatcctctgatgctgaaagagagaagctgatggaggaggtttcctctcgctttgatggtaaacttaatatccttgtaaacaatgctgggacaaacatatataaagcgaccttagattacacagctgaggatttcacatctctcatgaacacaaaccttcaatctgctttccatttgtcccaacttgcacatccccttttgaaagcttcaggggctggaaagattgtcttcatgtcttccattggtagtgtggtatctgtaaaccctcagtatcctttgtattcagcttctaaaggtgcaatgaaccaacttacaaggaatttggcgtgcgaatgggctaaggacaatataagggttaacggagttgcgccctggttcgtccgaactccactcacagcacatagtctggatgatgagagcattgcgaaggaggttttcagtcgaacccccatgagacgcgttggggaaccaggggaggtctcttctgttgtcgcatttctatgcttgcctgcaccaggtttcttaacaggacaaatcatatgcgtagatggagggatgtcagtgaatggcttttccatgggttga

SEQ ID NO: 612 - protein, 260 aa, Populus balsamifera subsp. trichocarpa
  misc_feature (1)..(260): Ceres ANNOT ID no. 1469356
  misc_feature (10)..(179): Pfam Name: adh_short Pfam Description: short chain dehydrogenase
  misc_feature: SWISSPROT Homolog: TRNH1_ARATH Putative tropinone reductase homolog At1g07440 (EC 1.1.1.-) with e-value of 8.9e-91 and BLAST sequence identity of 66.3
  misc_feature: SWISSPROT Homolog: TRNH_DATST Tropinone reductase homolog (EC 1.1.1.-) (P29X) with e-value of 1.6e-77 and BLAST sequence identity of 58.5
  misc_feature: SWISSPROT Homolog: TRN1_DATST Tropinone reductase 1 (EC 1.1.1.206) (Tropinone reductase-I) TR-I (Tropine dehydrogenase) with e-value of 4.5e-71 and BLAST sequence identity of 56.0
  misc_feature: SWISSPROT Homolog: TRN2_DATST Tropinone reductase 2 (EC 1.1.1.236) (Tropinone reductase-II) (TR-II) with e-value of 1.1e-67 and BLAST sequence identity of 53.3
  misc_feature: SWISSPROT Homolog: TRN2_HYONI Tropinone reductase 2 (EC 1.1.1.236) (Tropinone reductase-II) (TR-II) with e-value of 1.0e-66 and BLAST sequence identity of 52.9
  misc_feature 65465:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(260): Functional Homolog of  Ceres CLONE ID no. 14555 at SEQ ID NO. 637 with e-value of 1.49E-87 and BLAST sequence identity of 67.9
MEKRWSLQGMTALVTGGTKGIGYAVVDELAALGAIVHTCARNQDQLNERIREWNEKGFKVTGSVCDVSSDAEREKLMEEVSSRFDGKLNILVNNAGTNIYKATLDYTAEDFTSLMNTNLQSAFHLSQLAHPLLKASGAGKIVFMSSIGSVVSVNPQYPLYSASKGAMNQLTRNLACEWAKDNIRVNGVAPWFVRTPLTAHSLDDESIAKEVFSRTPMRRVGEPGEVSSVVAFLCLPAPGFLTGQIICVDGGMSVNGFSMG

SEQ ID NO: 613 - DNA, 795 bp, Populus balsamifera subsp. trichocarpa
  misc_feature (1)..(795): Ceres ANNOT ID no. 1517500
  misc_feature 65598:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
atgtctcatccacaaatcactaacagatggtctctccagggaaccactgctcttgtcactggtggaaccaaagggatcggatatgctgttgtggaagaattggcagccctaggagcatgtgttcatacatgtgcgaggacccaaggccagattgatgcatgcttacgtcaatggaaggagaggggtcttaaagttagcggatcagtctgtgatgtatcctctcaagctgaccgagagaagctgataaaggaggtttcctccctgtttggtgggaaactcaacattcttatcaacaatgctggaaccaatgtatacaaaccaactttagaatacacggctgaggatttctcatttttgatgaatacaaatctccaatctgctttccatctgtcccaacttgcacatccacttttgaaagcttcaggagctggaaggattgtctttgtgtcctctatttgcggcgtgacatctgtcaacattggatatcctatatactcagcctctaaaggagcaattaaccaactcacaaggaacctggcatgcgaatgggccaaagacaatattagggttaattccgtcgctccttggttcatcaacaccccaatgaatgaagatgtaatattctctaccctgtcatatgagcttgcttatcggacccccatgggacgtgctggagaaccaggagaagtctcttctgttgtcgcatttctttgcctgccggggccatcgtttacaactggacaggtcatttgtattgatggagggttgtcagtgaacggcttttccatgggttga

SEQ ID NO: 614 - protein, 264 aa, Populus balsamifera subsp. trichocarpa
  misc_feature (1)..(264): Ceres ANNOT ID no. 1517500
  misc_feature (15)..(184): Pfam Name: adh_short Pfam Description: short chain dehydrogenase
  misc_feature: SWISSPROT Homolog: TRNH1_ARATH Putative tropinone reductase homolog At1g07440 (EC 1.1.1.-) with e-value of 8.9e-91 and BLAST sequence identity of 66.3
  misc_feature: SWISSPROT Homolog: TRNH_DATST Tropinone reductase homolog (EC 1.1.1.-) (P29X) with e-value of 1.6e-77 and BLAST sequence identity of 58.5
  misc_feature: SWISSPROT Homolog: TRN1_DATST Tropinone reductase 1 (EC 1.1.1.206) (Tropinone reductase-I) TR-I (Tropine dehydrogenase) with e-value of 4.5e-71 and BLAST sequence identity of 56.0
  misc_feature: SWISSPROT Homolog: TRN2_DATST Tropinone reductase 2 (EC 1.1.1.236) (Tropinone reductase-II) (TR-II) with e-value of 1.1e-67 and BLAST sequence identity of 53.3
  misc_feature: SWISSPROT Homolog: TRN2_HYONI Tropinone reductase 2 (EC 1.1.1.236) (Tropinone reductase-II) (TR-II) with e-value of 1.0e-66 and BLAST sequence identity of 52.9
  misc_feature 65746:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(264): Functional Homolog of  Ceres CLONE ID no. 14555 at SEQ ID NO. 637 with e-value of 1.89E-87 and BLAST sequence identity of 65.7
MSHPQITNRWSLQGTTALVTGGTKGIGYAVVEELAALGACVHTCARTQGQIDACLRQWKERGLKVSGSVCDVSSQADREKLIKEVSSLFGGKLNILINNAGTNVYKPTLEYTAEDFSFLMNTNLQSAFHLSQLAHPLLKASGAGRIVFVSSICGVTSVNIGYPIYSASKGAINQLTRNLACEWAKDNIRVNSVAPWFINTPMNEDVIFSTLSYELAYRTPMGRAGEPGEVSSVVAFLCLPGPSFTTGQVICIDGGLSVNGFSMG

SEQ ID NO: 615 - DNA, 798 bp, Populus balsamifera subsp. trichocarpa
  misc_feature (1)..(798): Ceres ANNOT ID no. 1458151
  misc_feature 65879:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
atggcagagagcagcagattcaaagactcgagatggtctctccatggaatgactgctcttgtcactggtggcactcgtggaatcgggaatgcaacagtggaggaacttgcagggtttggagcgagggtgcatacgtgttcaagaaacgaggaagagctcaataagtgcttgaaagaatgggaggctaaaggttttgtggttactggttcagtttgtgatgcatcttctcgtgtccagagagagaagcttatcgaggaagttggttctgtttttcatggcaaactcaacattctggtaggtaaccctgttaaaaccaggaagccaaccactggttattctgctgaggaattttcaaacctcttagcaaccaactttgaatctgcataccatttgtctcaaattgcacatcctcttctaaaagaatctggagctggaagcgttgtgtttatttcctctgttgcaggtcttttgcatataggtagcggatcaatttatggagcaagtaaaggtgcaataaatcaacttacaaaaaatctggcttgtgagtgggcaaaagacaatatcaggaccaactgtgttgcaccctggtatatcagaacctcgcttgtggaacatttgctcgatgacaaggtgtttctagacaaaataatctctcgaacccctctccagcgcgttggagatccaaaggaagtctcatccctggtgggattcctttgcctacctgctgctgcttacatcaccggacaagttatttctgttgatgggggatttactgtgaatggatttaacccggtatag

SEQ ID NO: 616 - protein, 265 aa, Populus balsamifera subsp. trichocarpa
  misc_feature (1)..(265): Ceres ANNOT ID no. 1458151
  misc_feature (17)..(184): Pfam Name: adh_short Pfam Description: short chain dehydrogenase
  misc_feature: SWISSPROT Homolog: TRNH1_ARATH Putative tropinone reductase homolog At1g07440 (EC 1.1.1.-) with e-value of 8.9e-91 and BLAST sequence identity of 66.3
  misc_feature: SWISSPROT Homolog: TRNH_DATST Tropinone reductase homolog (EC 1.1.1.-) (P29X) with e-value of 1.6e-77 and BLAST sequence identity of 58.5
  misc_feature: SWISSPROT Homolog: TRN1_DATST Tropinone reductase 1 (EC 1.1.1.206) (Tropinone reductase-I) TR-I (Tropine dehydrogenase) with e-value of 4.5e-71 and BLAST sequence identity of 56.0
  misc_feature: SWISSPROT Homolog: TRN2_DATST Tropinone reductase 2 (EC 1.1.1.236) (Tropinone reductase-II) (TR-II) with e-value of 1.1e-67 and BLAST sequence identity of 53.3
  misc_feature: SWISSPROT Homolog: TRN2_HYONI Tropinone reductase 2 (EC 1.1.1.236) (Tropinone reductase-II) (TR-II) with e-value of 1.0e-66 and BLAST sequence identity of 52.9
  misc_feature 66027:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(265): Functional Homolog of  Ceres CLONE ID no. 14555 at SEQ ID NO. 637 with e-value of 6.59E-85 and BLAST sequence identity of 65.3
MAESSRFKDSRWSLHGMTALVTGGTRGIGNATVEELAGFGARVHTCSRNEEELNKCLKEWEAKGFVVTGSVCDASSRVQREKLIEEVGSVFHGKLNILVGNPVKTRKPTTGYSAEEFSNLLATNFESAYHLSQIAHPLLKESGAGSVVFISSVAGLLHIGSGSIYGASKGAINQLTKNLACEWAKDNIRTNCVAPWYIRTSLVEHLLDDKVFLDKIISRTPLQRVGDPKEVSSLVGFLCLPAAAYITGQVISVDGGFTVNGFNPV

SEQ ID NO: 617 - DNA, 867 bp, Populus balsamifera subsp. trichocarpa
  misc_feature (1)..(867): Ceres ANNOT ID no. 1522757
  misc_feature 66160:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
atgccttcatgtgaatcgaagtcactagaaattatctgcaaaattctcatcttgcatatcaatgcaggtattattgagcttgaaggagagaaagagaagatgtctctagagagcagtagcagggataagagatggggtctccaaggaatgacagcccttgtcaccggtggaaccaaagggctcggttatgctatcgtggaagagttagcagcgctaggggcaattgttcatacatgtgcgaggaaccaagaccagatcaatgaacgcgttagggaatggaaggagaagggtttcaaagttactggttcagtctgtgatgtatcctctaatgctgaaagagagaagctgatgaaggaggtttcctctctgtttgatgggaagcttaatatccttgtaaacaatgctgggacaaacatatataaagcgaccttagattacacagctgaggatttcacatctctcatgaacacaaaccttcaatctgctttccatttgtcccaacttgcacatccccttttgaaagcttcaggggctggaaagattgtcttcatgacctgtcatgacatgtatactgcaggtgcaatgaaccaacttacaaggaatttggcgtgcgaatgggctaaggacaatataagggttaacggagttgcgccctggttcgtccgaactccactcacagcacatagtctggatgatgagagcattgcgaaggaggttttcagtcgaacccccatgagacgcgttggggaaccaggagaggtctcttctgttgtcgcatttctatgcttgcctgcaccaggtttcttaacaggacaagtcatatgcattgatggagggatgtcagtgaatggcttttccatgggttga

SEQ ID NO: 618 - protein, 255 aa, Populus balsamifera subsp. trichocarpa
  misc_feature (1)..(255): Ceres ANNOT ID no. 1522757
  misc_feature (17)..(174): Pfam Name: adh_short Pfam Description: short chain dehydrogenase
  misc_feature: SWISSPROT Homolog: TRNH1_ARATH Putative tropinone reductase homolog At1g07440 (EC 1.1.1.-) with e-value of 8.9e-91 and BLAST sequence identity of 66.3
  misc_feature: SWISSPROT Homolog: TRNH_DATST Tropinone reductase homolog (EC 1.1.1.-) (P29X) with e-value of 1.6e-77 and BLAST sequence identity of 58.5
  misc_feature: SWISSPROT Homolog: TRN1_DATST Tropinone reductase 1 (EC 1.1.1.206) (Tropinone reductase-I) TR-I (Tropine dehydrogenase) with e-value of 4.5e-71 and BLAST sequence identity of 56.0
  misc_feature: SWISSPROT Homolog: TRN2_DATST Tropinone reductase 2 (EC 1.1.1.236) (Tropinone reductase-II) (TR-II) with e-value of 1.1e-67 and BLAST sequence identity of 53.3
  misc_feature: SWISSPROT Homolog: TRN2_HYONI Tropinone reductase 2 (EC 1.1.1.236) (Tropinone reductase-II) (TR-II) with e-value of 1.0e-66 and BLAST sequence identity of 52.9
  misc_feature 66310:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(255): Functional Homolog of  Ceres CLONE ID no. 14555 at SEQ ID NO. 637 with e-value of 6.10E-82 and BLAST sequence identity of 66.3
MSLESSSRDKRWGLQGMTALVTGGTKGLGYAIVEELAALGAIVHTCARNQDQINERVREWKEKGFKVTGSVCDVSSNAEREKLMKEVSSLFDGKLNILVNNAGTNIYKATLDYTAEDFTSLMNTNLQSAFHLSQLAHPLLKASGAGKIVFMTCHDMYTAGAMNQLTRNLACEWAKDNIRVNGVAPWFVRTPLTAHSLDDESIAKEVFSRTPMRRVGEPGEVSSVVAFLCLPAPGFLTGQVICIDGGMSVNGFSMG

SEQ ID NO: 619 - protein, 102 aa, Arabidopsis thaliana
  misc_feature (1)..(102): Ceres CLONE ID no. 14583
  misc_feature (34)..(93): Pfam Name: ZF-HD_dimer Pfam Description: ZF-HD protein dimerisation region
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
MMKKRQMVIKQRSRNSNTSSSWTTTSSSSSSSEISNVRYVECQKNHAANIGGYAVDGCREFMAAGVEGTVDALRCAACGCHRNFHRKEVDTEVVCEYSPPNA

SEQ ID NO: 620 - DNA, 291 bp, Populus balsamifera subsp. trichocarpa
  misc_feature (1)..(291): Ceres ANNOT ID no. 1530256
  misc_feature 66545:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
atgaggaagcgacaagtggtggtaagaagatcagaagaaccttcaagaagctcaacgacttcttctttcactatcaggaatgttaaatacggagagtgccaaaagaatcatgctgctggagttggaggttacgctgttgatgggtgcagagagttcatggcaagtggtgaagaaggcacagctgctgcactcacttgtgcggcttgtggttgccataggaacttccacagaagggaagtggaaacagaggtggcatgtgattgttcttcaccttcttcaaatggtaattag

SEQ ID NO: 621 - protein, 96 aa, Populus balsamifera subsp. trichocarpa
  misc_feature (1)..(96): Ceres ANNOT ID no. 1530256
  misc_feature (25)..(84): Pfam Name: ZF-HD_dimer Pfam Description: ZF-HD protein dimerisation region
  misc_feature: SWISSPROT Homolog: Y5541_ARATH ZF-HD homeobox protein At5g65410 with e-value of 7.7e-21 and BLAST sequence identity of 52.9
  misc_feature: SWISSPROT Homolog: Y4466_ARATH ZF-HD homeobox protein At4g24660 (AtHB-22) with e-value of 1.6e-20 and BLAST sequence identity of 70.2
  misc_feature 66657:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
  misc_feature (1)..(96): Functional Homolog of  Ceres CLONE ID no. 14583 at SEQ ID NO. 648 with e-value of 2.79E-29 and BLAST sequence identity of 68.8
MRKRQVVVRRSEEPSRSSTTSSFTIRNVKYGECQKNHAAGVGGYAVDGCREFMASGEEGTAAALTCAACGCHRNFHRREVETEVACDCSSPSSNGN

SEQ ID NO: 622 - DNA, 456 bp, Populus balsamifera subsp. trichocarpa
  misc_feature (1)..(456): Ceres ANNOT ID no. 1476783
  misc_feature 66767:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
atggaaggactttacatatcaggttcggcaaggttgctaaacactggcatgtcagtcttccaattggagaattctagcctagcttatcaaggatttgaaggcgaaggaagcggagaagaattggggactagccagatgaggaagcgacaagtggtggtaagaagatcagaagaaccttcaagaagctcaacgacttcttctttcactatcaggaatgttaaatacggagagtgccaaaagaatcatgctgctggagttggaggttacgctgttgatgggtgcagagagttcatggcaagtggtgaagaaggcacagctgctgcactcacttgtgcggcttgtggttgccataggaacttccacagaagggaagtggaaacagaggtggcatgtgattgttcttcaccttcttcaaatgtattagtagcttttagggttgatggacaccatcagtag

SEQ ID NO: 623 - protein, 106 aa, Populus balsamifera subsp. trichocarpa
  misc_feature (1)..(106): Ceres ANNOT ID no. 1476783
  misc_feature (25)..(84): Pfam Name: ZF-HD_dimer Pfam Description: ZF-HD protein dimerisation region
  misc_feature: SWISSPROT Homolog: Y5541_ARATH ZF-HD homeobox protein At5g65410 with e-value of 7.7e-21 and BLAST sequence identity of 52.9
  misc_feature: SWISSPROT Homolog: Y4466_ARATH ZF-HD homeobox protein At4g24660 (AtHB-22) with e-value of 1.6e-20 and BLAST sequence identity of 70.2
  misc_feature 66885:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
  misc_feature (1)..(106): Functional Homolog of  Ceres CLONE ID no. 14583 at SEQ ID NO. 648 with e-value of 2.79E-29 and BLAST sequence identity of 68.8
MRKRQVVVRRSEEPSRSSTTSSFTIRNVKYGECQKNHAAGVGGYAVDGCREFMASGEEGTAAALTCAACGCHRNFHRREVETEVACDCSSPSSNVLVAFRVDGHHQ

SEQ ID NO: 624 - DNA, 288 bp, Populus balsamifera subsp. trichocarpa
  misc_feature (1)..(288): Ceres ANNOT ID no. 1503166
  misc_feature 66995:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
atgaggaagcgacaagtggcggtaagaagaacggaagaaccttcaagaagctcaacgacttctttcactatcaggaatgttaaatatggagagtgtctaaagaatcatgctgctagtgttggagggtatgctgttgacgggtgcagagagttcatggctagtggcgaggaaggcacagctgatgcactcacttgtgccgcttgtggttgccatagaaacttccacagaagggaagtggagacagaggtgatatgtgattgttcttcaccttcttcaaatggtaattag

SEQ ID NO: 625 - protein, 95 aa, Populus balsamifera subsp. trichocarpa
  misc_feature (1)..(95): Ceres ANNOT ID no. 1503166
  misc_feature (24)..(83): Pfam Name: ZF-HD_dimer Pfam Description: ZF-HD protein dimerisation region
  misc_feature: SWISSPROT Homolog: Y5541_ARATH ZF-HD homeobox protein At5g65410 with e-value of 7.7e-21 and BLAST sequence identity of 52.9
  misc_feature: SWISSPROT Homolog: Y4466_ARATH ZF-HD homeobox protein At4g24660 (AtHB-22) with e-value of 1.6e-20 and BLAST sequence identity of 70.2
  misc_feature 67107:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Glossy Useful for making plants with enhanced abiotic stress tolerance
  misc_feature: Phenotype: FLOWER - Other Useful for making ornamental plants with modified flowers
  misc_feature (1)..(95): Functional Homolog of  Ceres CLONE ID no. 14583 at SEQ ID NO. 648 with e-value of 1.60E-28 and BLAST sequence identity of 65.2
MRKRQVAVRRTEEPSRSSTTSFTIRNVKYGECLKNHAASVGGYAVDGCREFMASGEEGTADALTCAACGCHRNFHRREVETEVICDCSSPSSNGN

SEQ ID NO: 626 - protein, 137 aa, Arabidopsis thaliana
  misc_feature (1)..(137): Ceres CLONE ID no. 14909
  misc_feature (18)..(129): Pfam Name: MMR_HSR1 Pfam Description: GTPase of unknown function
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNCDERR

SEQ ID NO: 627 - DNA, 546 bp, Populus balsamifera subsp. trichocarpa
  misc_feature (1)..(546): Ceres ANNOT ID no. 1497838
  misc_feature 67297:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atggggctgtctttcaccaagttgtttagccgactgtttgctaagaaggaaatgcgtattctgatggtgggtcttgatgctgctggtaagaccaccattctctacaagctcaagctcggtgagattgtcaccaccattcctaccattggatttaatgtggagactgtggagtacaaaaacattagctttactgtttgggatgtcgggggtcaggacaagatccgccccttgtggagacattacttccagaacacacaaggacttatctttgtggttgatagcaatgacagagatcgtgtggttgaagctagggatgagctacacaggatgttgaatgaggatgagttgagggatgctgtgctgctagtgtttgcaaacaaacaggatcttccgaatgcaatgaatgccgctgagattacggataagcttggccttcactcccttcgtcagcgccactggtacatccagagcacatgcgccacctctggtgaggggctgtatgagggattggactggctctcaaacaacattgcaaacaaggtatag

SEQ ID NO: 628 - protein, 181 aa, Populus balsamifera subsp. trichocarpa
  misc_feature (1)..(181): Ceres ANNOT ID no. 1497838
  misc_feature (4)..(177): Pfam Name: Arf Pfam Description: ADP-ribosylation factor family
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 67412:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(181): Functional Homolog of  Ceres CLONE ID no. 14909 at SEQ ID NO. 655 with e-value of 7.80E-66 and BLAST sequence identity of 98.4
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKV

SEQ ID NO: 629 - DNA, 672 bp, Populus balsamifera subsp. trichocarpa
  misc_feature (1)..(672): Ceres ANNOT ID no. 1522523
  misc_feature 67509:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atggggctctcattcaccaaactttttagccgtctgtttgccaagaaagaaatgcgaattctcatggtgggtcttgacgctgctggtaagaccaccatcttgtacaagctcaagctcggagagattgtcaccaccattccaacaattgggtttaacgtggagactgtggaatacaagaacataagcttcactgtctgggatgtaggtggtcaggacaagatccgaccattgtggaggcattatttccaaaacactcaagggctcatctttgtggttgatagcaatgatcgtgaccgtgtggttgaagctagggatgagctgcaccggatgttgaatgaggatgaattgagggatgctgtgctacttgtgtttgcaaacaagcaagatcttccaaatgctatgaatgctgctgaaattacagataagcttggtcttcattcactccgtcaacgccactggtatatccagagcacctgtgccacttctggtgaaggtctctatgagggactggactggctctccaacaacattgctagcaaggtaagttttatgctagtggagtttttgaagaactgtgcttctttcaatgaccagccattgtttcattgcattctctcaagtaatgtagttctacgggccggtcaaatttttgagtgtacagaaggaagctga

SEQ ID NO: 630 - protein, 223 aa, Populus balsamifera subsp. trichocarpa
  misc_feature (1)..(223): Ceres ANNOT ID no. 1522523
  misc_feature (19)..(179): Pfam Name: Ras Pfam Description: Ras family
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 67628:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(223): Functional Homolog of  Ceres CLONE ID no. 14909 at SEQ ID NO. 655 with e-value of 7.80E-66 and BLAST sequence identity of 98.4
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKVSFMLVEFLKNCASFNDQPLFHCILSSNVVLRAGQIFECTEGS

SEQ ID NO: 631 - DNA, 546 bp, Populus balsamifera subsp. trichocarpa
  misc_feature (1)..(546): Ceres ANNOT ID no. 1471525
  misc_feature 67731:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atggggctgtctttcaccaagttgtttagcagactgtttgctaagaaggaaatgcgtattctgatggtgggtcttgatgctgctggtaagacaaccattctctacaagctcaagctcggtgagattgtcaccaccattcctactattggattcaatgtggagactgtggagtataagaacattagctttactgtttgggatgtcgggggtcaggacaagatccgccccttgtggagacattacttccagaacacacaaggacttatctttgtggttgatagcaacgacagggatcgtgtggttgaagctagggatgagctacacaggatgttgaatgaggatgagttgagggatgctgtgcttctagtgtttgcaaacaagcaagatcttccaaatgcaatgaatgctgctgagataactgataagcttggtcttcactctcttcgtcagcgccactggtatatccaaagcacatgtgccacttctggtgaagggctgtatgagggattggactggctctcaaacaacattgcaaacaaggcttag

SEQ ID NO: 632 - protein, 181 aa, Populus balsamifera subsp. trichocarpa
  misc_feature (1)..(181): Ceres ANNOT ID no. 1471525
  misc_feature (4)..(177): Pfam Name: Arf Pfam Description: ADP-ribosylation factor family
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 67846:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(181): Functional Homolog of  Ceres CLONE ID no. 14909 at SEQ ID NO. 655 with e-value of 7.80E-66 and BLAST sequence identity of 98.4
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 633 - DNA, 546 bp, Populus balsamifera subsp. trichocarpa
  misc_feature (1)..(546): Ceres ANNOT ID no. 1511908
  misc_feature 67943:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atggggctctctttcacgaaattacttggccggttgttctcaaagaaggaaatgcggattctgatggtaggtcttgatgctgctggtaaaaccaccattctttacaagctcaagttgggagaaattgtcaccaccatccctaccattggatttaatgtggaaactgtggaatacaagaatattagcttcactgtttgggatgttggtggtcaagataagattcgccctttgtggagacattacttccaaaacacgcaagggcttatctttgtggttgacagtaatgaccgagatcgagttggtgaggctagagacgagctgcacaggatgttgaatgaggatgagctgagggatgctgtgctccttgtgtttgcaaataagcaagatcttccaaatgcaatgaatgctgctgaaatcactgataagcttggtcttcattctctaaggcaacgccactggtatatccagagcacatgtgccacttcaggagaagggctttatgaaggattggactggctttcaaacaacattgctagcaaggcttaa

SEQ ID NO: 634 - protein, 181 aa, Populus balsamifera subsp. trichocarpa
  misc_feature (1)..(181): Ceres ANNOT ID no. 1511908
  misc_feature (18)..(129): Pfam Name: MMR_HSR1 Pfam Description: GTPase of unknown function
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 68058:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(181): Functional Homolog of  Ceres CLONE ID no. 14909 at SEQ ID NO. 655 with e-value of 9.99E-64 and BLAST sequence identity of 95.4
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNIASKA

SEQ ID NO: 635 - DNA, 546 bp, Populus balsamifera subsp. trichocarpa
  misc_feature (1)..(546): Ceres ANNOT ID no. 1464305
  misc_feature 68155:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atggggctgtcattcacgaaattacttggccgattgttctcgaagaaagaaatgcgaattctgatggtaggtcttgatgctgctggtaaaaccaccattctttacaagctcaagttgggagaaattgtcactactatccctaccattggatttaatgtggaaactgtggaatataagaatattagcttcactgtttgggatgttggcggtcaagacaagattcgtcctttgtggagacattacttccaaaacacgcaagggcttatctttgtggttgacagcaatgaccgagatcgagttggtgaggccagagacgagctgcacaggatgttgaatgaggatgagctgagggatgctgtgctccttgtatttgcaaataagcaagatcttccaaatgcaatgaatgctgccgagataactgataaactcggtcttcattctctaagacaacgccactggtatatccagagcacatgtgccacttcaggagaagggctttatgaaggattggactggctttcaaacaacatttctagcaaggcttag

SEQ ID NO: 636 - protein, 181 aa, Populus balsamifera subsp. trichocarpa
  misc_feature (1)..(181): Ceres ANNOT ID no. 1464305
  misc_feature (18)..(129): Pfam Name: MMR_HSR1 Pfam Description: GTPase of unknown function
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 68270:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(181): Functional Homolog of  Ceres CLONE ID no. 14909 at SEQ ID NO. 655 with e-value of 9.99E-64 and BLAST sequence identity of 95.4
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNISSKA

SEQ ID NO: 637 - DNA, 564 bp, Populus balsamifera subsp. trichocarpa
  misc_feature (1)..(564): Ceres ANNOT ID no. 1451416
  misc_feature 68367:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atgggaatggcaatatctagactcgtgaagctactctttgcaaggaaagaaatgaggatcctgatggtgggtctagatgctgcagggaaaacaactatcctctacaagttgaagcttggagagattgttactaccatacctacaatagggttcaacgtggaaactgttgaatacaaaaacgttagtttcactgtctgggatgttggaggacaggataagattcgaccattatggagacactacttccagaacacccagggccttatatttgtggtggatagcaatgacagagaaagggttacagaagccagagatgagcttcatcgaatgctgagcgaggatgaactgcgtgatgcgacactgcttatttttgccaataagcaagaccttccaaatgctatgagtgtctcagaaatcactgataagcttggtttgcactctttgcgccagcgtcgttggtacattcaggctgcttgcgccacctctggccaaggactatacgaaggtcttgactggctgtcaagcaatatctctagcaaggcaagttcatcaaagctccattaa

SEQ ID NO: 638 - protein, 187 aa, Populus balsamifera subsp. trichocarpa
  misc_feature (1)..(187): Ceres ANNOT ID no. 1451416
  misc_feature (19)..(150): Pfam Name: Ras Pfam Description: Ras family
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 68482:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(187): Functional Homolog of  Ceres CLONE ID no. 14909 at SEQ ID NO. 655 with e-value of 1.19E-60 and BLAST sequence identity of 88.6
MGMAISRLVKLLFARKEMRILMVGLDAAGKTTILYKLKLGEIVTTIPTIGFNVETVEYKNVSFTVWDVGGQDKIRPLWRHYFQNTQGLIFVVDSNDRERVTEARDELHRMLSEDELRDATLLIFANKQDLPNAMSVSEITDKLGLHSLRQRRWYIQAACATSGQGLYEGLDWLSSNISSKASSSKLH

SEQ ID NO: 639 - DNA, 588 bp, Populus balsamifera subsp. trichocarpa
  misc_feature (1)..(588): Ceres ANNOT ID no. 1461050
  misc_feature 68579:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
atgggcgcaaccatatcccgacttgcaagaagattccttccgaagactgaaattaggattctcatggtggggcttgatgcatctgggaaaacaaccattctgtacaaactaaagctgggagaaattgttcttacagtacctacaattggttttaatgtggagacggtggtgtacaaaaatataagtttcaccgtatgggatgtaggaggacaacaaaagattcggcctctatggagatactactttcagaattcccacggactcatctttgttgtggacagcaatgatagggggagaatttcagaagctcgcaatgagctacatcgcattttatctgatatcgaactaaaggatgccatcctgcttgtctttgccaacaagcaggatgttccgaatgctatgtctgtttctgaggttgctgataagcttggactacctactcttaaacagcgtcgctggcaacatgcgtgccaacaattgctcagcttgacaggtggtaatttggattactttctgcagtgtagtatcgctgtaaagagccactgtgaagcagtattcccacagaatgtacttagctcggtgccctaa

SEQ ID NO: 640 - protein, 195 aa, Populus balsamifera subsp. trichocarpa
  misc_feature (1)..(195): Ceres ANNOT ID no. 1461050
  misc_feature (19)..(150): Pfam Name: Ras Pfam Description: Ras family
  misc_feature: SWISSPROT Homolog: ARF1_ARATH ADP-ribosylation factor 1 with e-value of 4.3e-66 and BLAST sequence identity of 99.2
  misc_feature: SWISSPROT Homolog: ARF2_ARATH ADP-ribosylation factor 2 (AtARF2) with e-value of 1.9e-65 and BLAST sequence identity of 98.5
  misc_feature: SWISSPROT Homolog: ARF1_DAUCA ADP-ribosylation factor 1 with e-value of 3.1e-65 and BLAST sequence identity of 98.5
  misc_feature: SWISSPROT Homolog: ARF_VIGUN ADP-ribosylation factor with e-value of 3.1e-65 and BLAST sequence identity of 98.5
  misc_feature: SWISSPROT Homolog: ARF_MAIZE ADP-ribosylation factor with e-value of 6.4e-65 and BLAST sequence identity of 97.7
  misc_feature 68694:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature (1)..(195): Functional Homolog of  Ceres CLONE ID no. 14909 at SEQ ID NO. 655 with e-value of 3.29E-51 and BLAST sequence identity of 75.7
MGATISRLARRFLPKTEIRILMVGLDASGKTTILYKLKLGEIVLTVPTIGFNVETVVYKNISFTVWDVGGQQKIRPLWRYYFQNSHGLIFVVDSNDRGRISEARNELHRILSDIELKDAILLVFANKQDVPNAMSVSEVADKLGLPTLKQRRWQHACQQLLSLTGGNLDYFLQCSIAVKSHCEAVFPQNVLSSVP

SEQ ID NO: 641 - protein, 172 aa, Arabidopsis thaliana
  misc_feature (1)..(172): Ceres CLONE ID no. 15343
  misc_feature (34)..(115): Pfam Name: Cu_bind_like Pfam Description: Plastocyanin-like domain
  misc_feature: Phenotype: FLOWER - Reduced fertility Useful for sterility, genetic confinement systems
  misc_feature: Phenotype: FLOWER - Sterile Useful for sterility, genetic confinement systems
MKMQAVLVILVFSGLLSVKTALAAQHVIGGSQGWEQSVDFDSWSSDQSFKVGDQIVFKYSGLHSVVELGSETAYKSCDLGTSVNSLSSGNDVVKLSKTGTRYFVCGTVGHCEQGMKIKVNVVDSKSGSSPSGSGSGSDSGSGSKSSSGDGLRASIGYMFVVGSLVIGLIWAY

SEQ ID NO: 642 - DNA, 507 bp, Populus balsamifera subsp. trichocarpa
  misc_feature (1)..(507): Ceres ANNOT ID no. 1440753
  misc_feature 68862:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
atggagtacagagtttgtctggtgttggtttttgttgctttgatcaccaaagaagcaatggcagctcaacatgttgttggggggagccaaggttgggaagaatctacagacttcagctcatgggcttcaggtcaaaaattcaaggttggagatcaactagttttcaagtacacatcagggctgcacagcgtggttgaacttggtggcgagagtgcctacaagagttgtggccttggtactgcgttaaactcaatgaatactggcaatgatgttgtgaaactgaacaaacctggaacacgttacttcgcctgtggtactttaggccactgtggccaaggcatgaaagtgaagattacggtagaatccgggactgctccgtctaccccagaatcaccgtcttcatcttcatctcccgcagcttcctctgcatccgccatgcacagttattttgctacatttgttcttctcacagcgttggtggctaccagtttgttatatatgttttga

SEQ ID NO: 643 - protein, 168 aa, Populus balsamifera subsp. trichocarpa
  misc_feature (1)..(168): Ceres ANNOT ID no. 1440753
  misc_feature (32)..(114): Pfam Name: Cu_bind_like Pfam Description: Plastocyanin-like domain
  misc_feature: SWISSPROT Homolog: BCP_PEA Blue copper protein precursor with e-value of 4.0e-24 and BLAST sequence identity of 39.2
  misc_feature: SWISSPROT Homolog: ENL1_ARATH Early nodulin-like protein 1 precursor (Phytocyanin-like protein) with e-value of 7.9e-19 and BLAST sequence identity of 34.9
  misc_feature: SWISSPROT Homolog: MAVI_CUCPE Mavicyanin with e-value of 1.5e-17 and BLAST sequence identity of 38.2
  misc_feature: SWISSPROT Homolog: BCB2_ARATH Uclacyanin-2 precursor (Uclacyanin-II) Blue copper-binding protein II (BCB II) (Phytocyanin 2) with e-value of 3.1e-17 and BLAST sequence identity of 31.1
  misc_feature: SWISSPROT Homolog: NO552_SOYBN Early nodulin 55-2 precursor (N-55-2) (Nodulin-315) with e-value of 2.2e-16 and BLAST sequence identity of 35.1
  misc_feature 68956:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature (1)..(168): Functional Homolog of  Ceres CLONE ID no. 15343 at SEQ ID NO. 670 with e-value of 1.69E-45 and BLAST sequence identity of 66.6
MEYRVCLVLVFVALITKEAMAAQHVVGGSQGWEESTDFSSWASGQKFKVGDQLVFKYTSGLHSVVELGGESAYKSCGLGTALNSMNTGNDVVKLNKPGTRYFACGTLGHCGQGMKVKITVESGTAPSTPESPSSSSSPAASSASAMHSYFATFVLLTALVATSLLYMF

SEQ ID NO: 644 - protein, 496 aa, Arabidopsis thaliana
  misc_feature (1)..(496): Ceres CLONE ID no. 15650
  misc_feature (12)..(406): Pfam Name: PTR2 Pfam Description: POT family
  misc_feature: Utility: MSX Useful for making plants tolerant to low nitrogen
  misc_feature: Phenotype: WHOLE PLANT - MSX Useful for making plants tolerant to low nitrogen
MTDYNYIDNMQGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFTIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSME

SEQ ID NO: 645 - DNA, 1914 bp, Populus balsamifera subsp. trichocarpa
  misc_feature (1)..(1914): Ceres ANNOT ID no. 1513435
  misc_feature: Utility: MSX Useful for making plants tolerant to low nitrogen
  misc_feature 69165:<222: Transcription Factor
  misc_feature: Phenotype: WHOLE PLANT - MSX Useful for making plants tolerant to low nitrogen
atggctgaagatgaaaagaagggcacaagctcatacaggctatattgctccataaaatgcttccaaaaaccatcatcaccggagcagaagcacggcaaccttgcagaaactgagcagaagaagcccggaggatggagagccatgccttttatcttaggaaatgagacttttgagaggctggctacttttggcttgttagccaacttcatggtgtatttgatgagagtctttcacttggagcaggtgactgctgcaaacgtcataaacatctggtctggtgtaactaatttcgcaccgttggttggtgcattcatctctgatgcctatgtgggcaggtttaagaccattgcttttgcatcctgtgcagctttcctgggaatggtgactgtgacttcgacggcatgggtgccttatcttcaccctcaaaaatgcgagcctgaaggaaagcagcagtcttatgggaactgtgaaagtcccaccagcatgcaattgggtgttctgttgcttggcttagggttcctatctatcggaacaggtgggattaggccatgcagcattccgtttggtgttgatcagtttgaccctacaactgaagaagggataaaagggattagcagctactacaattggtattatacaaccttcacggtggtgatgttgatcactttaaccgcagtggtatatgttcaagactctgttagctgggttttgggttttggaatacctactgtgcttatgctctgctccatcatactcttcttcattggaacaaggatttatgtgcatgtaaagccagaaggaagtgttttctctggcattgcacaggtttttgtttctgcttataaaaagcgtaggcttaagcttcctgacaattgtgatggagagcaggttgatgggatcttttatgatcctccaattaaagatcaattaacaatattgtcaaagctccctcttaccaatcagatcaggtttttgaacaaggctgcaatgatagagaaagaaactgacctcaagccagatggttcgtgtgctaagcaatggagattgtgcagtgtccaacaggttgaagaggtgaaatgcctgataaaaataggtccaatatgggcttctagtattgttagcttgacttcaatggtacaacaaggaacatttactgtgtctcaagccttgaaaatggacagacaccttggagaaaaattccaaatcccagctagttccatcatcgtcgtgtcgttgataacaataggaatatggctcccattctatgacagagtcctagtgccagccattcgaaaagtaacaaaacatgaaggtggaatcacaattctccaaagaattggaattgggaatgtattctctgttctatcaatggtagtagctggattggtggagagggagagaagagctgcagcaatttcacacccagaggctgcacccatgtcagtcttttggctagctccacaacttgtggtaatggggttatgcgaggcattcgttggcactggacaaattgaattttacaacaagcagtttcctgatcacatgagaagcctcggtaactctcttttcttctgctcatttgctggtgcaagttaccttagtaccatgttgggcagcattgttcataaggttactggaacgagacaccatccagactggctgacaaatgatctaaatgctgggaatttggattacttctacttccttttggcaggaatgggggttgtcaattggttttattttctgctttgtgctcatcgatatcgttacaagataatggtagatgctcatcatgatttgcgcgccaactcggttgtaaattgtggagtattttgcgtcagatggagagataagcccacttggcgaaaagcgtggagcctcacaatacgtcaccagcgttgtggcaatgattag

SEQ ID NO: 646 - protein, 568 aa, Populus balsamifera subsp. trichocarpa
  misc_feature (1)..(568): Ceres ANNOT ID no. 1513435
  misc_feature (2)..(162): Pfam Name: MFS_1 Pfam Description: Major Facilitator Superfamily
  misc_feature: SWISSPROT Homolog: PTR2_ARATH Peptide transporter PTR2 (Histidine-transporting protein) with e-value of 2.7e-82 and BLAST sequence identity of 38.0
  misc_feature: SWISSPROT Homolog: CHL1_ARATH Nitrate/chlorate transporter with e-value of 1.5e-65 and BLAST sequence identity of 34.6
  misc_feature: SWISSPROT Homolog: OPT1_DROME Oligopeptide transporter 1 (Protein YIN) with e-value of 3.6e-24 and BLAST sequence identity of 29.8
  misc_feature: SWISSPROT Homolog: S15A2_RABIT Oligopeptide transporter, kidney isoform (Peptide transporter 2) with e-value of 5.1e-19 and BLAST sequence identity of 31.1
  misc_feature: SWISSPROT Homolog: S15A2_RABIT Kidney H(+)/peptide cotransporter Solute carrier family 15 member 2
  misc_feature: SWISSPROT Homolog: S15A2_HUMAN Oligopeptide transporter, kidney isoform (Peptide transporter 2) with e-value of 8.8e-19 and BLAST sequence identity of 29.2
  misc_feature: SWISSPROT Homolog: S15A2_HUMAN Kidney H(+)/peptide cotransporter Solute carrier family 15 member 2
  misc_feature: Utility: MSX Useful for making plants tolerant to low nitrogen
  misc_feature 69319:<222: Transcription Factor
  misc_feature: Phenotype: WHOLE PLANT - MSX Useful for making plants tolerant to low nitrogen
  misc_feature (1)..(568): Functional Homolog of  Ceres CLONE ID no. 15650 at SEQ ID NO. 673 with e-value of 6.79E-154 and BLAST sequence identity of 62.8
MVYLMRVFHLEQVTAANVINIWSGVTNFAPLVGAFISDAYVGRFKTIAFASCAAFLGMVTVTSTAWVPYLHPQKCEPEGKQQSYGNCESPTSMQLGVLLLGLGFLSIGTGGIRPCSIPFGVDQFDPTTEEGIKGISSYYNWYYTTFTVVMLITLTAVVYVQDSVSWVLGFGIPTVLMLCSIILFFIGTRIYVHVKPEGSVFSGIAQVFVSAYKKRRLKLPDNCDGEQVDGIFYDPPIKDQLTILSKLPLTNQIRFLNKAAMIEKETDLKPDGSCAKQWRLCSVQQVEEVKCLIKIGPIWASSIVSLTSMVQQGTFTVSQALKMDRHLGEKFQIPASSIIVVSLITIGIWLPFYDRVLVPAIRKVTKHEGGITILQRIGIGNVFSVLSMVVAGLVERERRAAAISHPEAAPMSVFWLAPQLVVMGLCEAFVGTGQIEFYNKQFPDHMRSLGNSLFFCSFAGASYLSTMLGSIVHKVTGTRHHPDWLTNDLNAGNLDYFYFLLAGMGVVNWFYFLLCAHRYRYKIMVDAHHDLRANSVVNCGVFCVRWRDKPTWRKAWSLTIRHQRCGND

SEQ ID NO: 647 - protein, 142 aa, Arabidopsis thaliana
  misc_feature (1)..(142): Ceres CLONE ID no. 16461
  misc_feature (22)..(142): Pfam Name: Response_reg Pfam Description: Response regulator receiver domain
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
MATKSTGGTEKTKSIEVKKKLINVLIVDDDPLNRRLHEMIIKTIGGISQTAKNGEEAVILHRDGEASFDLILMDKEMPERDGVSTTKKLREMKVTSMIVGVTSVADQEEERKAFMEAGLNHCLEKPLTKAKIFPLISHLFDA

SEQ ID NO: 648 - DNA, 417 bp, Populus balsamifera subsp. trichocarpa
  misc_feature (1)..(417): Ceres ANNOT ID no. 1479013
  misc_feature 69543:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atgaggaacaaagtaatggttggtggagaagagaacaataatgaaggcaaaaacagcttcactgtgcttgttgttgatgatgataccgtcgttcgaatggtccataggatgctcgtgacaagtcttgggctaaaagttcaagaagccaaaaatggaaaagaagccgttgatcttcatatcaatggagcttcctttgatcttattttaatggatatggaaatgcccatcatgaatggtcccacggcaacaagggagcttcgagcaatgggtgtaaagagcaccattattggtgttacatcttgtacttttgagtctgtgcacaaagatttcatggaagcaggcctaaaccactgtgttgcgaagccattgactatagcccagattgcctccttccttctgaaatccaacaacaactaa

SEQ ID NO: 649 - protein, 133 aa, Populus balsamifera subsp. trichocarpa
  misc_feature (1)..(133): Ceres ANNOT ID no. 1479013
  misc_feature (15)..(123): Pfam Name: Response_reg Pfam Description: Response regulator receiver domain
  misc_feature: SWISSPROT Homolog: ARR22_ARATH Two-component response regulator ARR22 with e-value of 3.2e-70 and BLAST sequence identity of 100.0
  misc_feature: SWISSPROT Homolog: RCSC_SALTI Sensor protein rcsC (EC 2.7.13.3) (Capsular synthesis regulator component C) with e-value of 2.9e-13 and BLAST sequence identity of 36.8
  misc_feature: SWISSPROT Homolog: RCSC_SALTY Sensor protein rcsC (EC 2.7.13.3) (Capsular synthesis regulator component C) with e-value of 2.9e-13 and BLAST sequence identity of 36.8
  misc_feature: SWISSPROT Homolog: RCSC_ECOLI Sensor kinase protein rcsC (EC 2.7.13.3) (Capsular synthesis regulator component C) with e-value of 6.0e-13 and BLAST sequence identity of 35.8
  misc_feature: SWISSPROT Homolog: DCTR_BACHD Probable C4-dicarboxylate response regulator dctR with e-value of 1.8e-12 and BLAST sequence identity of 35.4
  misc_feature 69654:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(133): Functional Homolog of  Ceres CLONE ID no. 16461 at SEQ ID NO. 676 with e-value of 3.00E-25 and BLAST sequence identity of 54.5
MVGGEENNNEGKNSFTVLVVDDDTVVRMVHRMLVTSLGLKVQEAKNGKEAVDLHINGASFDLILMDMEMPIMNGPTATRELRAMGVKSTIIGVTSCTFESVHKDFMEAGLNHCVAKPLTIAQIASFLLKSNNN

SEQ ID NO: 650 - protein, 148 aa, Arabidopsis thaliana
  misc_feature (1)..(148): Ceres CLONE ID no. 16865
  misc_feature (5)..(142): Pfam Name: UQ_con Pfam Description: Ubiquitin-conjugating enzyme
  misc_feature: Phenotype: FLOWER - Reduced fertility Useful for sterility, genetic confinement systems
  misc_feature: Phenotype: ROSETTE LEAVES - Other Useful for making ornamental plants with modified leaves
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 651 - DNA, 672 bp, Populus balsamifera subsp. trichocarpa
  misc_feature (1)..(672): Ceres ANNOT ID no. 1454311
  misc_feature 69807:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atgggagaatccgaaaacagaagcagaccctcctcctccacctccgcctccgccctatctctgggtgtaagaagaaaaagaaataaaaagaagaggccagggagtgggaaatcagcggttgtgttggatccaccgttaattcatttccagatcgtcgattcgtcgatttcccccttccacaaccccatcttttcatcttcagggtgcataggaggagtaataataatggcttcaaagcgtattttgaaggaactcaaggatttacagaaggatccgcctacttcttgcagtgcaggccctgtagctgaagatatgtttcactggcaagcaacaataatgggacctgctgatagtccatatgcaggaggggtatttctagttactatccattttcctcctgattatcctttcaagccccctaaggttgcatttaggaccaaggtctttcatcccaacattaatagtaatggaagcatttgtcttgatattctcaaagagcaatggagtcctgctcttaccatctctaaggtactgctctccatttgctcattgctgactgatccaaatcctgatgatcctcttgtaccggagattgcccatatgtacaagactgaccgatccaaatatgaagccactgctcgcagctggacacagaagtatgccatgggctga

SEQ ID NO: 652 - protein, 148 aa, Populus balsamifera subsp. trichocarpa
  misc_feature (1)..(148): Ceres ANNOT ID no. 1454311
  misc_feature (5)..(142): Pfam Name: UQ_con Pfam Description: Ubiquitin-conjugating enzyme
  misc_feature: SWISSPROT Homolog: UBC8_ARATH Ubiquitin-conjugating enzyme E2-17 kDa 8 with e-value of 2.5e-79 and BLAST sequence identity of 99.3
  misc_feature: SWISSPROT Homolog: UBC8_ARATH EC 6.3.2.19 Ubiquitin-protein ligase 8 Ubiquitin carrier protein 8 (UBCAT4A)
  misc_feature: SWISSPROT Homolog: UBC10_ARATH Ubiquitin-conjugating enzyme E2-17 kDa 10/12 (EC 6.3.2.19) (Ubiquitin-protein ligase 10/12) (Ubiquitin carrier protein 10/12) with e-value of 6.7e-77 and BLAST sequence identity of 95.3
  misc_feature: SWISSPROT Homolog: UBC4_LYCES Ubiquitin-conjugating enzyme E2-17 kDa (EC 6.3.2.19) (Ubiquitin-protein ligase) (Ubiquitin carrier protein) with e-value of 6.7e-77 and BLAST sequence identity of 95.3
  misc_feature: SWISSPROT Homolog: UBC9_ARATH Ubiquitin-conjugating enzyme E2-17 kDa 9 with e-value of 8.6e-77 and BLAST sequence identity of 95.3
  misc_feature: SWISSPROT Homolog: UBC9_ARATH EC 6.3.2.19 Ubiquitin-protein ligase 9 Ubiquitin carrier protein 9 (UBCAT4B)
  misc_feature: SWISSPROT Homolog: UBC11_ARATH Ubiquitin-conjugating enzyme E2-17 kDa 11 (EC 6.3.2.19) (Ubiquitin-protein ligase 11) (Ubiquitin carrier protein 11) with e-value of 3.3e-75 and BLAST sequence identity of 91.9
  misc_feature 69925:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(148): Functional Homolog of  Ceres CLONE ID no. 16865 at SEQ ID NO. 679 with e-value of 6.49E-78 and BLAST sequence identity of 96.6
MASKRILKELKDLQKDPPTSCSAGPVAEDMFHWQATIMGPADSPYAGGVFLVTIHFPPDYPFKPPKVAFRTKVFHPNINSNGSICLDILKEQWSPALTISKVLLSICSLLTDPNPDDPLVPEIAHMYKTDRSKYEATARSWTQKYAMG

SEQ ID NO: 653 - DNA, 498 bp, Populus balsamifera subsp. trichocarpa
  misc_feature (1)..(498): Ceres ANNOT ID no. 1483290
  misc_feature 69995:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atgagaaggaggatcaatccggttcttgcaagtgaagaagaagaagaagagatggcatcgaaacggatcttgaaggaattgaaagatttgcaaaaggaccctcctacttcatgcagcgccggtcctgttgctgaagacatgttccattggcaagcaacaattatgggtcctccagatagcccttatgctggtggtgttttcctagttactattcattttcctccagactatccatttaagcctcccaaggtagcattcagaacaaaggtattccacccaaatataaatagcaatggaagcatttgcctggacattttgaaggagcaatggagccctgctctaaccatatccaaggtgttgctctcaatctgttctctgttgacggatcctaaccccgatgatccactggtgccggagatagctcacatgtacaagaccgacaggaacaagtatgagacaactgcaagaagctggacccagaagtatgcaatgggctaa

SEQ ID NO: 654 - protein, 148 aa, Populus balsamifera subsp. trichocarpa
  misc_feature (1)..(148): Ceres ANNOT ID no. 1483290
  misc_feature (5)..(142): Pfam Name: UQ_con Pfam Description: Ubiquitin-conjugating enzyme
  misc_feature: SWISSPROT Homolog: UBC8_ARATH Ubiquitin-conjugating enzyme E2-17 kDa 8 with e-value of 2.5e-79 and BLAST sequence identity of 99.3
  misc_feature: SWISSPROT Homolog: UBC8_ARATH EC 6.3.2.19 Ubiquitin-protein ligase 8 Ubiquitin carrier protein 8 (UBCAT4A)
  misc_feature: SWISSPROT Homolog: UBC10_ARATH Ubiquitin-conjugating enzyme E2-17 kDa 10/12 (EC 6.3.2.19) (Ubiquitin-protein ligase 10/12) (Ubiquitin carrier protein 10/12) with e-value of 6.7e-77 and BLAST sequence identity of 95.3
  misc_feature: SWISSPROT Homolog: UBC4_LYCES Ubiquitin-conjugating enzyme E2-17 kDa (EC 6.3.2.19) (Ubiquitin-protein ligase) (Ubiquitin carrier protein) with e-value of 6.7e-77 and BLAST sequence identity of 95.3
  misc_feature: SWISSPROT Homolog: UBC9_ARATH Ubiquitin-conjugating enzyme E2-17 kDa 9 with e-value of 8.6e-77 and BLAST sequence identity of 95.3
  misc_feature: SWISSPROT Homolog: UBC9_ARATH EC 6.3.2.19 Ubiquitin-protein ligase 9 Ubiquitin carrier protein 9 (UBCAT4B)
  misc_feature: SWISSPROT Homolog: UBC11_ARATH Ubiquitin-conjugating enzyme E2-17 kDa 11 (EC 6.3.2.19) (Ubiquitin-protein ligase 11) (Ubiquitin carrier protein 11) with e-value of 3.3e-75 and BLAST sequence identity of 91.9
  misc_feature 70107:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(148): Functional Homolog of  Ceres CLONE ID no. 16865 at SEQ ID NO. 679 with e-value of 1.19E-76 and BLAST sequence identity of 95.2
MASKRILKELKDLQKDPPTSCSAGPVAEDMFHWQATIMGPPDSPYAGGVFLVTIHFPPDYPFKPPKVAFRTKVFHPNINSNGSICLDILKEQWSPALTISKVLLSICSLLTDPNPDDPLVPEIAHMYKTDRNKYETTARSWTQKYAMG

SEQ ID NO: 655 - DNA, 447 bp, Populus balsamifera subsp. trichocarpa
  misc_feature (1)..(447): Ceres ANNOT ID no. 1533930
  misc_feature 70177:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atggcttccaagaggattaacaaggagttgaaagacctgcagaaggaccctcctgcttcatgcagtgctggtcctgttgctgatgatatgttccactggcaagcaacaattatgggcccagctgacagcccatttactggtggtgtattccttgtgtccattcactttcctccagattacccattcaagccacccaaggtctccttccgtacaaaggttttccaccctaacatcaacagcaatggaagcatttgtcttgacattctcaaagagcagtggagccctgcccttacaatatccaaggttcttctgtctatctgctcactgctgactgatccaaacccggatgatcccctggtgcctgaaattgctcacatgtacaagacagacagagccaggtatgaaactactgcacggtcctggacccagaaatatgccatgggctag

SEQ ID NO: 656 - protein, 148 aa, Populus balsamifera subsp. trichocarpa
  misc_feature (1)..(148): Ceres ANNOT ID no. 1533930
  misc_feature (5)..(142): Pfam Name: UQ_con Pfam Description: Ubiquitin-conjugating enzyme
  misc_feature: SWISSPROT Homolog: UBC8_ARATH Ubiquitin-conjugating enzyme E2-17 kDa 8 with e-value of 2.5e-79 and BLAST sequence identity of 99.3
  misc_feature: SWISSPROT Homolog: UBC8_ARATH EC 6.3.2.19 Ubiquitin-protein ligase 8 Ubiquitin carrier protein 8 (UBCAT4A)
  misc_feature: SWISSPROT Homolog: UBC10_ARATH Ubiquitin-conjugating enzyme E2-17 kDa 10/12 (EC 6.3.2.19) (Ubiquitin-protein ligase 10/12) (Ubiquitin carrier protein 10/12) with e-value of 6.7e-77 and BLAST sequence identity of 95.3
  misc_feature: SWISSPROT Homolog: UBC4_LYCES Ubiquitin-conjugating enzyme E2-17 kDa (EC 6.3.2.19) (Ubiquitin-protein ligase) (Ubiquitin carrier protein) with e-value of 6.7e-77 and BLAST sequence identity of 95.3
  misc_feature: SWISSPROT Homolog: UBC9_ARATH Ubiquitin-conjugating enzyme E2-17 kDa 9 with e-value of 8.6e-77 and BLAST sequence identity of 95.3
  misc_feature: SWISSPROT Homolog: UBC9_ARATH EC 6.3.2.19 Ubiquitin-protein ligase 9 Ubiquitin carrier protein 9 (UBCAT4B)
  misc_feature: SWISSPROT Homolog: UBC11_ARATH Ubiquitin-conjugating enzyme E2-17 kDa 11 (EC 6.3.2.19) (Ubiquitin-protein ligase 11) (Ubiquitin carrier protein 11) with e-value of 3.3e-75 and BLAST sequence identity of 91.9
  misc_feature 70287:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(148): Functional Homolog of  Ceres CLONE ID no. 16865 at SEQ ID NO. 679 with e-value of 9.79E-75 and BLAST sequence identity of 91.8
MASKRINKELKDLQKDPPASCSAGPVADDMFHWQATIMGPADSPFTGGVFLVSIHFPPDYPFKPPKVSFRTKVFHPNINSNGSICLDILKEQWSPALTISKVLLSICSLLTDPNPDDPLVPEIAHMYKTDRARYETTARSWTQKYAMG

SEQ ID NO: 657 - DNA, 447 bp, Populus balsamifera subsp. trichocarpa
  misc_feature (1)..(447): Ceres ANNOT ID no. 1450556
  misc_feature 70357:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atggcatcgaaaagaatattgaaggagctcaaggacttgcagagagatcccccaacttcatgcagtgcaggtcctgtggctgaggatatgttccattggcaagccaccatcataggtccaaatgacagtccctatgccggtggtgttttccttgttaccattcatttcccaccggattatccttttaaacctcccaaggttgccttcaggaccaaggtattccatccaaacataaacagtaacgggaacatctgcttggacatactcaaggaacaatggagccctgcgctcaccatatcaaaggttttactctccatatgctcactgcttacagatccaaaccctgatgatcctcttgttcctgaaatagcccatatgtgcaaggccgacaagatcaagtatgagtcttctgctaggagctggactcaaaagtatgccatgggatag

SEQ ID NO: 658 - protein, 148 aa, Populus balsamifera subsp. trichocarpa
  misc_feature (1)..(148): Ceres ANNOT ID no. 1450556
  misc_feature (5)..(142): Pfam Name: UQ_con Pfam Description: Ubiquitin-conjugating enzyme
  misc_feature: SWISSPROT Homolog: UBC8_ARATH Ubiquitin-conjugating enzyme E2-17 kDa 8 with e-value of 2.5e-79 and BLAST sequence identity of 99.3
  misc_feature: SWISSPROT Homolog: UBC8_ARATH EC 6.3.2.19 Ubiquitin-protein ligase 8 Ubiquitin carrier protein 8 (UBCAT4A)
  misc_feature: SWISSPROT Homolog: UBC10_ARATH Ubiquitin-conjugating enzyme E2-17 kDa 10/12 (EC 6.3.2.19) (Ubiquitin-protein ligase 10/12) (Ubiquitin carrier protein 10/12) with e-value of 6.7e-77 and BLAST sequence identity of 95.3
  misc_feature: SWISSPROT Homolog: UBC4_LYCES Ubiquitin-conjugating enzyme E2-17 kDa (EC 6.3.2.19) (Ubiquitin-protein ligase) (Ubiquitin carrier protein) with e-value of 6.7e-77 and BLAST sequence identity of 95.3
  misc_feature: SWISSPROT Homolog: UBC9_ARATH Ubiquitin-conjugating enzyme E2-17 kDa 9 with e-value of 8.6e-77 and BLAST sequence identity of 95.3
  misc_feature: SWISSPROT Homolog: UBC9_ARATH EC 6.3.2.19 Ubiquitin-protein ligase 9 Ubiquitin carrier protein 9 (UBCAT4B)
  misc_feature: SWISSPROT Homolog: UBC11_ARATH Ubiquitin-conjugating enzyme E2-17 kDa 11 (EC 6.3.2.19) (Ubiquitin-protein ligase 11) (Ubiquitin carrier protein 11) with e-value of 3.3e-75 and BLAST sequence identity of 91.9
  misc_feature 70467:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(148): Functional Homolog of  Ceres CLONE ID no. 16865 at SEQ ID NO. 679 with e-value of 1.80E-73 and BLAST sequence identity of 90.5
MASKRILKELKDLQRDPPTSCSAGPVAEDMFHWQATIIGPNDSPYAGGVFLVTIHFPPDYPFKPPKVAFRTKVFHPNINSNGNICLDILKEQWSPALTISKVLLSICSLLTDPNPDDPLVPEIAHMCKADKIKYESSARSWTQKYAMG

SEQ ID NO: 659 - DNA, 447 bp, Populus balsamifera subsp. trichocarpa
  misc_feature (1)..(447): Ceres ANNOT ID no. 1533218
  misc_feature 70537:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atggcttcaaaacggattaacaaggaattgagggacttgcagaaggatcctcctactgcttgcagtgcaggccctgctggtagtgacatgttccattggcaagcaacaattatgggtccagcagacagcccatacgctgggggtgtgttctctgttaacatacacttccctcctgattacccattcaagccacccaaggtttcctttaagacaaaagtttatcatccaaacattaacagcaatggcagtatctgtcttgacattctcaaggagcaatggagcccagccttgacaatttcaaaggtgttgttgtcgatatgctcgctgttgacagatccaaatcccaatgatcccctggtgcctgagattgctcatatctacacgactgatagagtcaagtatgatgctactgctcgagcctggactcagaaatatgctatgagctag

SEQ ID NO: 660 - protein, 148 aa, Populus balsamifera subsp. trichocarpa
  misc_feature (1)..(148): Ceres ANNOT ID no. 1533218
  misc_feature (5)..(142): Pfam Name: UQ_con Pfam Description: Ubiquitin-conjugating enzyme
  misc_feature: SWISSPROT Homolog: UBC8_ARATH Ubiquitin-conjugating enzyme E2-17 kDa 8 with e-value of 2.5e-79 and BLAST sequence identity of 99.3
  misc_feature: SWISSPROT Homolog: UBC8_ARATH EC 6.3.2.19 Ubiquitin-protein ligase 8 Ubiquitin carrier protein 8 (UBCAT4A)
  misc_feature: SWISSPROT Homolog: UBC10_ARATH Ubiquitin-conjugating enzyme E2-17 kDa 10/12 (EC 6.3.2.19) (Ubiquitin-protein ligase 10/12) (Ubiquitin carrier protein 10/12) with e-value of 6.7e-77 and BLAST sequence identity of 95.3
  misc_feature: SWISSPROT Homolog: UBC4_LYCES Ubiquitin-conjugating enzyme E2-17 kDa (EC 6.3.2.19) (Ubiquitin-protein ligase) (Ubiquitin carrier protein) with e-value of 6.7e-77 and BLAST sequence identity of 95.3
  misc_feature: SWISSPROT Homolog: UBC9_ARATH Ubiquitin-conjugating enzyme E2-17 kDa 9 with e-value of 8.6e-77 and BLAST sequence identity of 95.3
  misc_feature: SWISSPROT Homolog: UBC9_ARATH EC 6.3.2.19 Ubiquitin-protein ligase 9 Ubiquitin carrier protein 9 (UBCAT4B)
  misc_feature: SWISSPROT Homolog: UBC11_ARATH Ubiquitin-conjugating enzyme E2-17 kDa 11 (EC 6.3.2.19) (Ubiquitin-protein ligase 11) (Ubiquitin carrier protein 11) with e-value of 3.3e-75 and BLAST sequence identity of 91.9
  misc_feature 70647:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(148): Functional Homolog of  Ceres CLONE ID no. 16865 at SEQ ID NO. 679 with e-value of 3.49E-70 and BLAST sequence identity of 87.0
MASKRINKELRDLQKDPPTACSAGPAGSDMFHWQATIMGPADSPYAGGVFSVNIHFPPDYPFKPPKVSFKTKVYHPNINSNGSICLDILKEQWSPALTISKVLLSICSLLTDPNPNDPLVPEIAHIYTTDRVKYDATARAWTQKYAMS

SEQ ID NO: 661 - DNA, 456 bp, Populus balsamifera subsp. trichocarpa
  misc_feature (1)..(456): Ceres ANNOT ID no. 1512378
  misc_feature 70717:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atgtcgaggatcagggagaacaggatgaggaaggagttgagtgaaattgcaagggacaattcatctgaatatttcagtgcaggtattgccaccggaaacacgtacgattgggaggccacggttcatgggccaccgctcaccccatatgctggcggtgtgtttcggttgggtgtcagttttccgcaagaatatccatttaagccaccgaagctaaccttcttaaccaagatttaccacccaaacatcaacgacaagggtagcatctgtgtagacatattgaaaaacaactggactgcagccaacacaatgactgctgtattcaacagcatattgcttctactggcatccccgaacccagatgatcctttggtgcctggtattggtaagcagtacatcaatgatagactcgagttcgagcaggtagctagcatgtggactgtcaaatatgcagcttaa

SEQ ID NO: 662 - protein, 151 aa, Populus balsamifera subsp. trichocarpa
  misc_feature (1)..(151): Ceres ANNOT ID no. 1512378
  misc_feature (8)..(146): Pfam Name: UQ_con Pfam Description: Ubiquitin-conjugating enzyme
  misc_feature: SWISSPROT Homolog: UBC8_ARATH Ubiquitin-conjugating enzyme E2-17 kDa 8 with e-value of 2.5e-79 and BLAST sequence identity of 99.3
  misc_feature: SWISSPROT Homolog: UBC8_ARATH EC 6.3.2.19 Ubiquitin-protein ligase 8 Ubiquitin carrier protein 8 (UBCAT4A)
  misc_feature: SWISSPROT Homolog: UBC10_ARATH Ubiquitin-conjugating enzyme E2-17 kDa 10/12 (EC 6.3.2.19) (Ubiquitin-protein ligase 10/12) (Ubiquitin carrier protein 10/12) with e-value of 6.7e-77 and BLAST sequence identity of 95.3
  misc_feature: SWISSPROT Homolog: UBC4_LYCES Ubiquitin-conjugating enzyme E2-17 kDa (EC 6.3.2.19) (Ubiquitin-protein ligase) (Ubiquitin carrier protein) with e-value of 6.7e-77 and BLAST sequence identity of 95.3
  misc_feature: SWISSPROT Homolog: UBC9_ARATH Ubiquitin-conjugating enzyme E2-17 kDa 9 with e-value of 8.6e-77 and BLAST sequence identity of 95.3
  misc_feature: SWISSPROT Homolog: UBC9_ARATH EC 6.3.2.19 Ubiquitin-protein ligase 9 Ubiquitin carrier protein 9 (UBCAT4B)
  misc_feature: SWISSPROT Homolog: UBC11_ARATH Ubiquitin-conjugating enzyme E2-17 kDa 11 (EC 6.3.2.19) (Ubiquitin-protein ligase 11) (Ubiquitin carrier protein 11) with e-value of 3.3e-75 and BLAST sequence identity of 91.9
  misc_feature 70827:<222: Transcription Factor
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(151): Functional Homolog of  Ceres CLONE ID no. 16865 at SEQ ID NO. 679 with e-value of 5.99E-36 and BLAST sequence identity of 50.0
MSRIRENRMRKELSEIARDNSSEYFSAGIATGNTYDWEATVHGPPLTPYAGGVFRLGVSFPQEYPFKPPKLTFLTKIYHPNINDKGSICVDILKNNWTAANTMTAVFNSILLLLASPNPDDPLVPGIGKQYINDRLEFEQVASMWTVKYAA

SEQ ID NO: 663 - protein, 217 aa, Arabidopsis thaliana
  misc_feature (1)..(217): Ceres CLONE ID no. 17081
  misc_feature (14)..(175): Pfam Name: Ras Pfam Description: Ras family
  misc_feature: Utility: Cold Germination Useful for making plants with increased tolerance to cold stress
  misc_feature: Phenotype: WHOLE PLANT - Cold Germination Useful for making plants with increased tolerance to cold stress
MARRPDEEYDYLFKVVLIGDSGVGKSNLLSRFTRNEFCLESKSTIGVEFATRTLQVEGRTVKAQIWDTAGQERYRAITSAYYRGALGALLVYDVTKPTTFENVSRWLKELRDHADSNIVIMLIGNKTDLKHLRAVATEDAQSYAEKEGLSFIETSALEALNVEKAFQTILSEVYRIISKKSISSDQTTANANIKEGQTIDVAATSESNAKKPCCSSS

SEQ ID NO: 664 - DNA, 654 bp, Populus balsamifera subsp. trichocarpa
  misc_feature (1)..(654): Ceres ANNOT ID no. 1481199
  misc_feature: Utility: Cold Germination Useful for making plants with increased tolerance to cold stress
  misc_feature 70979:<222: Transcription Factor
  misc_feature: Phenotype: WHOLE PLANT - Cold Germination Useful for making plants with increased tolerance to cold stress
atggcgaggagacccgacgaggagtacgattacctgttcaaggtagtgttaatcggcgattccggtgtcggaaaatcgaacatcctctcccgatttactcgcaacgagttttgtttggagtccaagtccaccatcggcgtcgaattcgccactcgcactcttcaagttgaaggaaggacagtgaaggcgcagatatgggacacggcagggcaagagcgatacagagcgatcacgagtgcctactataggggcgcgcttggagctcttctggtgtatgatgtaacaaagccaacgacttttgaaaacgtgagtcggtggttgaaggagctgagggatcatgcagattccaatattgtgatcatgttaattgggaacaagactgatcttaaacatcttagagcagtagctactgaggatgctcaaagttatgctgagaaagaagggcttgcttttgtagagacatccgctcttgaagccaccaatgttgacaaggcttttcaaacaattctttctgagatatataggattattagtaagaagacactttcttcggaagagtcagcagcacctgtgagtgtcaaagatgggaagaccattgtagttggaggacccgatcccagcactaaaaagaccacctgctgctcttcttcttag

SEQ ID NO: 665 - protein, 217 aa, Populus balsamifera subsp. trichocarpa
  misc_feature (1)..(217): Ceres ANNOT ID no. 1481199
  misc_feature (8)..(173): Pfam Name: Arf Pfam Description: ADP-ribosylation factor family
  misc_feature: SWISSPROT Homolog: RB11C_ARATH Ras-related protein Rab11C with e-value of 2.8e-110 and BLAST sequence identity of 100.0
  misc_feature: SWISSPROT Homolog: RB11C_LOTJA Ras-related protein Rab11C with e-value of 2.2e-85 and BLAST sequence identity of 75.6
  misc_feature: SWISSPROT Homolog: RB2BV_BETVU Ras-related protein Rab2BV with e-value of 3.7e-85 and BLAST sequence identity of 75.9
  misc_feature: SWISSPROT Homolog: RB11A_ARATH Ras-related protein Rab11A with e-value of 5.4e-84 and BLAST sequence identity of 76.1
  misc_feature: SWISSPROT Homolog: RB11A_TOBAC Ras-related protein Rab11A with e-value of 3.4e-82 and BLAST sequence identity of 73.3
  misc_feature: Utility: Cold Germination Useful for making plants with increased tolerance to cold stress
  misc_feature 71073:<222: Transcription Factor
  misc_feature: Phenotype: WHOLE PLANT - Cold Germination Useful for making plants with increased tolerance to cold stress
  misc_feature (1)..(217): Functional Homolog of  Ceres CLONE ID no. 17081 at SEQ ID NO. 692 with e-value of 9.89E-98 and BLAST sequence identity of 87.0
MARRPDEEYDYLFKVVLIGDSGVGKSNILSRFTRNEFCLESKSTIGVEFATRTLQVEGRTVKAQIWDTAGQERYRAITSAYYRGALGALLVYDVTKPTTFENVSRWLKELRDHADSNIVIMLIGNKTDLKHLRAVATEDAQSYAEKEGLAFVETSALEATNVDKAFQTILSEIYRIISKKTLSSEESAAPVSVKDGKTIVVGGPDPSTKKTTCCSSS

SEQ ID NO: 666 - DNA, 648 bp, Populus balsamifera subsp. trichocarpa
  misc_feature (1)..(648): Ceres ANNOT ID no. 1543087
  misc_feature: Utility: Cold Germination Useful for making plants with increased tolerance to cold stress
  misc_feature 71154:<222: Transcription Factor
  misc_feature: Phenotype: WHOLE PLANT - Cold Germination Useful for making plants with increased tolerance to cold stress
atggcgaggagagcagacgaggaatacgactacctgttcaaggtagtattaatcggcgactcaggagtaggaaaatcgaacctcctctcccgatttactcgcaacgagttctgtttggagtccaagtccaccattggcgtcgaattcgctactcgcactcttcaagttgaaggaaggactgtgaaagctcagatatgggacacagctggacaggagcgatacagagcaatcaccagtgcctactataggggtgcccttggagctcttcttgtatatgatgttacaaagccaacaacatttgaaaatgtgagtcggtggctgaaggagctgagggatcatgcggattccaatattgtgatcatgttaattgggaacaagactgatctgaaacatcttcgagcggttgccaccgaggatgctcaaagttatgcagagaaagaagggcttgcatttatagagacatccgctctcgaagcaacaaatgttgagaaggctttccagacaattctttcagagatatataggatagttagtaagaagtcactttcttcagaagagtcagcacctgctagtatcaaagacgggaagacaattgtagttggaggacctgagcccgacactaaaaagacttgctgctcttcatcctga

SEQ ID NO: 667 - protein, 215 aa, Populus balsamifera subsp. trichocarpa
  misc_feature (1)..(215): Ceres ANNOT ID no. 1543087
  misc_feature (1)..(173): Pfam Name: Arf Pfam Description: ADP-ribosylation factor family
  misc_feature: SWISSPROT Homolog: RB11C_ARATH Ras-related protein Rab11C with e-value of 2.8e-110 and BLAST sequence identity of 100.0
  misc_feature: SWISSPROT Homolog: RB11C_LOTJA Ras-related protein Rab11C with e-value of 2.2e-85 and BLAST sequence identity of 75.6
  misc_feature: SWISSPROT Homolog: RB2BV_BETVU Ras-related protein Rab2BV with e-value of 3.7e-85 and BLAST sequence identity of 75.9
  misc_feature: SWISSPROT Homolog: RB11A_ARATH Ras-related protein Rab11A with e-value of 5.4e-84 and BLAST sequence identity of 76.1
  misc_feature: SWISSPROT Homolog: RB11A_TOBAC Ras-related protein Rab11A with e-value of 3.4e-82 and BLAST sequence identity of 73.3
  misc_feature: Utility: Cold Germination Useful for making plants with increased tolerance to cold stress
  misc_feature 71248:<222: Transcription Factor
  misc_feature: Phenotype: WHOLE PLANT - Cold Germination Useful for making plants with increased tolerance to cold stress
  misc_feature (1)..(215): Functional Homolog of  Ceres CLONE ID no. 17081 at SEQ ID NO. 692 with e-value of 2.10E-97 and BLAST sequence identity of 90.2
MARRADEEYDYLFKVVLIGDSGVGKSNLLSRFTRNEFCLESKSTIGVEFATRTLQVEGRTVKAQIWDTAGQERYRAITSAYYRGALGALLVYDVTKPTTFENVSRWLKELRDHADSNIVIMLIGNKTDLKHLRAVATEDAQSYAEKEGLAFIETSALEATNVEKAFQTILSEIYRIVSKKSLSSEESAPASIKDGKTIVVGGPEPDTKKTCCSSS

SEQ ID NO: 668 - DNA, 612 bp, Populus balsamifera subsp. trichocarpa
  misc_feature (1)..(612): Ceres ANNOT ID no. 1489696
  misc_feature: Utility: Cold Germination Useful for making plants with increased tolerance to cold stress
  misc_feature 71329:<222: Transcription Factor
  misc_feature: Phenotype: WHOLE PLANT - Cold Germination Useful for making plants with increased tolerance to cold stress
atgtggctgcttacagtgcatttgctatggattcccatgttccagattaggacatacacgttttcgcaatctacttgtctggtttctgtgtcaacattacatgattttcatcctatgtcattcatgaatgttgaaggaaggactgtgaaagctcagatatgggacacagctggacaggagcgatacagagcaatcaccagtgcctactataggggtgcccttggagctcttcttgtatatgatgttacaaagccaacaacatttgaaaatgtgagtcggtggctgaaggagctgagggatcatgcggattccaatattgtgatcatgttaattgggaacaagactgatctgaaacatcttcgagcggttgccaccgaggatgctcaaagttatgcagagaaagaagggcttgcatttatagagacatccgctctcgaagcaacaaatgttgagaaggctttccagacaattctttcagagatatataggatagttagtaagaagtcactttcttcagaagagtcagcacctgctagtatcaaagacgggaagacaattgtagttggaggacctgagcccgacactaaaaagacttgctgctcttcatcctga

SEQ ID NO: 669 - protein, 203 aa, Populus balsamifera subsp. trichocarpa
  misc_feature (1)..(203): Ceres ANNOT ID no. 1489696
  misc_feature (18)..(163): Pfam Name: Ras Pfam Description: Ras family
  misc_feature: SWISSPROT Homolog: RB11C_ARATH Ras-related protein Rab11C with e-value of 2.8e-110 and BLAST sequence identity of 100.0
  misc_feature: SWISSPROT Homolog: RB11C_LOTJA Ras-related protein Rab11C with e-value of 2.2e-85 and BLAST sequence identity of 75.6
  misc_feature: SWISSPROT Homolog: RB2BV_BETVU Ras-related protein Rab2BV with e-value of 3.7e-85 and BLAST sequence identity of 75.9
  misc_feature: SWISSPROT Homolog: RB11A_ARATH Ras-related protein Rab11A with e-value of 5.4e-84 and BLAST sequence identity of 76.1
  misc_feature: SWISSPROT Homolog: RB11A_TOBAC Ras-related protein Rab11A with e-value of 3.4e-82 and BLAST sequence identity of 73.3
  misc_feature: Utility: Cold Germination Useful for making plants with increased tolerance to cold stress
  misc_feature 71423:<222: Transcription Factor
  misc_feature: Phenotype: WHOLE PLANT - Cold Germination Useful for making plants with increased tolerance to cold stress
  misc_feature (1)..(203): Functional Homolog of  Ceres CLONE ID no. 17081 at SEQ ID NO. 692 with e-value of 5.69E-70 and BLAST sequence identity of 81.4
MWLLTVHLLWIPMFQIRTYTFSQSTCLVSVSTLHDFHPMSFMNVEGRTVKAQIWDTAGQERYRAITSAYYRGALGALLVYDVTKPTTFENVSRWLKELRDHADSNIVIMLIGNKTDLKHLRAVATEDAQSYAEKEGLAFIETSALEATNVEKAFQTILSEIYRIVSKKSLSSEESAPASIKDGKTIVVGGPEPDTKKTCCSSS

SEQ ID NO: 670 - protein, 456 aa, Arabidopsis thaliana
  misc_feature (1)..(456): Ceres CLONE ID no. 17250
  misc_feature (60)..(224): Pfam Name: Phytochel_synth Pfam Description: Phytochelatin synthetase-like conserved region
  misc_feature: Utility: pH (high) Useful for making plants tolerant to high pH or low phosphate
  misc_feature: Phenotype: WHOLE PLANT - pH (high) Useful for making plants tolerant to high pH or low phosphate
MESFFSRSTSIVSKLSFLALWIVFLISSSSFTSTEAYDALDPEGNITIKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 671 - DNA, 1362 bp, Populus balsamifera subsp. trichocarpa
  misc_feature (1)..(1362): Ceres ANNOT ID no. 1450185
  misc_feature: Utility: pH (high) Useful for making plants tolerant to high pH or low phosphate
  misc_feature 71622:<222: Transcription Factor
  misc_feature: Phenotype: WHOLE PLANT - pH (high) Useful for making plants tolerant to high pH or low phosphate
atgggctttcttgtctctcccatgatgagtttgttctcaaaattcactgtcctgctgctttttgtgctttggtgcgctagttttacttcaacagaagcctatgatcctcttgaccctactgggaatattacaatcaaatgggacatcataagctggactgctgatggctatgtcgctgttgtcacgatttacaacttccagcagtatcgtcacattcaagcaccaggatggtcactgggatggacatgggcaaagaaggaggtaatatggagcatgctgggaggccaagcaaccgaccaaggagattgttcaaaattcaaaggaaacgttccacattgttgtaaaaagagtccgacggttgtagatttattgccaggaactccttataaccagcagactgcaaattgctgcaaggggggagttatcagctcatgggcgcaagatccagccaatgcagcaagctccttccagcttagcgtgggttcagctggaaccagtaacaaaacagtgagattaccaaaaaacttcactctgaaggcaccaggacctggttatacttgtgctcgtgcaaaaattgttaagcctactagatttatgtctacagataaaaggagaatcactcaagctttgatgacatggaacgttacttgcacatattcacaattcctggctcagaagactcctagttgctgtgtctccctctcatcattctacaacgacactatagttccttgtccaaaatgcacctgtggctgccaaagaaacaattcggattcggggggttgtgttgatccaaatgcaccacatttagcttcggttgtttcgagtctagggaataacaaccctatgcctcttgtccaatgcacaagtcacatgtgcccgatcagagttcactggcatgttaagcttaactacaagcaatactggcgcgttaaggtcacaattacaaatttcaattataacatgaactatacgcaatggaacttagttgtgcaacaccccaactttgacaatctgacccagagtttcagttttaactaccagtcattatctccttattcagctattaatgatactgccatgttgtggggagtaaagttctacaatgacttgcttatgcaagccggtcgttctggtaatgttcagtcagagctactttttcgaaaggacaagtcaacttttacctttgataaaggctgggccttccctcggagaatctatttcaatggtgacaattgcgttatgcctcctccagatgcgtatccatggttgcctaatgcaagttcacgccagcttacttcaccgcttatgctaatgatagccttcttttctgttttggctttcttatatggatacgcgtag

SEQ ID NO: 672 - protein, 453 aa, Populus balsamifera subsp. trichocarpa
  misc_feature (1)..(453): Ceres ANNOT ID no. 1450185
  misc_feature (57)..(221): Pfam Name: Phytochel_synth Pfam Description: Phytochelatin synthetase-like conserved region
  misc_feature: SWISSPROT Homolog: COBRA_ARATH COBRA protein precursor (Cell expansion protein) with e-value of 2.0e-260 and BLAST sequence identity of 99.8
  misc_feature: SWISSPROT Homolog: COBL1_ARATH COBRA-like protein 1 precursor with e-value of 1.4e-193 and BLAST sequence identity of 71.5
  misc_feature: SWISSPROT Homolog: COBL2_ARATH COBRA-like protein 2 precursor with e-value of 2.3e-186 and BLAST sequence identity of 70.9
  misc_feature: SWISSPROT Homolog: COBL4_ARATH COBRA-like protein 4 precursor with e-value of 1.0e-174 and BLAST sequence identity of 67.4
  misc_feature: SWISSPROT Homolog: COBL6_ARATH COBRA-like protein 6 precursor with e-value of 1.3e-123 and BLAST sequence identity of 51.8
  misc_feature: Utility: pH (high) Useful for making plants tolerant to high pH or low phosphate
  misc_feature 71741:<222: Transcription Factor
  misc_feature: Phenotype: WHOLE PLANT - pH (high) Useful for making plants tolerant to high pH or low phosphate
  misc_feature (1)..(453): Functional Homolog of  Ceres CLONE ID no. 17250 at SEQ ID NO. 699 with e-value of 3.30E-193 and BLAST sequence identity of 74.4
MGFLVSPMMSLFSKFTVLLLFVLWCASFTSTEAYDPLDPTGNITIKWDIISWTADGYVAVVTIYNFQQYRHIQAPGWSLGWTWAKKEVIWSMLGGQATDQGDCSKFKGNVPHCCKKSPTVVDLLPGTPYNQQTANCCKGGVISSWAQDPANAASSFQLSVGSAGTSNKTVRLPKNFTLKAPGPGYTCARAKIVKPTRFMSTDKRRITQALMTWNVTCTYSQFLAQKTPSCCVSLSSFYNDTIVPCPKCTCGCQRNNSDSGGCVDPNAPHLASVVSSLGNNNPMPLVQCTSHMCPIRVHWHVKLNYKQYWRVKVTITNFNYNMNYTQWNLVVQHPNFDNLTQSFSFNYQSLSPYSAINDTAMLWGVKFYNDLLMQAGRSGNVQSELLFRKDKSTFTFDKGWAFPRRIYFNGDNCVMPPPDAYPWLPNASSRQLTSPLMLMIAFFSVLAFLYGYA

SEQ ID NO: 673 - protein, 199 aa, Arabidopsis thaliana
  misc_feature (1)..(199): Ceres CLONE ID no. 17356
  misc_feature (5)..(68): Pfam Name: AP2 Pfam Description: AP2 domain
  misc_feature: Phenotype: WHOLE PLANT - Large Useful for making bigger plants
  misc_feature: Phenotype: INFLORESCENCE - Strong Useful for making stronger plants
  misc_feature: Phenotype: ROSETTE LEAVES - Other Useful for making ornamental plants with modified leaves
MVQTKKFRGVRQRHWGSWVAEIRHPLLKRRIWLGTFETAEEAARAYHEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 674 - DNA, 621 bp, Populus balsamifera subsp. trichocarpa
  misc_feature (1)..(621): Ceres ANNOT ID no. 1478584
  misc_feature 71942:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature: Phenotype: ROSETTE LEAVES - Other Useful for making ornamental plants with modified leaves
atggtgcagtcaaaaaagttcagaggggtgaggcagcgacattggggttcttgggtttctgaaattagacatcctttactgaagaggagggtatggctaggcacatttgaaacagcagaagaggcagcaagagcctatgatcaagctgcaatcttgatgagtggtcgtaatgcgaaaactaactttccaatacctcaaacttcaaacgaggaggacccaaaatcaagtgatgaagcttcactcccaacaccaccaaatggtttgtctgagatcctccatgctaagctaagaaagtgtagcaaggcaccatcaccatcaatgacttgtttgaggcttgacactgagaattcactaattggggtttggcagaagcgtgcaggtgagcgttctgactcaaattgggtcatgagagtgcagcttggacagagagaaagccaagtttctgagagtacattgccattgcctcagtcttcagggggggtatcagagccagaattgagagcagaaatgggtgaagatgagagaattgcactgcaaatgattgaagagcttcttaacaggaattgtcctagcccttcttttggggttcaagatcacggagacggtagcctttttctttag

SEQ ID NO: 675 - protein, 206 aa, Populus balsamifera subsp. trichocarpa
  misc_feature (1)..(206): Ceres ANNOT ID no. 1478584
  misc_feature (5)..(68): Pfam Name: AP2 Pfam Description: AP2 domain
  misc_feature: SWISSPROT Homolog: PZ02_LUPPO Protein PPLZ02 with e-value of 2.3e-21 and BLAST sequence identity of 61.5
  misc_feature: SWISSPROT Homolog: ERF2_ARATH Ethylene-responsive transcription factor 2 EREBP-2 (AtERF2) with e-value of 7.9e-19 and BLAST sequence identity of 51.9
  misc_feature: SWISSPROT Homolog: ERF10_ARATH Ethylene-responsive transcription factor 10 EREBP-10 (AtERF10) with e-value of 2.0e-18 and BLAST sequence identity of 46.1
  misc_feature: SWISSPROT Homolog: ERF11_ARATH Ethylene-responsive transcription factor 11 EREBP-11 (AtERF11) with e-value of 5.6e-18 and BLAST sequence identity of 50.5
  misc_feature: SWISSPROT Homolog: ERF4_ARATH Ethylene-responsive transcription factor 4 Related to APETALA-2 protein 5 (EREBP-4) (AtERF4) with e-value of 1.4e-17 and BLAST sequence identity of 50.0
  misc_feature 72048:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature: Phenotype: ROSETTE LEAVES - Other Useful for making ornamental plants with modified leaves
  misc_feature (1)..(206): Functional Homolog of  Ceres CLONE ID no. 17356 at SEQ ID NO. 702 with e-value of 1.80E-57 and BLAST sequence identity of 66.3
MVQSKKFRGVRQRHWGSWVSEIRHPLLKRRVWLGTFETAEEAARAYDQAAILMSGRNAKTNFPIPQTSNEEDPKSSDEASLPTPPNGLSEILHAKLRKCSKAPSPSMTCLRLDTENSLIGVWQKRAGERSDSNWVMRVQLGQRESQVSESTLPLPQSSGGVSEPELRAEMGEDERIALQMIEELLNRNCPSPSFGVQDHGDGSLFL

SEQ ID NO: 676 - DNA, 543 bp, Populus balsamifera subsp. trichocarpa
  misc_feature (1)..(543): Ceres ANNOT ID no. 1487130
  misc_feature 72134:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature: Phenotype: ROSETTE LEAVES - Other Useful for making ornamental plants with modified leaves
atgaaaattgtcgtttctgttcctccagttttccaagtgcctagagccttaaactttcatgggttcttgattattgcgcacagaaaaagaagggtgtggcttggaacatttgatacggctgaagaggcagcaagagcctacgatgaagcagcgattttgatgagtggccgtaacgccaaaacaaacttccctgtggttgcaaatcaaacaagaaatggtcagaactctccctcctcctcgtcagctcttagtgcaaaactacgcaaatattgcagatctccatatccttccctaacttgtctaaggcttgacgccgagaattgccacattggagtctggcaaaagcgtgccggtccacgttcggtttcaaattggattatgactgtagagcttggaaagaaggatggacggcaagccccggaacaaaagattctcatctcagatacatcagatatggcaggccaagaaggtggtagtgatgatggtccagatgacgaggaaagggttgcattgcagatgatagaggagctacttaacaggtag

SEQ ID NO: 677 - protein, 180 aa, Populus balsamifera subsp. trichocarpa
  misc_feature (1)..(180): Ceres ANNOT ID no. 1487130
  misc_feature (17)..(69): Pfam Name: AP2 Pfam Description: AP2 domain
  misc_feature: SWISSPROT Homolog: PZ02_LUPPO Protein PPLZ02 with e-value of 2.3e-21 and BLAST sequence identity of 61.5
  misc_feature: SWISSPROT Homolog: ERF2_ARATH Ethylene-responsive transcription factor 2 EREBP-2 (AtERF2) with e-value of 7.9e-19 and BLAST sequence identity of 51.9
  misc_feature: SWISSPROT Homolog: ERF10_ARATH Ethylene-responsive transcription factor 10 EREBP-10 (AtERF10) with e-value of 2.0e-18 and BLAST sequence identity of 46.1
  misc_feature: SWISSPROT Homolog: ERF11_ARATH Ethylene-responsive transcription factor 11 EREBP-11 (AtERF11) with e-value of 5.6e-18 and BLAST sequence identity of 50.5
  misc_feature: SWISSPROT Homolog: ERF4_ARATH Ethylene-responsive transcription factor 4 Related to APETALA-2 protein 5 (EREBP-4) (AtERF4) with e-value of 1.4e-17 and BLAST sequence identity of 50.0
  misc_feature 72238:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature: Phenotype: ROSETTE LEAVES - Other Useful for making ornamental plants with modified leaves
  misc_feature (1)..(180): Functional Homolog of  Ceres CLONE ID no. 17356 at SEQ ID NO. 702 with e-value of 4.40E-40 and BLAST sequence identity of 65.1
MKIVVSVPPVFQVPRALNFHGFLIIAHRKRRVWLGTFDTAEEAARAYDEAAILMSGRNAKTNFPVVANQTRNGQNSPSSSSALSAKLRKYCRSPYPSLTCLRLDAENCHIGVWQKRAGPRSVSNWIMTVELGKKDGRQAPEQKILISDTSDMAGQEGGSDDGPDDEERVALQMIEELLNR

SEQ ID NO: 678 - protein, 242 aa, Arabidopsis thaliana
  misc_feature (1)..(242): Ceres CLONE ID no. 17409
  misc_feature (11)..(81): Pfam Name: Ribosomal_L30_N Pfam Description: Ribosomal L30 N-terminal domain
  misc_feature (82)..(134): Pfam Name: Ribosomal_L30 Pfam Description: Ribosomal protein L30p/L7e
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
MAESKVVVPESVLKKIKRQEEWALAKKDEAVAAKKKSVEARKLIFKRAEQYAKEYAEKDNELIRLKREAKLKGGFYVDPEAKLLFIIRIRGINAIDPKTKKILQLLRLRQIFNGVFLKVNKATVNMLRRVEPYVTYGYPNLKSVKELIYKRGYGKLNHQRIALTDNSIVDQALGKHGIICVEDLIHEIMTVGPHFKEANNFLWPFQLKAPLGGLKKKRNHYVEGGDAGNRENFINELVRRMN

SEQ ID NO: 679 - DNA, 732 bp, Populus balsamifera subsp. trichocarpa
  misc_feature (1)..(732): Ceres ANNOT ID no. 1457617
  misc_feature 72431:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
atgggtgaagaggtgatggtagctgttccggagtcggtactgaagaagcggaagagagaggaggagtgggcattggctaagaagcaggagcttgctgctactaagaaaaagaatgctgagaaccgaaagatcattttcaagagagctaagcaatactcaaaagagtatgaggagcagggaaagcaacttgtacaactgaagcgtgaggcgaggttgaagggtggattttatgttgaccctgaggctaagctcttgtttattattcgcatccggggaatcaatgccatgcaccccaagaccaggtcaatcttgcagcttttgcgtttgagacagatcttcaacggtgtcttcctcaaagtaaacaaggcaacagtgaatatgctgcgcagggttgaaccttatgtgacctatggatatcccaacttgaaaagtgtgagagaattgatttacaagagaggctttgggaagttgaaccagcagagaattcccttgactgataactcaatcatcgaccagggtctgggtaagcatggcattatctgcgtggaagatctcattcacgagatcataacagttgggcctcattttaaagaggcaaataacttcctgtggccattccaactcaaggccccgttgggtggtttgaaaaagaagaggaatcactatgtagaaggaggagatgcaggaaaccgtgagaactatattaacgagcttatcaggagaatgaattag

SEQ ID NO: 680 - protein, 243 aa, Populus balsamifera subsp. trichocarpa
  misc_feature (1)..(243): Ceres ANNOT ID no. 1457617
  misc_feature (12)..(82): Pfam Name: Ribosomal_L30_N Pfam Description: Ribosomal L30 N-terminal domain
  misc_feature (83)..(135): Pfam Name: Ribosomal_L30 Pfam Description: Ribosomal protein L30p/L7e
  misc_feature: SWISSPROT Homolog: RL72_ARATH 60S ribosomal protein L7-2 with e-value of 3.6e-126 and BLAST sequence identity of 100.0
  misc_feature: SWISSPROT Homolog: RL71_ARATH 60S ribosomal protein L7-1 with e-value of 1.6e-116 and BLAST sequence identity of 91.3
  misc_feature: SWISSPROT Homolog: RL73_ARATH 60S ribosomal protein L7-3 with e-value of 1.1e-115 and BLAST sequence identity of 90.9
  misc_feature: SWISSPROT Homolog: RL7_NEUCR 60S ribosomal protein L7 with e-value of 2.3e-76 and BLAST sequence identity of 61.6
  misc_feature: SWISSPROT Homolog: RL7_BOVIN 60S ribosomal protein L7 with e-value of 9.9e-76 and BLAST sequence identity of 60.6
  misc_feature 72557:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature (1)..(243): Functional Homolog of  Ceres CLONE ID no. 17409 at SEQ ID NO. 707 with e-value of 2.79E-109 and BLAST sequence identity of 85.0
MGEEVMVAVPESVLKKRKREEEWALAKKQELAATKKKNAENRKIIFKRAKQYSKEYEEQGKQLVQLKREARLKGGFYVDPEAKLLFIIRIRGINAMHPKTRSILQLLRLRQIFNGVFLKVNKATVNMLRRVEPYVTYGYPNLKSVRELIYKRGFGKLNQQRIPLTDNSIIDQGLGKHGIICVEDLIHEIITVGPHFKEANNFLWPFQLKAPLGGLKKKRNHYVEGGDAGNRENYINELIRRMN

SEQ ID NO: 681 - DNA, 735 bp, Populus balsamifera subsp. trichocarpa
  misc_feature (1)..(735): Ceres ANNOT ID no. 1465289
  misc_feature 72666:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
atgggcgaagaggcaactaaggtagcggttccagagtctgtcttgaagaagcagaagagagaggaggagtgggcattggctaagaagcaggagcttgctgctactaagaaaaagaatgctgagaacagaaagctcattttcaaccgagctaagctatatgcaaaggagtaccaggagcaggaaaagcaacttgtacaatggaagcgtgaggcaaggttgaagggtggattttatgttgaccctgaggctaagctcttgtttattattcgcatccggggtatcaatgccatgcaccccaagaccaggagtatcttgcagcttttgcgtttgagacagatcttcaatggtgtcttcctcaaagtaaacaaggcaaccgtgaatatgcttcacagggttgaaccttatgtgacctttgggtatcccaacttgaagagcgtgagggaattgatctacaagagaggctttgggaagttgaaccagcagagaattcctttgactgacaactcgatcattgagcagggtctaggcaagcacggcattatctgcgtggaagatctcattcatgagataatgactgttggaccacattttaaggaggcaaataacttcttgtggccattccagctcaaggctccattgggtggtctgaaaaagaagaggaatcactatgttgaaggaggagatgctggaaaccgtgagaactacattaatgagcttatcaggagaatgaattag

SEQ ID NO: 682 - protein, 244 aa, Populus balsamifera subsp. trichocarpa
  misc_feature (1)..(244): Ceres ANNOT ID no. 1465289
  misc_feature (13)..(83): Pfam Name: Ribosomal_L30_N Pfam Description: Ribosomal L30 N-terminal domain
  misc_feature (84)..(136): Pfam Name: Ribosomal_L30 Pfam Description: Ribosomal protein L30p/L7e
  misc_feature: SWISSPROT Homolog: RL72_ARATH 60S ribosomal protein L7-2 with e-value of 3.6e-126 and BLAST sequence identity of 100.0
  misc_feature: SWISSPROT Homolog: RL71_ARATH 60S ribosomal protein L7-1 with e-value of 1.6e-116 and BLAST sequence identity of 91.3
  misc_feature: SWISSPROT Homolog: RL73_ARATH 60S ribosomal protein L7-3 with e-value of 1.1e-115 and BLAST sequence identity of 90.9
  misc_feature: SWISSPROT Homolog: RL7_NEUCR 60S ribosomal protein L7 with e-value of 2.3e-76 and BLAST sequence identity of 61.6
  misc_feature: SWISSPROT Homolog: RL7_BOVIN 60S ribosomal protein L7 with e-value of 9.9e-76 and BLAST sequence identity of 60.6
  misc_feature 72792:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature (1)..(244): Functional Homolog of  Ceres CLONE ID no. 17409 at SEQ ID NO. 707 with e-value of 1.09E-107 and BLAST sequence identity of 84.1
MGEEATKVAVPESVLKKQKREEEWALAKKQELAATKKKNAENRKLIFNRAKLYAKEYQEQEKQLVQWKREARLKGGFYVDPEAKLLFIIRIRGINAMHPKTRSILQLLRLRQIFNGVFLKVNKATVNMLHRVEPYVTFGYPNLKSVRELIYKRGFGKLNQQRIPLTDNSIIEQGLGKHGIICVEDLIHEIMTVGPHFKEANNFLWPFQLKAPLGGLKKKRNHYVEGGDAGNRENYINELIRRMN

SEQ ID NO: 683 - DNA, 1053 bp, Populus balsamifera subsp. trichocarpa
  misc_feature (1)..(1053): Ceres ANNOT ID no. 1478647
  misc_feature 72901:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
atgaagcccacaactctctcaaaaaaccctaatcctttactctcatatattttacctttgagcagcgaagacaccttcacttctctctctgaagatagcagtcgccaccatcaagccgaacaacaaagagagatgggcggggaagaagttcaggtagcggtaccagagtctgtgttgaagaagcaaaaaaggaacgaggaatgggcattggctaagaaggaagagaagctagctttgaagaagaagaatgctgaaaatcgcaagttgatttacaatagggctaagcagtatgccaaggagtatgatgatgagcaaaaggagcttattaggctgaaacgtgaagccagactcaagggagggttctatgtcaacccagaagctaagctgttgtttatcatcaggatccgtggtttaatggtacatttgtttaatgctatggattccatgactttcagtatcaatgccatgcacccaaagacaagatcaatcttgcagcttctgcgtttgagacaggtgggtgtttgtttaggatgcttaatgatgtcgataatgaggtcttgcaataataatgtcaaaatgtcttcgctggtcacaattgaagtgcaaaaggatttcttcaggctgcagttgtttgccattaacaactttttccatatatttaatggtgtattcctgaaagttaacaaagcaaccgtgaatatgcttcacagggttgagccttatgtgacatttgggtatcctaatttaaagagtgtcaaagaattgatttacaagaggggctttgggaaactaaaccaacagagaattcccttgactgacaattcaatcgttgagcagggcttgggcaagcatggaatcatctgcacagaagatctcatccatgaaattattactgttggaccccatttcaaggaggcaaacaacttcctgtggcctttccagctgaaggcaccacttggaggcttgaagaaaaagagaaatcattatgttgaaggaggtgatgctggaaatcgtgaggattttatcaatgagctaatcaggaggatgaattag

SEQ ID NO: 684 - protein, 306 aa, Populus balsamifera subsp. trichocarpa
  misc_feature (1)..(306): Ceres ANNOT ID no. 1478647
  misc_feature (108)..(131): Pfam Name: Ribosomal_L30 Pfam Description: Ribosomal protein L30p/L7e
  misc_feature (13)..(83): Pfam Name: Ribosomal_L30_N Pfam Description: Ribosomal L30 N-terminal domain
  misc_feature: SWISSPROT Homolog: RL72_ARATH 60S ribosomal protein L7-2 with e-value of 3.6e-126 and BLAST sequence identity of 100.0
  misc_feature: SWISSPROT Homolog: RL71_ARATH 60S ribosomal protein L7-1 with e-value of 1.6e-116 and BLAST sequence identity of 91.3
  misc_feature: SWISSPROT Homolog: RL73_ARATH 60S ribosomal protein L7-3 with e-value of 1.1e-115 and BLAST sequence identity of 90.9
  misc_feature: SWISSPROT Homolog: RL7_NEUCR 60S ribosomal protein L7 with e-value of 2.3e-76 and BLAST sequence identity of 61.6
  misc_feature: SWISSPROT Homolog: RL7_BOVIN 60S ribosomal protein L7 with e-value of 9.9e-76 and BLAST sequence identity of 60.6
  misc_feature 73037:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature (1)..(306): Functional Homolog of  Ceres CLONE ID no. 17409 at SEQ ID NO. 707 with e-value of 5.79E-93 and BLAST sequence identity of 84.5
MGGEEVQVAVPESVLKKQKRNEEWALAKKEEKLALKKKNAENRKLIYNRAKQYAKEYDDEQKELIRLKREARLKGGFYVNPEAKLLFIIRIRGLMVHLFNAMDSMTFSINAMHPKTRSILQLLRLRQVGVCLGCLMMSIMRSCNNNVKMSSLVTIEVQKDFFRLQLFAINNFFHIFNGVFLKVNKATVNMLHRVEPYVTFGYPNLKSVKELIYKRGFGKLNQQRIPLTDNSIVEQGLGKHGIICTEDLIHEIITVGPHFKEANNFLWPFQLKAPLGGLKKKRNHYVEGGDAGNREDFINELIRRMN

SEQ ID NO: 685 - DNA, 831 bp, Populus balsamifera subsp. trichocarpa
  misc_feature (1)..(831): Ceres ANNOT ID no. 1453865
  misc_feature 73158:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
atgggcggggaagaagttaaggtagcggtaccagagtctgtgttgaaaaagcagaaaaggaatgaggaatgggctttggctaagaaggaagagaagctagctataaagaagaaaaatgctgaaaatcgcaagttgatttacagtagggctaagcagtatgcccagcaatatgatgaggagcaaaaggagcttattaggctgaagcgtgaagcaagactcaagggagggttctatgtcaatccagaagctaagctgttgtttatcgtcaggatccgtgggtggtggtgtgttctaacttctccacaattaagatctcagtttaggaagttcaaggacgttgataatgagatattcaacggagtattcctgaaagtaaacaaagcaactgtgaatatgcttcacagggttgagccttatgtgacttttgggtatgttttcataatgattctaaactgtttacttcctgttcctcttaatgtgctaaatttcatgactgatgcaaatggatctaggtatcccaatttaaagagtgttaaagaattgatttacaagaggggctatgggaaactgaaccaacagcgaattcccttgactgataattcaatcgttgaacagggattgggcaagcacggaataatctgcatggaagatctcatacatgaaatcataactgttggaccacatttcaaggaggcaaacaacttcctgtggcctttccagctcaaggcaccactcggaggtttgaagaaaaagagaaaccattatgttgaaggaggtgatgctggaaaccgtgaagattacatcaatgagttgatcaggaggatgaactag

SEQ ID NO: 686 - protein, 276 aa, Populus balsamifera subsp. trichocarpa
  misc_feature (1)..(276): Ceres ANNOT ID no. 1453865
  misc_feature (13)..(83): Pfam Name: Ribosomal_L30_N Pfam Description: Ribosomal L30 N-terminal domain
  misc_feature (84)..(140): Pfam Name: Ribosomal_L30 Pfam Description: Ribosomal protein L30p/L7e
  misc_feature: SWISSPROT Homolog: RL72_ARATH 60S ribosomal protein L7-2 with e-value of 3.6e-126 and BLAST sequence identity of 100.0
  misc_feature: SWISSPROT Homolog: RL71_ARATH 60S ribosomal protein L7-1 with e-value of 1.6e-116 and BLAST sequence identity of 91.3
  misc_feature: SWISSPROT Homolog: RL73_ARATH 60S ribosomal protein L7-3 with e-value of 1.1e-115 and BLAST sequence identity of 90.9
  misc_feature: SWISSPROT Homolog: RL7_NEUCR 60S ribosomal protein L7 with e-value of 2.3e-76 and BLAST sequence identity of 61.6
  misc_feature: SWISSPROT Homolog: RL7_BOVIN 60S ribosomal protein L7 with e-value of 9.9e-76 and BLAST sequence identity of 60.6
  misc_feature 73286:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature (1)..(276): Functional Homolog of  Ceres CLONE ID no. 17409 at SEQ ID NO. 707 with e-value of 4.70E-91 and BLAST sequence identity of 78.3
MGGEEVKVAVPESVLKKQKRNEEWALAKKEEKLAIKKKNAENRKLIYSRAKQYAQQYDEEQKELIRLKREARLKGGFYVNPEAKLLFIVRIRGWWCVLTSPQLRSQFRKFKDVDNEIFNGVFLKVNKATVNMLHRVEPYVTFGYVFIMILNCLLPVPLNVLNFMTDANGSRYPNLKSVKELIYKRGYGKLNQQRIPLTDNSIVEQGLGKHGIICMEDLIHEIITVGPHFKEANNFLWPFQLKAPLGGLKKKRNHYVEGGDAGNREDYINELIRRMN

SEQ ID NO: 687 - protein, 294 aa, Arabidopsis thaliana
  misc_feature (1)..(294): Ceres CLONE ID no. 17434
  misc_feature (235)..(273): Pfam Name: CCT Pfam Description: CCT motif
  misc_feature (5)..(50): Pfam Name: zf-B_box Pfam Description: B-box zinc finger
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Oval Shaped Useful for making plants with increased biomass and foliage
MASSSRLCDSCKSTAATLFCRADAAFLCGNCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYCGFGVVPSF

SEQ ID NO: 688 - DNA, 1047 bp, Populus balsamifera subsp. trichocarpa
  misc_feature (1)..(1047): Ceres ANNOT ID no. 1455741
  misc_feature 73506:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Oval Shaped Useful for making plants with increased biomass and foliage
atggcatcaaagctttgtgactcatgcaaatcagcaacagcaacgttgttttgtcgagctgactcagctttcctctgcgtcagttgcgactccaaaatccacgcggccaacaagcttgcttctcgccacgcgcgtgtctgggtctgtgaagtctgtgaacaagccccagctcatgtcacctgcaaggctgacgctgccgctctatgtgtcacctgtgaccgtgacatccactcggcaaaccctcttgcccaacgccacgaacgtgtccctgtcactcccttctttgactcttcctccgctgcgcacggcggtggagctgccgttaacttcttggagtatcgttaccttgatgacgtgaatggtggggatgatgttagtagggaggaggcagaggcggagtcgtggctgttaccgaaccctggtggggggaatactaaaggggtggacagtttggatctgaatacgggtcaatatgtgtttggggcggaaatgcacccgtatttggatttggatcggtatgtggatcagaaagtggaagtggaagtgcaagagcagaacagttcaggtactactgatggggtggtgcctgtgcaaagtaacaaattagggtttcaagctcctgctttggtgaatgacaattgctgctttgagttggatttctctgctggatctaaaacttttgctggtggctatggctataactccttgagccacagtgtttcttcttcatctcttgatgttggagtcgtaccagatggcagtaccttgacagacatatcgaacccttacagtagatcagtgagcaatggaatggagtcggcaaaccagacagtgcaactatcagcagttgaccgcgaagcaagggtgttaaggtatagagagaagagaaagaatcgaaaattcgagaagacaattagatatgcatcgcgaaaagcctatgccgaaacaaggcctcgaatcaaaggaaggttcgctaaacgtactgattccggagtcgaggttgatcggagtagtatttatggattcggcgttgttccatcattctaa

SEQ ID NO: 689 - protein, 348 aa, Populus balsamifera subsp. trichocarpa
  misc_feature (1)..(348): Ceres ANNOT ID no. 1455741
  misc_feature (291)..(329): Pfam Name: CCT Pfam Description: CCT motif
  misc_feature (3)..(45): Pfam Name: zf-B_box Pfam Description: B-box zinc finger
  misc_feature: SWISSPROT Homolog: COL3_ARATH Zinc finger protein CONSTANS-LIKE 3 with e-value of 1.8e-156 and BLAST sequence identity of 99.3
  misc_feature: SWISSPROT Homolog: COL4_ARATH Zinc finger protein CONSTANS-LIKE 4 with e-value of 1.1e-79 and BLAST sequence identity of 55.0
  misc_feature: SWISSPROT Homolog: COL5_ARATH Zinc finger protein CONSTANS-LIKE 5 with e-value of 2.5e-67 and BLAST sequence identity of 51.6
  misc_feature: SWISSPROT Homolog: COL2_ARATH Zinc finger protein CONSTANS-LIKE 2 with e-value of 9.4e-60 and BLAST sequence identity of 52.3
  misc_feature: SWISSPROT Homolog: COL1_ARATH Zinc finger protein CONSTANS-LIKE 1 with e-value of 3.6e-58 and BLAST sequence identity of 50.4
  misc_feature 73628:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(348): Functional Homolog of  Ceres CLONE ID no. 17434 at SEQ ID NO. 716 with e-value of 6.30E-80 and BLAST sequence identity of 67.0
MASKLCDSCKSATATLFCRADSAFLCVSCDSKIHAANKLASRHARVWVCEVCEQAPAHVTCKADAAALCVTCDRDIHSANPLAQRHERVPVTPFFDSSSAAHGGGAAVNFLEYRYLDDVNGGDDVSREEAEAESWLLPNPGGGNTKGVDSLDLNTGQYVFGAEMHPYLDLDRYVDQKVEVEVQEQNSSGTTDGVVPVQSNKLGFQAPALVNDNCCFELDFSAGSKTFAGGYGYNSLSHSVSSSSLDVGVVPDGSTLTDISNPYSRSVSNGMESANQTVQLSAVDREARVLRYREKRKNRKFEKTIRYASRKAYAETRPRIKGRFAKRTDSGVEVDRSSIYGFGVVPSF

SEQ ID NO: 690 - DNA, 1053 bp, Populus balsamifera subsp. trichocarpa
  misc_feature (1)..(1053): Ceres ANNOT ID no. 1477832
  misc_feature 73741:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Oval Shaped Useful for making plants with increased biomass and foliage
atggcttcaaagctctgtgactcatgcaagtcagcaacagcaacgttgttttgtcgagctgactcagcttttctatgcatcagctgcgactccaaaatccacgcggcaaacaagcttgcctctcgccacgcgcgtgtctcggtctgcgaagtctgtgagcaagccccagcccatttcacctgcaaggcagacgcggctgctctctgtgttacctgtgaccgtgacatccactcagcaaaccctctagctagtcggcacgagcgtgtccctatcactccgtttttcgactcatcctccactgtgcacggcggtggggaagccgtgaacttgttggaggatcggtactttgatgaagtggatggtggtcgtggtgatgttagcagggaggaggcagaggcggagtcgtggctgttgcctaacccgggtggggggactactaagggggtggatagtatggatctgaataccggtcagtatgtgtttggttcggaaatggatccgtatttggatttggatccgtatgtggatccaaaagtggaagtgcaagagcagaacagttcagggactactgatggggtggtgcctgtgcaaagtaacaaactaggatttcaatctcctgctttggtcaatgatcattgctgctatgagttggatttctctactggatccaagtcttttggtggtggctatggctataactccttgagccagagtgtttcttcttcatctcttgatgttggagtggtaccagatggaagtggaagtaccttgacagacatatctaacccatactgtagtagatcagtgtgcaacggaatggagtcagcaaaccagacagtgcaactatcggcagttgaccgtgaagcaagggtgttgaggtacagagagaagaggaagaacagaaaattcgagaagacaattcgatacgcatcaagaaaagcctatgccgaaacaaggccacgaatcaaaggaaggttcgctaaacgtacagatactgaagtcgaggttgatcgaagcagtctttatggattcggtgtcgttccatcgttctaa

SEQ ID NO: 691 - protein, 350 aa, Populus balsamifera subsp. trichocarpa
  misc_feature (1)..(350): Ceres ANNOT ID no. 1477832
  misc_feature (293)..(331): Pfam Name: CCT Pfam Description: CCT motif
  misc_feature (3)..(48): Pfam Name: zf-B_box Pfam Description: B-box zinc finger
  misc_feature: SWISSPROT Homolog: COL3_ARATH Zinc finger protein CONSTANS-LIKE 3 with e-value of 1.8e-156 and BLAST sequence identity of 99.3
  misc_feature: SWISSPROT Homolog: COL4_ARATH Zinc finger protein CONSTANS-LIKE 4 with e-value of 1.1e-79 and BLAST sequence identity of 55.0
  misc_feature: SWISSPROT Homolog: COL5_ARATH Zinc finger protein CONSTANS-LIKE 5 with e-value of 2.5e-67 and BLAST sequence identity of 51.6
  misc_feature: SWISSPROT Homolog: COL2_ARATH Zinc finger protein CONSTANS-LIKE 2 with e-value of 9.4e-60 and BLAST sequence identity of 52.3
  misc_feature: SWISSPROT Homolog: COL1_ARATH Zinc finger protein CONSTANS-LIKE 1 with e-value of 3.6e-58 and BLAST sequence identity of 50.4
  misc_feature 73863:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(350): Functional Homolog of  Ceres CLONE ID no. 17434 at SEQ ID NO. 716 with e-value of 1.10E-77 and BLAST sequence identity of 67.0
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGEAVNLLEDRYFDEVDGGRGDVSREEAEAESWLLPNPGGGTTKGVDSMDLNTGQYVFGSEMDPYLDLDPYVDPKVEVQEQNSSGTTDGVVPVQSNKLGFQSPALVNDHCCYELDFSTGSKSFGGGYGYNSLSQSVSSSSLDVGVVPDGSGSTLTDISNPYCSRSVCNGMESANQTVQLSAVDREARVLRYREKRKNRKFEKTIRYASRKAYAETRPRIKGRFAKRTDTEVEVDRSSLYGFGVVPSF

SEQ ID NO: 692 - protein, 235 aa, Arabidopsis thaliana
  misc_feature (1)..(235): Ceres CLONE ID no. 17482
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
  misc_feature (128)..(128): Xaa is any aa, unknown, or other
MSNVLLSPNGYVFASPKPLGRFINSKSGGRKLFFSVVRASSDDADCNAEECAPEKEVGTVSMEWLAGEKTKVVGTFPPRKPRGWTGYVEKDTAGQTNVYSIEPAVYVAESAISSGTAGSSADGAENTXAIVAGIALIAVAAASSILLQVGKDAPTRPKAVDYSGPSLSYYINKFKPSEIVQPSTPSVTEAPPVAELETSLPETPPVAQQETSLPETMASEAQPEASFVPTTSSTS

SEQ ID NO: 693 - DNA, 714 bp, Populus balsamifera subsp. trichocarpa
  misc_feature (1)..(714): Ceres ANNOT ID no. 1501311
  misc_feature 74062:<222: Transcription Factor
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
atggcttgtgcctcacaggcaatgatatcagcaaacacttgcgcgctcacttcaccaagacttctgaagaaatacacgaatggaaataagagaaactcgaagcttttcactatcaaagcgtcctctgatgacgctgaatgtaatactgaagaatgtgccccggaaaaagaggttgggaaggtgagcatggagtggttggctggggagaaaaccaaagtcgttgggacattccctccgagtaaacgcggttggacagggtatgttgagaaagacactgctggacagacaaatatctattcagttgagcctgcagtttatgtagcagaaagtgcaataagttcgggaactgcaggtacttctgaaggttctgaaggcacagtagcacttgttgctggccttggactcgcttctgtagctgtagcttcatttattctcctcctagttggtaagaacccatctaacataacaacggcggaatacaaaggaccatctctcagttactatatcaacaaatttaagccagcagaaatcatccaagctgcagtgccaagccaaacagagtccccctcatccatacaggcagacagctccatgccagaagtccccgagatacaggttcaatctgcaccagaagtttctgaggtaccggttcaatctcaatatgaacctgagcctttaacttcaagtgtgagcagtgctaatttggcaaattaa

SEQ ID NO: 694 - protein, 237 aa, Populus balsamifera subsp. trichocarpa
  misc_feature (1)..(237): Ceres ANNOT ID no. 1501311
  misc_feature 74125:<222: Transcription Factor
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: WHOLE PLANT - Yellow-Green Viable 1 Useful for making lethal plants for genetic confinement systems
  misc_feature (1)..(237): Functional Homolog of  Ceres CLONE ID no. 17482 at SEQ ID NO. 721 with e-value of 8.69E-67 and BLAST sequence identity of 61.2
MACASQAMISANTCALTSPRLLKKYTNGNKRNSKLFTIKASSDDAECNTEECAPEKEVGKVSMEWLAGEKTKVVGTFPPSKRGWTGYVEKDTAGQTNIYSVEPAVYVAESAISSGTAGTSEGSEGTVALVAGLGLASVAVASFILLLVGKNPSNITTAEYKGPSLSYYINKFKPAEIIQAAVPSQTESPSSIQADSSMPEVPEIQVQSAPEVSEVPVQSQYEPEPLTSSVSSANLAN

SEQ ID NO: 695 - protein, 248 aa, Arabidopsis thaliana
  misc_feature (1)..(248): Ceres CLONE ID no. 17632
  misc_feature (1)..(248): Also Known As Ceres CDNA ID no. 23374596
  misc_feature (1)..(248): Also Known As Ceres GEMINI ID 535H8
  misc_feature (115)..(177): Pfam Name: KH_1 Pfam Description: KH domain
  misc_feature (37)..(63): Pfam Name: zf-CCCH Pfam Description: Zinc finger C-x8-C-x5-C-x3-H type (and similar)
  misc_feature 74243:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 696 - DNA, 897 bp, Populus balsamifera subsp. trichocarpa
  misc_feature (1)..(897): Ceres ANNOT ID no. 1474847
  misc_feature 74344:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
atggatacaagaaagagagggagacctgacttcggcactaatggttatggtggattcaagaaatctaagcaagaaatggactccttatcaactggtgtaggaagcaaatcgaagccatgcaccaagtttttcagaactgatttcttccttttccttggttatgcattggattgcagtactgctggctgtccatttggcgagagctgccactttctccaccatgttcccggtggctacaaggctgtggcccagatggtgaatctgggacctactgttgctttaccgcctgtacctaacagctctgctccgtctgctgttaaaagccggctatgcaaaaaatacaatagtgctgaaggttgcaaatttggtgataaatgccattttgcgcatggcgagtgggaacttggcaaggcttttgttccatcccacaacgatcctcatgctgctggaagtgttccaggacgtctgggtggtcgggtggagccaccccctcctggccccgccaccagcttcggtgtctttgccaccactacaagaatcagtgtagatgcctcccttgctggatccatcattggtaaggctggtgtgcattccaagcagatctgccgccaaacaggaatcaagctatctattaaggatcatgaaacaaatccaaatctcaagaacattgagctagaggggtctttggaacagattgcccaagctagtaagatggtagaagagcttgtgagggtgacttcagcaaatgccgctgcaaaatcctctgggggtcatgccaacccaggaagcaactataagactaagttgtgtgacaattttgccaaagggtcttgcacttttggtcaaaggtgccattttgctcatggggctgctgaattgcgcaagtcatcaatgtga

SEQ ID NO: 697 - protein, 298 aa, Populus balsamifera subsp. trichocarpa
  misc_feature (1)..(298): Ceres ANNOT ID no. 1474847
  misc_feature (177)..(239): Pfam Name: KH_1 Pfam Description: KH domain
  misc_feature (63)..(75): Pfam Name: zf-CCCH Pfam Description: Zinc finger C-x8-C-x5-C-x3-H type (and similar)
  misc_feature: SWISSPROT Homolog: FUBP1_HUMAN Far upstream element-binding protein 1 (FUSE-binding protein 1) FBP (DNA helicase V) (HDH V) with e-value of 9.3e-13 and BLAST sequence identity of 35.1
  misc_feature: SWISSPROT Homolog: FUBP1_MOUSE Far upstream element-binding protein 1 (FUSE-binding protein 1) FBP with e-value of 9.9e-12 and BLAST sequence identity of 35.1
  misc_feature: SWISSPROT Homolog: FUBP2_RAT Far upstream element-binding protein 2 (FUSE-binding protein 2) with e-value of 9.4e-10 and BLAST sequence identity of 35.4
  misc_feature: SWISSPROT Homolog: FUBP2_RAT KH type splicing regulatory protein (KSRP) MAP2 RNA trans-acting protein 1 (MARTA1)
  misc_feature: SWISSPROT Homolog: ZBP2_CHICK Zipcode-binding protein 2 with e-value of 1.1e-06 and BLAST sequence identity of 35.0
  misc_feature: SWISSPROT Homolog: FUBP2_HUMAN Far upstream element-binding protein 2 (FUSE-binding protein 2) (KH type splicing regulatory protein) (KSRP) (p75) with e-value of 3.7e-06 and BLAST sequence identity of 31.3
  misc_feature 74485:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(298): Functional Homolog of  Ceres CLONE ID no. 17632 at SEQ ID NO. 724 with e-value of 3.90E-64 and BLAST sequence identity of 68.2
MDTRKRGRPDFGTNGYGGFKKSKQEMDSLSTGVGSKSKPCTKFFRTDFFLFLGYALDCSTAGCPFGESCHFLHHVPGGYKAVAQMVNLGPTVALPPVPNSSAPSAVKSRLCKKYNSAEGCKFGDKCHFAHGEWELGKAFVPSHNDPHAAGSVPGRLGGRVEPPPPGPATSFGVFATTTRISVDASLAGSIIGKAGVHSKQICRQTGIKLSIKDHETNPNLKNIELEGSLEQIAQASKMVEELVRVTSANAAAKSSGGHANPGSNYKTKLCDNFAKGSCTFGQRCHFAHGAAELRKSSM

SEQ ID NO: 698 - DNA, 813 bp, Populus balsamifera subsp. trichocarpa
  misc_feature (1)..(813): Ceres ANNOT ID no. 1507835
  misc_feature 74603:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
atggaccccttatcaactggtgtaggaagcaaattgaagccatgcaccaagtttttcagcactgctggctgcccatttggtgagagctgccactttctccaccatgttcctggtggctacaatgctgtgacccagatgatgaatctgggacctactgtcaccccaccatccagaagtatggtggccccactgccagtccctaatggctctgcttcgtctgctgttaaaggccggctatgtaacaaatacagtagtgctgaaggttgcaaatttggtgataaatgccgttttgcgcatggtgagtgggaacttggcagggcttttgctccatctcacaacaatccacgtgctgctggaggtgttccaggacatttgggtggtcgtgtggagcaaccttctcctggccctgctaccagctttggtgtctttgccaccactacaagaatcagtgtcaatgcctcccttgctggattcatcattggtaagggtggtgtgcattccatacagatatgccaccaaacaggagtcaagctgtctattaaggagcatgaaacaaatccaaatctcaagaacatcgaacttgaggggtcatttgaacagattgcccaagctagcaagatggtagaagagcttgtaaaggtgaattcagcaaaagccgctgcaaaaacctctgggggccgtggggggcatgccaatccaggaagcaactataagaccaagttgtgtgacaattttgccaaagggtcttgcacttttggtcaaaggtgccattttgctcacggagctgctgaattgcgcaagacagcagcgtga

SEQ ID NO: 699 - protein, 270 aa, Populus balsamifera subsp. trichocarpa
  misc_feature (1)..(270): Ceres ANNOT ID no. 1507835
  misc_feature (146)..(208): Pfam Name: KH_1 Pfam Description: KH domain
  misc_feature (75)..(101): Pfam Name: zf-CCCH Pfam Description: Zinc finger C-x8-C-x5-C-x3-H type (and similar)
  misc_feature: SWISSPROT Homolog: FUBP1_HUMAN Far upstream element-binding protein 1 (FUSE-binding protein 1) FBP (DNA helicase V) (HDH V) with e-value of 9.3e-13 and BLAST sequence identity of 35.1
  misc_feature: SWISSPROT Homolog: FUBP1_MOUSE Far upstream element-binding protein 1 (FUSE-binding protein 1) FBP with e-value of 9.9e-12 and BLAST sequence identity of 35.1
  misc_feature: SWISSPROT Homolog: FUBP2_RAT Far upstream element-binding protein 2 (FUSE-binding protein 2) with e-value of 9.4e-10 and BLAST sequence identity of 35.4
  misc_feature: SWISSPROT Homolog: FUBP2_RAT KH type splicing regulatory protein (KSRP) MAP2 RNA trans-acting protein 1 (MARTA1)
  misc_feature: SWISSPROT Homolog: ZBP2_CHICK Zipcode-binding protein 2 with e-value of 1.1e-06 and BLAST sequence identity of 35.0
  misc_feature: SWISSPROT Homolog: FUBP2_HUMAN Far upstream element-binding protein 2 (FUSE-binding protein 2) (KH type splicing regulatory protein) (KSRP) (p75) with e-value of 3.7e-06 and BLAST sequence identity of 31.3
  misc_feature 74742:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(270): Functional Homolog of  Ceres CLONE ID no. 17632 at SEQ ID NO. 724 with e-value of 3.89E-55 and BLAST sequence identity of 66.1
MDPLSTGVGSKLKPCTKFFSTAGCPFGESCHFLHHVPGGYNAVTQMMNLGPTVTPPSRSMVAPLPVPNGSASSAVKGRLCNKYSSAEGCKFGDKCRFAHGEWELGRAFAPSHNNPRAAGGVPGHLGGRVEQPSPGPATSFGVFATTTRISVNASLAGFIIGKGGVHSIQICHQTGVKLSIKEHETNPNLKNIELEGSFEQIAQASKMVEELVKVNSAKAAAKTSGGRGGHANPGSNYKTKLCDNFAKGSCTFGQRCHFAHGAAELRKTAA

SEQ ID NO: 700 - protein, 298 aa, Arabidopsis thaliana
  misc_feature (1)..(298): Ceres CLONE ID no. 17761
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MMESGAGFVAMEERISPGSFFQYPLSGFRASPNRSPCPPSDRERYLTELLQERQKLGPFLQVMPNCCRLLNHEIRRVSSFPDLDRYEHGSPFRSLGQPTNGKLDLEGWSMMQAEENCHLQRASPFRGPSPVGWIGMPGLPNPPIVKKVIRLDVPVDKYPSYNFVGRILGPRGNSLKRVELATHCRVFIRGRGSVKDTVKEEKLKGKPGYEHLCEPLHVLIEAELPEDIINSRLEHAVHFLESLLKPMDESMDHYKREQLKELAALNGTLREESPSPSLSPCLSPSMSPFNSKRAKTEI

SEQ ID NO: 701 - DNA, 1035 bp, Populus balsamifera subsp. trichocarpa
  misc_feature (1)..(1035): Ceres ANNOT ID no. 1481206
  misc_feature 74968:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgggagagagaattccatccgggagttactttcagtaccctccctctggagtccaccatgctactcctcagaggtccagttctcttccttcagatcttgaaagttgcaagcatctgcaagtcattatgctaggctcattctatggacctttatttcctaatatgactaaacttcttcaagctatttgtcagggtgctttggtgctcgagtgcagtgaagagattgaaactaggagctatagatttaaatatttggccgagttgttagcagagaagcataagttggggccatttgtgcaagttttaccaatttgttgcagacttctttaccaagaaatcagacgggcatcagcttacaatcaaggttttgtagatcatgaaagatatgaacatgagagtccatttaggtcattaggtcagcatccaaatggaaggccgatggatttggagggatggtctgctatgccaaaagaggagaatgggcatcttcaaagaatggcctcattaccagctgcttcaatgggttggcctggggtccctggaatttcaagtacgccagttgtgaagagagtaattagactcgatgttcctgttgacaaatatccaaattataattttgttggccgaatcttgggaccacgagggaactccttaaaaagagttgaagccttgacagaatgtagggtgtatataagaggcaagggctctgtaaaggattctctaaaggaagatgtaaatgcaatgtttatcttgttagcacctcagtttctgctggtaactcggtccaaaggctggaaggctgaatttccagaggatataatgaatgcccgcttggaccatgcaataacaatattagaaagcctcctgaagcctgtggatgaatcctttgataactataagaaacaacaattaagggaactagctttgctaaatgggacactaagggaggaaagcccgagcatgagccctagcatgagcccaagcatgtcacccttcaacactgcaggaatgaaacgagccaagacaggaagataa

SEQ ID NO: 702 - protein, 344 aa, Populus balsamifera subsp. trichocarpa
  misc_feature (1)..(344): Ceres ANNOT ID no. 1481206
  misc_feature: SWISSPROT Homolog: GLD1_CAEEL Female germline-specific tumor suppressor gld-1 (Defective in germ line development protein 1) with e-value of 2.9e-33 and BLAST sequence identity of 42.5
  misc_feature: SWISSPROT Homolog: HOW_DROME Protein held out wings (KH-domain protein KH93F) with e-value of 1.2e-32 and BLAST sequence identity of 43.4
  misc_feature: SWISSPROT Homolog: HOW_DROME Putative RNA-binding protein (Protein muscle-specific) Protein wings held out (Protein struthio) Quaking-related 93F
  misc_feature: SWISSPROT Homolog: KHDR3_HUMAN KH domain-containing, RNA binding, signal transduction-associated protein 3 with e-value of 6.8e-25 and BLAST sequence identity of 41.9
  misc_feature: SWISSPROT Homolog: KHDR3_HUMAN Sam68-like mammalian protein 2 (SLM-2) Sam68-like phosphotyrosine protein RNA-binding protein T-Star
  misc_feature: SWISSPROT Homolog: KHDR3_RAT KH domain-containing, RNA binding, signal transduction- associated protein 3 (Sam68-like mammalian protein 2) (SLM-2) with e-value of 6.8e-25 and BLAST sequence identity of 41.9
  misc_feature: SWISSPROT Homolog: KHDR3_MOUSE KH domain-containing, RNA binding, signal transduction-associated protein 3 with e-value of 6.8e-25 and BLAST sequence identity of 41.9
  misc_feature: SWISSPROT Homolog: KHDR3_MOUSE Sam68-like mammalian protein 2 (SLM-2) RNA-binding protein Etoile
  misc_feature 75129:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(344): Functional Homolog of  Ceres CLONE ID no. 17761 at SEQ ID NO. 729 with e-value of 7.99E-80 and BLAST sequence identity of 67.2
MGERIPSGSYFQYPPSGVHHATPQRSSSLPSDLESCKHLQVIMLGSFYGPLFPNMTKLLQAICQGALVLECSEEIETRSYRFKYLAELLAEKHKLGPFVQVLPICCRLLYQEIRRASAYNQGFVDHERYEHESPFRSLGQHPNGRPMDLEGWSAMPKEENGHLQRMASLPAASMGWPGVPGISSTPVVKRVIRLDVPVDKYPNYNFVGRILGPRGNSLKRVEALTECRVYIRGKGSVKDSLKEDVNAMFILLAPQFLLVTRSKGWKAEFPEDIMNARLDHAITILESLLKPVDESFDNYKKQQLRELALLNGTLREESPSMSPSMSPSMSPFNTAGMKRAKTGR

SEQ ID NO: 703 - DNA, 963 bp, Populus balsamifera subsp. trichocarpa
  misc_feature (1)..(963): Ceres ANNOT ID no. 1534689
  misc_feature 75263:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgggagagagaattccatccgggagttactttcagtaccctccctctggagtccaccatgctactcctcagaggtccagttctcttccttcagatcttgaaagttgcaagcatctgcaagtcattatgctaggctcattctatggacctttatttcctaatatgactaaacttcttcaagctatttgtcagggtgctttggtgctcgagtgcagtgaagagattgaaactaggagctatagatttaaacttctttaccaagaaatcagacgggcatcagcttacaatcaaggttttgtagatcatgaaagatatgaacatgagagtccatttaggtcattaggtcagcatccaaatggaaggccgatggatttggagggatggtctgctatgccaaaagaggagaatgggcatcttcaaagaatggcctcattaccagctgcttcaatgggttggcctggggtccctggaatttcaagtacgccagttgtgaagagagtaattagactcgatgttcctgttgacaaatatccaaattataattttgttggccgaatcttgggaccacgagggaactccttaaaaagagttgaagccttgacagaatgtagggtgtatataagaggcaagggctctgtaaaggattctctaaaggaagatgtaaatgcaatgtttatcttgttagcacctcagtttctgctggtaactcggtccaaaggctggaaggctgaatttccagaggatataatgaatgcccgcttggaccatgcaataacaatattagaaagcctcctgaagcctgtggatgaatcctttgataactataagaaacaacaattaagggaactagctttgctaaatgggacactaagggaggaaagcccgagcatgagccctagcatgagcccaagcatgtcacccttcaacactgcaggaatgaaacgagccaagacaggaagataa

SEQ ID NO: 704 - protein, 320 aa, Populus balsamifera subsp. trichocarpa
  misc_feature (1)..(320): Ceres ANNOT ID no. 1534689
  misc_feature: SWISSPROT Homolog: GLD1_CAEEL Female germline-specific tumor suppressor gld-1 (Defective in germ line development protein 1) with e-value of 2.9e-33 and BLAST sequence identity of 42.5
  misc_feature: SWISSPROT Homolog: HOW_DROME Protein held out wings (KH-domain protein KH93F) with e-value of 1.2e-32 and BLAST sequence identity of 43.4
  misc_feature: SWISSPROT Homolog: HOW_DROME Putative RNA-binding protein (Protein muscle-specific) Protein wings held out (Protein struthio) Quaking-related 93F
  misc_feature: SWISSPROT Homolog: KHDR3_HUMAN KH domain-containing, RNA binding, signal transduction-associated protein 3 with e-value of 6.8e-25 and BLAST sequence identity of 41.9
  misc_feature: SWISSPROT Homolog: KHDR3_HUMAN Sam68-like mammalian protein 2 (SLM-2) Sam68-like phosphotyrosine protein RNA-binding protein T-Star
  misc_feature: SWISSPROT Homolog: KHDR3_RAT KH domain-containing, RNA binding, signal transduction- associated protein 3 (Sam68-like mammalian protein 2) (SLM-2) with e-value of 6.8e-25 and BLAST sequence identity of 41.9
  misc_feature: SWISSPROT Homolog: KHDR3_MOUSE KH domain-containing, RNA binding, signal transduction-associated protein 3 with e-value of 6.8e-25 and BLAST sequence identity of 41.9
  misc_feature: SWISSPROT Homolog: KHDR3_MOUSE Sam68-like mammalian protein 2 (SLM-2) RNA-binding protein Etoile
  misc_feature 75422:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(320): Functional Homolog of  Ceres CLONE ID no. 17761 at SEQ ID NO. 729 with e-value of 7.90E-73 and BLAST sequence identity of 62.9
MGERIPSGSYFQYPPSGVHHATPQRSSSLPSDLESCKHLQVIMLGSFYGPLFPNMTKLLQAICQGALVLECSEEIETRSYRFKLLYQEIRRASAYNQGFVDHERYEHESPFRSLGQHPNGRPMDLEGWSAMPKEENGHLQRMASLPAASMGWPGVPGISSTPVVKRVIRLDVPVDKYPNYNFVGRILGPRGNSLKRVEALTECRVYIRGKGSVKDSLKEDVNAMFILLAPQFLLVTRSKGWKAEFPEDIMNARLDHAITILESLLKPVDESFDNYKKQQLRELALLNGTLREESPSMSPSMSPSMSPFNTAGMKRAKTGR

SEQ ID NO: 705 - protein, 144 aa, Arabidopsis thaliana
  misc_feature (1)..(144): Ceres CLONE ID no. 17912
  misc_feature (68)..(144): Pfam Name: SWIB Pfam Description: SWIB/MDM2 domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
MALSSGIFSITFLCVDTAPLRISMLSPSSLRLSPNHPTNLRMVRAVTSAAAASSDPTTTTKTREPRGIMKPRPVSQAMQDVVGVPEIPRTQALKRIWAYIKEHDLQDPQNKRDILCDEKLKKIFEGKERVGFLEIAKLIGPHFL

SEQ ID NO: 706 - DNA, 426 bp, Populus balsamifera subsp. trichocarpa
  misc_feature (1)..(426): Ceres ANNOT ID no. 1514378
  misc_feature 75632:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
atggcaatttcttcagggattttctctactttcctatccaccgaaacggtgccgcttctcaagtttccttctcctacatccactcttcctctcaggtttctggctgcgcctcccgcgaacccgcgcatggtgcgtagtactgtagttacctgcgccacggcatcgaccggaaaccgtgctccacgcggcataatgaagccgaggcgagtctcacctgaaatggcggactttattggtgctcctgaggtctctcgtactcaggctctcaagcttatatgggcccatatcaaggagcacaatcttcaggaccctagtaacaagaagaacataatttgtgacgagaagttgaagaagatatttgctggtagagaccaggttggatttcttgagattgctgggttgattagtcctcatttcctcaaatga

SEQ ID NO: 707 - protein, 141 aa, Populus balsamifera subsp. trichocarpa
  misc_feature (1)..(141): Ceres ANNOT ID no. 1514378
  misc_feature (64)..(140): Pfam Name: SWIB Pfam Description: SWIB/MDM2 domain
  misc_feature: SWISSPROT Homolog: YM74_YEAST Hypothetical 26.5 kDa protein in FUS2-RNH1 intergenic region with e-value of 1.4e-14 and BLAST sequence identity of 38.8
  misc_feature: SWISSPROT Homolog: Y5417_ARATH Protein At5g14170 with e-value of 3.2e-06 and BLAST sequence identity of 33.3
  misc_feature: SWISSPROT Homolog: SMRD1_MOUSE SWI/SNF-related matrix-associated actin-dependent regulator of chromatin subfamily D member 1 with e-value of 3.5e-06 and BLAST sequence identity of 40.0
  misc_feature: SWISSPROT Homolog: SMRD1_MOUSE SWI/SNF complex 60 kDa subunit 60 kDa BRG-1/Brm associated factor subunit A BRG1-associated factor 60A (D15KZ1 protein)
  misc_feature: SWISSPROT Homolog: SMRD1_HUMAN SWI/SNF-related matrix-associated actin-dependent regulator of chromatin subfamily D member 1 with e-value of 5.7e-06 and BLAST sequence identity of 38.2
  misc_feature: SWISSPROT Homolog: SMRD1_HUMAN SWI/SNF complex 60 kDa subunit 60 kDa BRG-1/Brm associated factor subunit A BRG1-associated factor 60A
  misc_feature 75748:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(141): Functional Homolog of  Ceres CLONE ID no. 17912 at SEQ ID NO. 734 with e-value of 1.50E-37 and BLAST sequence identity of 63.5
MAISSGIFSTFLSTETVPLLKFPSPTSTLPLRFLAAPPANPRMVRSTVVTCATASTGNRAPRGIMKPRRVSPEMADFIGAPEVSRTQALKLIWAHIKEHNLQDPSNKKNIICDEKLKKIFAGRDQVGFLEIAGLISPHFLK

SEQ ID NO: 708 - DNA, 423 bp, Populus balsamifera subsp. trichocarpa
  misc_feature (1)..(423): Ceres ANNOT ID no. 1494118
  misc_feature 75829:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
atggaaatttcttcaaggacttgctttcctttcctatccaccgaaacggtgccgcttctcaagcctccatttcatacatcctctccttctctcaggattctggctgcgcgtcctgttaacctgcgcatggggcgtactgttgttacctgcgctacggcgtcgactggcaaccgcgctcccagcggcataatgaagccgaagcgagtctcacctgaaatggcagactttgttggcgctcctgaggtctctcgcacccaggttctcaagcttatctgggcccatataaaggagcgcaatcttcaggaccctagtaacaagaagaacataatttgcgacgagaagttgaagaagatatttcctggtagagaccaggtcggatttcttgagattgctgggttgattagtcctcacttcctcaaatga

SEQ ID NO: 709 - protein, 140 aa, Populus balsamifera subsp. trichocarpa
  misc_feature (1)..(140): Ceres ANNOT ID no. 1494118
  misc_feature (63)..(139): Pfam Name: SWIB Pfam Description: SWIB/MDM2 domain
  misc_feature: SWISSPROT Homolog: YM74_YEAST Hypothetical 26.5 kDa protein in FUS2-RNH1 intergenic region with e-value of 1.4e-14 and BLAST sequence identity of 38.8
  misc_feature: SWISSPROT Homolog: Y5417_ARATH Protein At5g14170 with e-value of 3.2e-06 and BLAST sequence identity of 33.3
  misc_feature: SWISSPROT Homolog: SMRD1_MOUSE SWI/SNF-related matrix-associated actin-dependent regulator of chromatin subfamily D member 1 with e-value of 3.5e-06 and BLAST sequence identity of 40.0
  misc_feature: SWISSPROT Homolog: SMRD1_MOUSE SWI/SNF complex 60 kDa subunit 60 kDa BRG-1/Brm associated factor subunit A BRG1-associated factor 60A (D15KZ1 protein)
  misc_feature: SWISSPROT Homolog: SMRD1_HUMAN SWI/SNF-related matrix-associated actin-dependent regulator of chromatin subfamily D member 1 with e-value of 5.7e-06 and BLAST sequence identity of 38.2
  misc_feature: SWISSPROT Homolog: SMRD1_HUMAN SWI/SNF complex 60 kDa subunit 60 kDa BRG-1/Brm associated factor subunit A BRG1-associated factor 60A
  misc_feature 75945:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(140): Functional Homolog of  Ceres CLONE ID no. 17912 at SEQ ID NO. 734 with e-value of 3.89E-32 and BLAST sequence identity of 59.8
MEISSRTCFPFLSTETVPLLKPPFHTSSPSLRILAARPVNLRMGRTVVTCATASTGNRAPSGIMKPKRVSPEMADFVGAPEVSRTQVLKLIWAHIKERNLQDPSNKKNIICDEKLKKIFPGRDQVGFLEIAGLISPHFLK

SEQ ID NO: 710 - protein, 135 aa, Arabidopsis thaliana
  misc_feature (1)..(135): Ceres CLONE ID no. 18152
  misc_feature (3)..(77): Pfam Name: Sedlin_N Pfam Description: Sedlin, N-terminal conserved region
  misc_feature: Utility: Low Nitrate Useful for making plants tolerant to low nitrogen
  misc_feature: Phenotype: WHOLE PLANT - Low Nitrate Useful for making plants tolerant to low nitrogen
MANTACFIIVGRNDIPIYEAEVGSAAKREDAAQLHQFILHAALDVVQDLAWTTSAMFLKSVDRFNDLVVSVYVTAGHTRLMLLHDSRNEDGIKSFFQEVHELYIKILLNPLYLPGSRITSSHFDTKVRALARKYL

SEQ ID NO: 711 - DNA, 360 bp, Populus balsamifera subsp. trichocarpa
  misc_feature (1)..(360): Ceres ANNOT ID no. 1448104
  misc_feature: Utility: Low Nitrate Useful for making plants tolerant to low nitrogen
  misc_feature 76093:<222: Transcription Factor
  misc_feature: Phenotype: WHOLE PLANT - Low Nitrate Useful for making plants tolerant to low nitrogen
atggcaaccacagcttgttttataattgtgagcaggaatgatatccctatatatgaagctgaagttggatctgctactaaaagggaagacgctgcacagatgcatcaatttatattgcatgcagctttggatattgttcaggatcttgcatggaccaccagcgccatgtatttgaaggcaattgacagatttatgctacttcatgactctcgcaatgatgatggaatcaagagctttttccaggaggttcatgagctgtatataaagattcttctcaaccccctatacttgcctggttcccgcattacatcttcgcattttgacaccaaagttcgggctcttgcaagaaaatacctatag

SEQ ID NO: 712 - protein, 119 aa, Populus balsamifera subsp. trichocarpa
  misc_feature (1)..(119): Ceres ANNOT ID no. 1448104
  misc_feature (3)..(71): Pfam Name: Sedlin_N Pfam Description: Sedlin, N-terminal conserved region
  misc_feature: SWISSPROT Homolog: TPPC2_HUMAN Trafficking protein particle complex protein 2 (Sedlin) (MBP-1-interacting protein 2A) (MIP-2A) with e-value of 3.9e-33 and BLAST sequence identity of 50.0
  misc_feature: SWISSPROT Homolog: TPPC2_MOUSE Trafficking protein particle complex protein 2 (Sedlin) with e-value of 3.9e-33 and BLAST sequence identity of 50.0
  misc_feature: SWISSPROT Homolog: TRS20_YEAST Transport protein particle 20 kDa subunit (TRAPP 20 kDa subunit) with e-value of 1.1e-22 and BLAST sequence identity of 38.9
  misc_feature: Utility: Low Nitrate Useful for making plants tolerant to low nitrogen
  misc_feature 76168:<222: Transcription Factor
  misc_feature: Phenotype: WHOLE PLANT - Low Nitrate Useful for making plants tolerant to low nitrogen
  misc_feature (1)..(119): Functional Homolog of  Ceres CLONE ID no. 18152 at SEQ ID NO. 739 with e-value of 3.60E-52 and BLAST sequence identity of 92.4
MATTACFIIVSRNDIPIYEAEVGSATKREDAAQMHQFILHAALDIVQDLAWTTSAMYLKAIDRFMLLHDSRNDDGIKSFFQEVHELYIKILLNPLYLPGSRITSSHFDTKVRALARKYL

SEQ ID NO: 713 - DNA, 348 bp, Populus balsamifera subsp. trichocarpa
  misc_feature (1)..(348): Ceres ANNOT ID no. 1483641
  misc_feature: Utility: Low Nitrate Useful for making plants tolerant to low nitrogen
  misc_feature 76231:<222: Transcription Factor
  misc_feature: Phenotype: WHOLE PLANT - Low Nitrate Useful for making plants tolerant to low nitrogen
atggcaaccacagcttgttttataattgtgagcagggatgatatccctatatacgaagctgaagttggatctgctactaaaagggaagatgctgcacagatgcatcaattcatattgcacgcagctttggatattgttcaggatcttgcatggaccaccagtgcgatactcatgctacttcatgactctcgcaatgatgatggaatcaagagctttttccaggaggttcatgagctgtatataaaggcccatagaccaacgtgcaatatgatagagcagatctcccaacaagcggtagcggaaccgatagttcagctagatacaaatgaatgcatcgagtgtttgtag

SEQ ID NO: 714 - protein, 115 aa, Populus balsamifera subsp. trichocarpa
  misc_feature (1)..(115): Ceres ANNOT ID no. 1483641
  misc_feature (3)..(55): Pfam Name: Sedlin_N Pfam Description: Sedlin, N-terminal conserved region
  misc_feature: SWISSPROT Homolog: TPPC2_HUMAN Trafficking protein particle complex protein 2 (Sedlin) (MBP-1-interacting protein 2A) (MIP-2A) with e-value of 3.9e-33 and BLAST sequence identity of 50.0
  misc_feature: SWISSPROT Homolog: TPPC2_MOUSE Trafficking protein particle complex protein 2 (Sedlin) with e-value of 3.9e-33 and BLAST sequence identity of 50.0
  misc_feature: SWISSPROT Homolog: TRS20_YEAST Transport protein particle 20 kDa subunit (TRAPP 20 kDa subunit) with e-value of 1.1e-22 and BLAST sequence identity of 38.9
  misc_feature: Utility: Low Nitrate Useful for making plants tolerant to low nitrogen
  misc_feature 76304:<222: Transcription Factor
  misc_feature: Phenotype: WHOLE PLANT - Low Nitrate Useful for making plants tolerant to low nitrogen
  misc_feature (1)..(115): Functional Homolog of  Ceres CLONE ID no. 18152 at SEQ ID NO. 739 with e-value of 1.20E-30 and BLAST sequence identity of 90.2
MATTACFIIVSRDDIPIYEAEVGSATKREDAAQMHQFILHAALDIVQDLAWTTSAILMLLHDSRNDDGIKSFFQEVHELYIKAHRPTCNMIEQISQQAVAEPIVQLDTNECIECL

SEQ ID NO: 715 - protein, 221 aa, Arabidopsis thaliana
  misc_feature (1)..(221): Ceres CLONE ID no. 18246
  misc_feature (9)..(82): Pfam Name: GST_N Pfam Description: Glutathione S-transferase, N-terminal domain
  misc_feature (98)..(203): Pfam Name: GST_C Pfam Description: Glutathione S-transferase, C-terminal domain
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
MANSGEEKLKLYSYWRSSCAHRVRIALALKGLDYEYIPVNLLKGDQFDSDFKKINPMGTVPALVDGDVVINDSFAIIMYLDEKYPEPPLLPRDLHKRAVNYQAMSIVLSGIQPHQNLAVIRYIEEKINVEEKTAWVNNAITKGFTALEKLLVNCAGKLATGDEIYLADLFLAPQIHGAINRFQINMEPYPNLAKCYESYKELPVFQNALPEKQPDAPSSTN

SEQ ID NO: 716 - DNA, 633 bp, Populus balsamifera subsp. trichocarpa
  misc_feature (1)..(633): Ceres ANNOT ID no. 1489791
  misc_feature 76451:<222: Transcription Factor
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atggcagaaagtggagagagcaataagaataaattgaagctgtattcttactggaggagttcttgctctcaacgtgttcgcattgctcttaacctcaaagggctcgaatatgagtatatacctgttaacctgcttaaaggagaacatttcagtcctgatttcttaaagctgaatcctctcggatatgtgcctgcgctgtatttggaagagaagtaccctcagcatcctttgttgcctagtgatcttcagaaaaaagcccttaattatcaggctgcaaatgttgtctgctctagcatacagcctcttcaaaacttggctgtgctaaagtatattaaggaaaaagttggtccagatgaggtgattccttgggttcagagtcatattaacaaagggtttgcagcactagagaagctgctaaaagactctgctggaaaatatgcaactggaaatgaagtatccatggcagatctgtttatagaaccacagattcatggagcaattaaaaggttcaatgttgacatgactcagttccctcttctatcaaggttgcatgtagcatatagtgagctgccagcattccagaatgccatgccagaaaatcagccagatgcctcaccttcatctgtcacttag

SEQ ID NO: 717 - protein, 210 aa, Populus balsamifera subsp. trichocarpa
  misc_feature (1)..(210): Ceres ANNOT ID no. 1489791
  misc_feature (12)..(66): Pfam Name: GST_N Pfam Description: Glutathione S-transferase, N-terminal domain
  misc_feature (86)..(191): Pfam Name: GST_C Pfam Description: Glutathione S-transferase, C-terminal domain
  misc_feature: SWISSPROT Homolog: GSTZ1_ARATH Glutathione S-transferase zeta-class 1 (EC 2.5.1.18) (AtGSTZ1) (Maleylacetone isomerase) (EC 5.2.1.-) (MAI) with e-value of 1.6e-114 and BLAST sequence identity of 98.2
  misc_feature: SWISSPROT Homolog: GSTZ2_ARATH Probable glutathione S-transferase zeta-class 2 (EC 2.5.1.18) with e-value of 3.8e-99 and BLAST sequence identity of 85.0
  misc_feature: SWISSPROT Homolog: GSTZ_EUPES Glutathione S-transferase zeta class (EC 2.5.1.18) with e-value of 8.9e-75 and BLAST sequence identity of 66.2
  misc_feature: SWISSPROT Homolog: GSTZ1_DIACA Glutathione S-transferase 1 (EC 2.5.1.18) (SR8) (GST class-zeta) with e-value of 2.1e-57 and BLAST sequence identity of 57.8
  misc_feature: SWISSPROT Homolog: GSTZ_WHEAT Glutathione S-transferase (EC 2.5.1.18) (GST class-zeta) with e-value of 5.2e-54 and BLAST sequence identity of 51.7
  misc_feature 76564:<222: Transcription Factor
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(210): Functional Homolog of  Ceres CLONE ID no. 18246 at SEQ ID NO. 744 with e-value of 2.59E-65 and BLAST sequence identity of 65.6
MAESGESNKNKLKLYSYWRSSCSQRVRIALNLKGLEYEYIPVNLLKGEHFSPDFLKLNPLGYVPALYLEEKYPQHPLLPSDLQKKALNYQAANVVCSSIQPLQNLAVLKYIKEKVGPDEVIPWVQSHINKGFAALEKLLKDSAGKYATGNEVSMADLFIEPQIHGAIKRFNVDMTQFPLLSRLHVAYSELPAFQNAMPENQPDASPSSVT

SEQ ID NO: 718 - DNA, 717 bp, Populus balsamifera subsp. trichocarpa
  misc_feature (1)..(717): Ceres ANNOT ID no. 1470953
  misc_feature 76653:<222: Transcription Factor
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgaattcatcaccaaagctcgtcctgtataatttctcgcacagctcctgttcatggcgggtccgctttgctttaaaccttaaaggtatcattttctacatttatattgatcgacttttgttaatcatttctgaaaaatggaactgttcaggacttgattatgagtataaagcagtcaaccttgcaaaaggagagcagtttcgtacagagtttgaacaattgaatcctctccgttatgttccagtcttggttgatggtgatgtggtagtctcggactccttagcaatcttgctgtatttggaagaaaagtatcctcagagagcgttgctgccagatgatcctcggcgaaaagctctaaatctccaagttgccagtatcgtctgctctagcatacaacctcttcatatgttggctttggtgaaacgcattgaagaaaaagttggtccggaagagggattattatgggcacaatctattattgaaaaaggtttttttgcacttgagcagttggtaaaagactttgcaaccagatttgccactggagaagcattatacatggctgatgtgtttttggccccacagattgctacagttgttatgaggttcaacattgatatgtccaacttccctattttaagtagggtatatgaatcatacaagaccgtaccggagttccgagcttcatccccggaagcacaaccagatgcagggagttaa

SEQ ID NO: 719 - protein, 238 aa, Populus balsamifera subsp. trichocarpa
  misc_feature (1)..(238): Ceres ANNOT ID no. 1470953
  misc_feature (7)..(30): Pfam Name: GST_N Pfam Description: Glutathione S-transferase, N-terminal domain
  misc_feature: SWISSPROT Homolog: GSTZ1_ARATH Glutathione S-transferase zeta-class 1 (EC 2.5.1.18) (AtGSTZ1) (Maleylacetone isomerase) (EC 5.2.1.-) (MAI) with e-value of 1.6e-114 and BLAST sequence identity of 98.2
  misc_feature: SWISSPROT Homolog: GSTZ2_ARATH Probable glutathione S-transferase zeta-class 2 (EC 2.5.1.18) with e-value of 3.8e-99 and BLAST sequence identity of 85.0
  misc_feature: SWISSPROT Homolog: GSTZ_EUPES Glutathione S-transferase zeta class (EC 2.5.1.18) with e-value of 8.9e-75 and BLAST sequence identity of 66.2
  misc_feature: SWISSPROT Homolog: GSTZ1_DIACA Glutathione S-transferase 1 (EC 2.5.1.18) (SR8) (GST class-zeta) with e-value of 2.1e-57 and BLAST sequence identity of 57.8
  misc_feature: SWISSPROT Homolog: GSTZ_WHEAT Glutathione S-transferase (EC 2.5.1.18) (GST class-zeta) with e-value of 5.2e-54 and BLAST sequence identity of 51.7
  misc_feature 76762:<222: Transcription Factor
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(238): Functional Homolog of  Ceres CLONE ID no. 18246 at SEQ ID NO. 744 with e-value of 6.80E-51 and BLAST sequence identity of 53.5
MNSSPKLVLYNFSHSSCSWRVRFALNLKGIIFYIYIDRLLLIISEKWNCSGLDYEYKAVNLAKGEQFRTEFEQLNPLRYVPVLVDGDVVVSDSLAILLYLEEKYPQRALLPDDPRRKALNLQVASIVCSSIQPLHMLALVKRIEEKVGPEEGLLWAQSIIEKGFFALEQLVKDFATRFATGEALYMADVFLAPQIATVVMRFNIDMSNFPILSRVYESYKTVPEFRASSPEAQPDAGS

SEQ ID NO: 720 - protein, 441 aa, Arabidopsis thaliana
  misc_feature (1)..(441): Ceres CLONE ID no. 18612
  misc_feature (114)..(139): Pfam Name: zf-CCCH Pfam Description: Zinc finger C-x8-C-x5-C-x3-H type (and similar)
  misc_feature (352)..(391): Pfam Name: WD40 Pfam Description: WD domain, G-beta repeat
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
MDFDLNGGNKRVFNRLGGGGGVGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPRLLVGMPNLVKAWNIETNADQSLSGPVGQVYSLVVGTDLLFAGTQDGSILAWRYNAATNCFEPAASLTGHTLAVVTLYVGANRLYSGSMDKTIKVWSLDNLQCIQTLTDHTSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 721 - DNA, 1359 bp, Populus balsamifera subsp. trichocarpa
  misc_feature (1)..(1359): Ceres ANNOT ID no. 1522299
  misc_feature 77007:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
atggatttggactataacggaggcaacaccaccaacacaaacaagcgagtttttcacagattaggaggcgggaaatcagtgaacgacacgtcaaatcagcataaccatcagcatcagcagaatcagaaggtctgttaccactggagagctggaaagtgcaatagattcccatgtccatttctccaccgtgaacttccagcaccgccgccgcatgcgtctgtgaacgggggaggaggaggaggaggaggagcgaagagagggtttgcgggaaatgattcgtcctcgttttcagggaggaggggtggtaatagtaattatagtaatagttgggggcgatttggaaataaaggtgatgttagaggggtgaaaagggtaagtgtggagaaagtgtgtaatttttgggtacaagggaattgtagttttggtgataagtgtaggtatttgcattcttggagtttaggtgatgggttttctttggtgactcaacttgaagggcatcaaaaggtgattagtgggattgcattaccatctgggtctgataagctgtatacagggagtaaagatgagactgttagagtttgggattgccagtctggacagtgtacgggtgtggttaatcttggtggtgaggttggttgcatgattagtgaaggtccttggatttttgttggccttccaaatgttgtcaaggcgtggaatacacaaactaacgctgacctaagtcttaatgggcctattggacaagtgtatgctctggttgtgggcaatgatttgttatttgctggtacgcaggatgggtcaatattggtatggaaattcaatgcagctacctacaactttgaaccagctgtatcactaaaggatcacaaaatggccgttgtttcattagttgtcggagctaatagactctactctggctctatggaccattctataaaagtctggagccttgaaactttgcaatgtatacagacgctgacagatcatacttcagtggtcatgtcgctactatgctgggaacagtttcttctatcatgctcgttggaccaaacaataaaggtgtgggctgctacagaaagtggaaacttagaagtaacattcactcacaacgaagaacatggcctgcttaccctttgtgggatgcatgatccggaaggcaagccagtcttgctatgctccagtaatgacaattcagtccacctctatgatttaccatcgttctcggaaaagggcaaaatgtttgccaaacaagagatccgtgccattcaaactggtcctgggggcctatttttcactggcgatggcactggtcaagtgagagtgtggaattctgtcgctgtaccaactaccacaacttga

SEQ ID NO: 722 - protein, 452 aa, Populus balsamifera subsp. trichocarpa
  misc_feature (1)..(452): Ceres ANNOT ID no. 1522299
  misc_feature (126)..(151): Pfam Name: zf-CCCH Pfam Description: Zinc finger C-x8-C-x5-C-x3-H type (and similar)
  misc_feature (281)..(316): Pfam Name: WD40 Pfam Description: WD domain, G-beta repeat
  misc_feature: SWISSPROT Homolog: KMHB_DICDI Myosin heavy chain kinase B (EC 2.7.11.7) (MHCK B) with e-value of 1.7e-21 and BLAST sequence identity of 30.3
  misc_feature: SWISSPROT Homolog: POF1_SCHPO F-box/WD-repeat protein pof1 (Skp1-binding protein 1) with e-value of 3.1e-20 and BLAST sequence identity of 30.7
  misc_feature: SWISSPROT Homolog: HETE1_PODAN Vegetatible incompatibility protein HET-E-1 with e-value of 2.5e-19 and BLAST sequence identity of 28.4
  misc_feature: SWISSPROT Homolog: KMHA_DICDI Myosin heavy chain kinase A (EC 2.7.11.7) (MHCK A) with e-value of 4.3e-19 and BLAST sequence identity of 30.1
  misc_feature: SWISSPROT Homolog: SEL10_CAEEL F-box/WD-repeat protein sel-10 (Suppressor/enhancer of lin-12) (Sel-10 protein) with e-value of 3.0e-18 and BLAST sequence identity of 33.2
  misc_feature 77164:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
  misc_feature (1)..(452): Functional Homolog of  Ceres CLONE ID no. 18612 at SEQ ID NO. 749 with e-value of 2.90E-169 and BLAST sequence identity of 71.0
MDLDYNGGNTTNTNKRVFHRLGGGKSVNDTSNQHNHQHQQNQKVCYHWRAGKCNRFPCPFLHRELPAPPPHASVNGGGGGGGGAKRGFAGNDSSSFSGRRGGNSNYSNSWGRFGNKGDVRGVKRVSVEKVCNFWVQGNCSFGDKCRYLHSWSLGDGFSLVTQLEGHQKVISGIALPSGSDKLYTGSKDETVRVWDCQSGQCTGVVNLGGEVGCMISEGPWIFVGLPNVVKAWNTQTNADLSLNGPIGQVYALVVGNDLLFAGTQDGSILVWKFNAATYNFEPAVSLKDHKMAVVSLVVGANRLYSGSMDHSIKVWSLETLQCIQTLTDHTSVVMSLLCWEQFLLSCSLDQTIKVWAATESGNLEVTFTHNEEHGLLTLCGMHDPEGKPVLLCSSNDNSVHLYDLPSFSEKGKMFAKQEIRAIQTGPGGLFFTGDGTGQVRVWNSVAVPTTTT

SEQ ID NO: 723 - DNA, 1155 bp, Populus balsamifera subsp. trichocarpa
  misc_feature (1)..(1155): Ceres ANNOT ID no. 1527718
  misc_feature 77319:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
atggattttgactataacggaggcaacaccaccaacacaaacaagcgggtttttaaccgattaggagggggccaatcggcgaacgacacgtcaaatcataatcaccttcagcagaatcagaaggtctgttaccattggagagctgggaggtgcaatcgatttccatgtccgtttctccaccgtgaactctcagcaccgccgacgcatgcggcagtgaatggcggagtaggagcgaaaagagggtttgtggggaatgattcgtcgtcgtcgtcgttttcggggaggaggggtaataatggtactaatggtaataatagtaattatagtaatagttgggggcggtttgggaataagggtgatgggagaggggtaagagggggtagtgtggagaaagtgtgtacttactgggtacaagggcattgtaatcgtggtgatacgtgtaggtttttgcattcttggagtttaggtgatgggttttctttgttgactcaacttgaagggcatcaaaaggtgattagtgggattgcattgccatctgggtctgataagctttatacagggagtaaagatgaaactgttagagtttgggattgccagtctggacagtgtatgggtgtgataaatcttggtggtgaggttggttgcatgatcagtgaaggtccttggatttttgttggtactccaaatgtggtcaaggcatggaatacacagactaacacagacctgagtcttactggacctgtgggacaagtgtatactttggtcgtgggtaacgatttgctatttgctggtacacaggatgggtcaatattggtatggaaattcaatgcagctacttacaacttcgaaccagctgcatcactaaatgatcacaaaatggcagttgtttcattagttgttggagctaatagactctactctggttctatggatcattctataaaagtctggagccttgaaactttgcagtgtgtacaaacgctgaaggatcatacttcagttgtcatgtcactactatgctgggagcagtttcttttatcatgttcgttggaccaaacaataaaggtgtgggctgctacagaaagtggaaacttagaagtaacatacactcacaaagaagaacatgtgaaaagcaatttggaaagtaggttgtaa

SEQ ID NO: 724 - protein, 384 aa, Populus balsamifera subsp. trichocarpa
  misc_feature (1)..(384): Ceres ANNOT ID no. 1527718
  misc_feature (128)..(153): Pfam Name: zf-CCCH Pfam Description: Zinc finger C-x8-C-x5-C-x3-H type (and similar)
  misc_feature (239)..(274): Pfam Name: WD40 Pfam Description: WD domain, G-beta repeat
  misc_feature: SWISSPROT Homolog: KMHB_DICDI Myosin heavy chain kinase B (EC 2.7.11.7) (MHCK B) with e-value of 1.7e-21 and BLAST sequence identity of 30.3
  misc_feature: SWISSPROT Homolog: POF1_SCHPO F-box/WD-repeat protein pof1 (Skp1-binding protein 1) with e-value of 3.1e-20 and BLAST sequence identity of 30.7
  misc_feature: SWISSPROT Homolog: HETE1_PODAN Vegetatible incompatibility protein HET-E-1 with e-value of 2.5e-19 and BLAST sequence identity of 28.4
  misc_feature: SWISSPROT Homolog: KMHA_DICDI Myosin heavy chain kinase A (EC 2.7.11.7) (MHCK A) with e-value of 4.3e-19 and BLAST sequence identity of 30.1
  misc_feature: SWISSPROT Homolog: SEL10_CAEEL F-box/WD-repeat protein sel-10 (Suppressor/enhancer of lin-12) (Sel-10 protein) with e-value of 3.0e-18 and BLAST sequence identity of 33.2
  misc_feature 77470:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Ovate Shaped Useful for making plants with increased biomass and foliage
  misc_feature (1)..(384): Functional Homolog of  Ceres CLONE ID no. 18612 at SEQ ID NO. 749 with e-value of 7.49E-132 and BLAST sequence identity of 69.0
MDFDYNGGNTTNTNKRVFNRLGGGQSANDTSNHNHLQQNQKVCYHWRAGRCNRFPCPFLHRELSAPPTHAAVNGGVGAKRGFVGNDSSSSSFSGRRGNNGTNGNNSNYSNSWGRFGNKGDGRGVRGGSVEKVCTYWVQGHCNRGDTCRFLHSWSLGDGFSLLTQLEGHQKVISGIALPSGSDKLYTGSKDETVRVWDCQSGQCMGVINLGGEVGCMISEGPWIFVGTPNVVKAWNTQTNTDLSLTGPVGQVYTLVVGNDLLFAGTQDGSILVWKFNAATYNFEPAASLNDHKMAVVSLVVGANRLYSGSMDHSIKVWSLETLQCVQTLKDHTSVVMSLLCWEQFLLSCSLDQTIKVWAATESGNLEVTYTHKEEHVKSNLESRL

SEQ ID NO: 725 - protein, 101 aa, Arabidopsis thaliana
  misc_feature (1)..(101): Ceres CLONE ID no. 18663
  misc_feature (1)..(101): Pfam Name: GASA Pfam Description: Gibberellin regulated protein
MAKLITSFLLLTILFTFVCLTMSKEAEYHPESYGPGSLKSYQCGGQCTRRCSSTKYHKPCMFFCQKCCAKCLCVPPGTYGNKQVCPCYNNWKTQQGGPKCP

SEQ ID NO: 726 - DNA, 324 bp, Populus balsamifera subsp. trichocarpa
  misc_feature (1)..(324): Ceres ANNOT ID no. 1476788
  misc_feature 77655:<222: Transcription Factor
atggctaagtttgttgctgtcttcctcttggctctcattgccatttccatgctccaaaccttggttgtggcatcccatgggcgtggaggtcaccacaataacaacaagaacaaatatggacctgggagtctcaagagcttccaatgtccatcacaatgcacgaggaggtgtagcaagacccagtaccataagccatgcatgttcttctgtcagaagtgctgcaagaagtgcctctgcgttcccccagggtattatgggaataaagctgtgtgcccttgctacaacaactggaagaccaaggaaggagggcctaagtgcccttga

SEQ ID NO: 727 - protein, 107 aa, Populus balsamifera subsp. trichocarpa
  misc_feature (1)..(107): Ceres ANNOT ID no. 1476788
  misc_feature (3)..(107): Pfam Name: GASA Pfam Description: Gibberellin regulated protein
  misc_feature: SWISSPROT Homolog: GASA4_ARATH Gibberellin-regulated protein 4 precursor with e-value of 8.2e-33 and BLAST sequence identity of 57.5
  misc_feature: SWISSPROT Homolog: GAST1_LYCES GAST1 protein precursor with e-value of 1.4e-28 and BLAST sequence identity of 65.0
  misc_feature: SWISSPROT Homolog: RSI1_LYCES RSI-1 protein precursor (TR132) with e-value of 2.9e-28 and BLAST sequence identity of 60.0
  misc_feature: SWISSPROT Homolog: GASA2_ARATH Gibberellin-regulated protein 2 precursor with e-value of 3.9e-17 and BLAST sequence identity of 43.6
  misc_feature: SWISSPROT Homolog: GASA3_ARATH Gibberellin-regulated protein 3 precursor with e-value of 1.7e-16 and BLAST sequence identity of 42.3
  misc_feature 77727:<222: Transcription Factor
  misc_feature (1)..(107): Functional Homolog of  Ceres CLONE ID no. 18663 at SEQ ID NO. 754 with e-value of 5.20E-37 and BLAST sequence identity of 67.3
MAKFVAVFLLALIAISMLQTLVVASHGRGGHHNNNKNKYGPGSLKSFQCPSQCTRRCSKTQYHKPCMFFCQKCCKKCLCVPPGYYGNKAVCPCYNNWKTKEGGPKCP

SEQ ID NO: 728 - DNA, 342 bp, Populus balsamifera subsp. trichocarpa
  misc_feature (1)..(342): Ceres ANNOT ID no. 1439752
  misc_feature 77774:<222: Transcription Factor
atgggcaaatcaagcattgccatttttttatgctctctgctggtgcttgttctgctaggacaaaaccaggctcttaaaacaccaatctcagcttcacagacacaacgacagggcaaccatgcaatgtatggggccactcaaggcagtcttcgtcctcaggaatgtgcaccaaggtgcaccaccaggtgctcagccacagcatacaagaagccatgcttgttcttctgccaaaagtgctgtgcaaagtgcttgtgtgtgcctcccggcacgtatgggaacaaacagtcttgcccttgctacaacaactggaagaccaagagaggagggcccaaatgcccttga

SEQ ID NO: 729 - protein, 72 aa, Populus balsamifera subsp. trichocarpa
  misc_feature (1)..(72): Ceres ANNOT ID no. 1439752
  misc_feature (2)..(72): Pfam Name: GASA Pfam Description: Gibberellin regulated protein
  misc_feature: SWISSPROT Homolog: GASA4_ARATH Gibberellin-regulated protein 4 precursor with e-value of 8.2e-33 and BLAST sequence identity of 57.5
  misc_feature: SWISSPROT Homolog: GAST1_LYCES GAST1 protein precursor with e-value of 1.4e-28 and BLAST sequence identity of 65.0
  misc_feature: SWISSPROT Homolog: RSI1_LYCES RSI-1 protein precursor (TR132) with e-value of 2.9e-28 and BLAST sequence identity of 60.0
  misc_feature: SWISSPROT Homolog: GASA2_ARATH Gibberellin-regulated protein 2 precursor with e-value of 3.9e-17 and BLAST sequence identity of 43.6
  misc_feature: SWISSPROT Homolog: GASA3_ARATH Gibberellin-regulated protein 3 precursor with e-value of 1.7e-16 and BLAST sequence identity of 42.3
  misc_feature 77846:<222: Transcription Factor
  misc_feature (1)..(72): Functional Homolog of  Ceres CLONE ID no. 18663 at SEQ ID NO. 754 with e-value of 1.89E-30 and BLAST sequence identity of 76.8
MYGATQGSLRPQECAPRCTTRCSATAYKKPCLFFCQKCCAKCLCVPPGTYGNKQSCPCYNNWKTKRGGPKCP

SEQ ID NO: 730 - DNA, 288 bp, Populus balsamifera subsp. trichocarpa
  misc_feature (1)..(288): Ceres ANNOT ID no. 1506740
  misc_feature 77887:<222: Transcription Factor
atggcaacagcatttctatctcataatcttcttgtgactaatcatgcacaccttgccaaccttttcaggctaacatcacagaggctccaacccctcagccccaaccaaatacaaatagcaaccgtccaccgatgctccaagacagccttcaagaagccatgcatgttcttctgccaaaagtgctgtgccaagtgcttgtgtgtgcctgctggaacttatgggaacaagcaatcttgtccctgctacaacaactggaagaccaagaggggaggccccaagtgcccttga

SEQ ID NO: 731 - protein, 95 aa, Populus balsamifera subsp. trichocarpa
  misc_feature (1)..(95): Ceres ANNOT ID no. 1506740
  misc_feature (1)..(95): Pfam Name: GASA Pfam Description: Gibberellin regulated protein
  misc_feature: SWISSPROT Homolog: GASA4_ARATH Gibberellin-regulated protein 4 precursor with e-value of 8.2e-33 and BLAST sequence identity of 57.5
  misc_feature: SWISSPROT Homolog: GAST1_LYCES GAST1 protein precursor with e-value of 1.4e-28 and BLAST sequence identity of 65.0
  misc_feature: SWISSPROT Homolog: RSI1_LYCES RSI-1 protein precursor (TR132) with e-value of 2.9e-28 and BLAST sequence identity of 60.0
  misc_feature: SWISSPROT Homolog: GASA2_ARATH Gibberellin-regulated protein 2 precursor with e-value of 3.9e-17 and BLAST sequence identity of 43.6
  misc_feature: SWISSPROT Homolog: GASA3_ARATH Gibberellin-regulated protein 3 precursor with e-value of 1.7e-16 and BLAST sequence identity of 42.3
  misc_feature 77957:<222: Transcription Factor
  misc_feature (1)..(95): Functional Homolog of  Ceres CLONE ID no. 18663 at SEQ ID NO. 754 with e-value of 2.40E-25 and BLAST sequence identity of 84.6
MATAFLSHNLLVTNHAHLANLFRLTSQRLQPLSPNQIQIATVHRCSKTAFKKPCMFFCQKCCAKCLCVPAGTYGNKQSCPCYNNWKTKRGGPKCP

SEQ ID NO: 732 - protein, 136 aa, Arabidopsis thaliana
  misc_feature (1)..(136): Ceres CLONE ID no. 18903
  misc_feature (1)..(136): Also Known As Ceres CDNA ID no. 23357249
  misc_feature (1)..(136): Also Known As Ceres GEMINI ID 531E7
  misc_feature (37)..(108): Pfam Name: RRM_1 Pfam Description: RNA recognition motif. (a.k.a. RRM RBD, or RNP domain)
  misc_feature 78022:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MAFCNKLSGILRQGVSHSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 733 - DNA, 396 bp, Populus balsamifera subsp. trichocarpa
  misc_feature (1)..(396): Ceres ANNOT ID no. 1490030
  misc_feature 78075:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggctttctttaacaagtttgggagcctagtcaggcagtcagtttcccagaatgggcaagttccaatggcatctatgctgaactctattcgctgcatgtcttcatcaaagcttttcattggagggcttgcatggtcaactgatgatcaatccctcaaggatgcattttctggctttggggaagtgactgaggcaagagttatcactgatagagacactgggaggtctcgtggattcgggtttgttagttacgaaagcactgaatctgccagtgaagcattgtcagcaatggatggccaggaattgggaggaagaaacattcgcgtgggttatgccaccgacaagagacaaccacaaccttacaatagcaattacggtgggaatccagattattga

SEQ ID NO: 734 - protein, 131 aa, Populus balsamifera subsp. trichocarpa
  misc_feature (1)..(131): Ceres ANNOT ID no. 1490030
  misc_feature (38)..(109): Pfam Name: RRM_1 Pfam Description: RNA recognition motif. (a.k.a. RRM RBD, or RNP domain)
  misc_feature: SWISSPROT Homolog: GRP2_ARATH Glycine-rich RNA-binding protein 2, (AtGRP2) with e-value of 5.8e-54 and BLAST sequence identity of 71.6
  misc_feature: SWISSPROT Homolog: RT19_ARATH 40S ribosomal protein S19, with e-value of 4.5e-32 and BLAST sequence identity of 61.7
  misc_feature: SWISSPROT Homolog: GRPA_MAIZE Glycine-rich RNA-binding, abscisic acid-inducible protein with e-value of 1.6e-27 and BLAST sequence identity of 59.8
  misc_feature: SWISSPROT Homolog: GRP2_SORBI Glycine-rich RNA-binding protein 2 with e-value of 4.3e-27 and BLAST sequence identity of 59.6
  misc_feature: SWISSPROT Homolog: GRP1_DAUCA Glycine-rich RNA-binding protein with e-value of 5.5e-27 and BLAST sequence identity of 57.8
  misc_feature 78158:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(131): Functional Homolog of  Ceres CLONE ID no. 18903 at SEQ ID NO. 761 with e-value of 2.30E-34 and BLAST sequence identity of 59.3
MAFFNKFGSLVRQSVSQNGQVPMASMLNSIRCMSSSKLFIGGLAWSTDDQSLKDAFSGFGEVTEARVITDRDTGRSRGFGFVSYESTESASEALSAMDGQELGGRNIRVGYATDKRQPQPYNSNYGGNPDY

SEQ ID NO: 735 - protein, 405 aa, Arabidopsis thaliana
  misc_feature (1)..(405): Ceres CLONE ID no. 19116
  misc_feature (9)..(393): Pfam Name: TAP42 Pfam Description: TAP42-like family
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Oval Shaped Useful for making plants with increased biomass and foliage
MGGLAMEEMPLSVLFEQARKIHLAASESGVDQDVVKKGCEMFQKCEDMIGKLALFSSNETKEDISTNNLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEEREAWLSSINLAICKAIDLLEMLKREEEMLSAIKERQLKDGEGGFSRDALDDRTKKAETWHRDAAARIQYSKPAQPITCATFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDDEPVMKARAFDDWKDDNPRGAGNKKLTPCG

SEQ ID NO: 736 - DNA, 1293 bp, Populus balsamifera subsp. trichocarpa
  misc_feature (1)..(1293): Ceres ANNOT ID no. 1467522
  misc_feature 78360:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Oval Shaped Useful for making plants with increased biomass and foliage
atgaaaacggaggacatgccccttccttccctcttcgatgaagcttcaaaaatccatgtaaaagcaaccgaatctggttccagtgatcaggaattggtgaagaagggaatcgaatctctggagaaatgtgaggaaatgattagtaaactgggtctgttttcttctaatgagactaaggaggatattagcactacaaatctcaagtatattctggtgaagttggaacgcttgaggaggggaacgaacagtgttgttgctgatttggtttttgctttgttgtgtatggtgagggttatggtgccattctatctggcagagctggctgaaaaaattacgcaggatgataggatacaaattttaaaggcttcccaagcaaagttaaaggaattcctctcattttgtgaggcaatggaacttgtaccggaggaggagttgcaagcatcttctcaaggggctccaaatacttttgtagatcgaagggccctaaagattgccagatacaaacgccaaagagctgctgaggcaaagctggaggaaataaaggagtggaaagagaggcgtggtcgttcaactaaagctgcagcggtatcaactccagtcgaggcaggggaggaagacgtgctggatgatgatggagaagaagagcgagaggcttggattactaccatctctttggctatttgtaaggcaatcgatctactggaaatgttaaagaaggaggaagaaatgcttttggctgtaaaggaaagacaactaaaggaagggggcaaagctttttcccagactattcttgatgaacgtgccaagaaagctgaaaattggcatcgtgatgctgcagtgaaagcaagatatactcaaccagcacagcctatcacatgtgctacttttgctcaagatgttctagaagggagagcaaaggtttcgcaagcacatgatcataagcacgtgccaattacatttggaccagcaagtcttgtgggtggaagcctaactagcgaaagggaaaggatgagagcacaggtcttccaacctggccataggttaccaaccatgagcatagaagaagccgggttaaaggagatggagattatgaataaatggcaagagagaaatgctgaactcatggaagaagccaactctgcatggtacaaggacaatccaaaatcaaaactcagtgaagaagatgatgatgaagatgacgatgctgctgtgcagaaagcaagagcatgggatgactggaaagatgatcatcctcggggtgctggcaataagaagctcaccccttgtggttaa

SEQ ID NO: 737 - protein, 430 aa, Populus balsamifera subsp. trichocarpa
  misc_feature (1)..(430): Ceres ANNOT ID no. 1467522
  misc_feature (6)..(418): Pfam Name: TAP42 Pfam Description: TAP42-like family
  misc_feature: SWISSPROT Homolog: TAP46_ARATH PP2A regulatory subunit TAP46 (2A phosphatase-associated protein of 46 kDa) with e-value of 7.2e-215 and BLAST sequence identity of 99.5
  misc_feature: SWISSPROT Homolog: IGBP1_HUMAN Immunoglobulin-binding protein 1 (CD79a-binding protein 1) (B cell signal transduction molecule alpha 4) (Alpha 4 protein) with e-value of 3.3e-21 and BLAST sequence identity of 25.9
  misc_feature: SWISSPROT Homolog: YCJ5_SCHPO Hypothetical protein C63.05 in chromosome III with e-value of 8.3e-21 and BLAST sequence identity of 28.2
  misc_feature: SWISSPROT Homolog: IGB1B_MOUSE Immunoglobulin-binding protein 1b (CD79a-binding protein 1b) (Alpha 4-b protein) (Alpha4-b) with e-value of 1.3e-18 and BLAST sequence identity of 28.6
  misc_feature: SWISSPROT Homolog: IGBP1_MOUSE Immunoglobulin-binding protein 1 (CD79a-binding protein 1) with e-value of 5.4e-18 and BLAST sequence identity of 28.1
  misc_feature: SWISSPROT Homolog: IGBP1_MOUSE Alpha4 phosphoprotein Lymphocyte signal transduction molecule alpha 4 (p52)
  misc_feature 78516:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(430): Functional Homolog of  Ceres CLONE ID no. 19116 at SEQ ID NO. 764 with e-value of 6.69E-147 and BLAST sequence identity of 71.3
MKTEDMPLPSLFDEASKIHVKATESGSSDQELVKKGIESLEKCEEMISKLGLFSSNETKEDISTTNLKYILVKLERLRRGTNSVVADLVFALLCMVRVMVPFYLAELAEKITQDDRIQILKASQAKLKEFLSFCEAMELVPEEELQASSQGAPNTFVDRRALKIARYKRQRAAEAKLEEIKEWKERRGRSTKAAAVSTPVEAGEEDVLDDDGEEEREAWITTISLAICKAIDLLEMLKKEEEMLLAVKERQLKEGGKAFSQTILDERAKKAENWHRDAAVKARYTQPAQPITCATFAQDVLEGRAKVSQAHDHKHVPITFGPASLVGGSLTSERERMRAQVFQPGHRLPTMSIEEAGLKEMEIMNKWQERNAELMEEANSAWYKDNPKSKLSEEDDDEDDDAAVQKARAWDDWKDDHPRGAGNKKLTPCG

SEQ ID NO: 738 - DNA, 1341 bp, Populus balsamifera subsp. trichocarpa
  misc_feature (1)..(1341): Ceres ANNOT ID no. 1526421
  misc_feature 78665:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Oval Shaped Useful for making plants with increased biomass and foliage
atggaagacttgccccttccttctctcttcgatcaagcttcaaaaatccatctaaaagcaacagaatctggttctaatgataaggaattggtgaagaagggaattgaagcactggagaattgtgaggaaatgattagtaaattgggtttattttcttctaatgagactaaagaggatattagcactaccaatctcaagtatattctggttccattttatctggcagagctgactgaaaacattgctcaggatgataggatacaaattttaaaggcttcccaggcaaagttaaaggaattcctctcattttgtgaggcaatggaacttgtaccagaggaggagttgcaaacattttctcaagggactccaaatacttttgcagatcgaagggctctaaaggtagcttcaagtctttgtcaatactttcttacaatcaaaattactctgatgcatcatagttttgttgagcttcctttgcaacatggggcttttttagctcttgcactcacaaccccttcatgtgcctctattcagattgccagatacagacgccaaatagctgcagaagcaaagctggagaaaatgaaggagcagaaagagcggcgttttcattcaactaaagctgcagcagtatcaactctggttgaggccggggaggaagacctgctggatgatgatggagaagaagagcgggaggcttggattattaccatctctttggctatctgtaaggcaatcgatctgctggaaatgttaaagaaagaggaagaaatgctttcagatgtaaaggaaagacagctaaagggaggggacaaagctttttcccagatgattcttgatgaacgtgccaagaaagctgaagattggcatcgtgatgctgcagtaaaagcaaggtatactcaaccggcgccgcctatcacatgtgctacttttgctcaagatgttttagaagggagagcaaaggtttcagaagcacatgatcacaagcacctgccagtgacattcggaccagcaagtattgtgggtggaagcctatcaaacgaaagggaaaggatgacagcacaggtcttccaacctggccataggttgccaaccatgagtatagaagaagctgggttgaaggagatggagattatgaataaatggcaagagagaaacgttaaattcatggaagaagcaaactctgcatggtacaaggacaatcagaaattaaaaccaagcgaagaagaagaggatgaagatgatgacgatgctgctgtagagaaggcaagagcatttgatgactggaaagatgatcatcctcgcggtgctggcaataagaagctcaccccttgtggttaa

SEQ ID NO: 739 - protein, 446 aa, Populus balsamifera subsp. trichocarpa
  misc_feature (1)..(446): Ceres ANNOT ID no. 1526421
  misc_feature (4)..(133): Pfam Name: TAP42 Pfam Description: TAP42-like family
  misc_feature: SWISSPROT Homolog: TAP46_ARATH PP2A regulatory subunit TAP46 (2A phosphatase-associated protein of 46 kDa) with e-value of 7.2e-215 and BLAST sequence identity of 99.5
  misc_feature: SWISSPROT Homolog: IGBP1_HUMAN Immunoglobulin-binding protein 1 (CD79a-binding protein 1) (B cell signal transduction molecule alpha 4) (Alpha 4 protein) with e-value of 3.3e-21 and BLAST sequence identity of 25.9
  misc_feature: SWISSPROT Homolog: YCJ5_SCHPO Hypothetical protein C63.05 in chromosome III with e-value of 8.3e-21 and BLAST sequence identity of 28.2
  misc_feature: SWISSPROT Homolog: IGB1B_MOUSE Immunoglobulin-binding protein 1b (CD79a-binding protein 1b) (Alpha 4-b protein) (Alpha4-b) with e-value of 1.3e-18 and BLAST sequence identity of 28.6
  misc_feature: SWISSPROT Homolog: IGBP1_MOUSE Immunoglobulin-binding protein 1 (CD79a-binding protein 1) with e-value of 5.4e-18 and BLAST sequence identity of 28.1
  misc_feature: SWISSPROT Homolog: IGBP1_MOUSE Alpha4 phosphoprotein Lymphocyte signal transduction molecule alpha 4 (p52)
  misc_feature 78824:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(446): Functional Homolog of  Ceres CLONE ID no. 19116 at SEQ ID NO. 764 with e-value of 2.00E-138 and BLAST sequence identity of 69.75
MEDLPLPSLFDQASKIHLKATESGSNDKELVKKGIEALENCEEMISKLGLFSSNETKEDISTTNLKYILVPFYLAELTENIAQDDRIQILKASQAKLKEFLSFCEAMELVPEEELQTFSQGTPNTFADRRALKVASSLCQYFLTIKITLMHHSFVELPLQHGAFLALALTTPSCASIQIARYRRQIAAEAKLEKMKEQKERRFHSTKAAAVSTLVEAGEEDLLDDDGEEEREAWIITISLAICKAIDLLEMLKKEEEMLSDVKERQLKGGDKAFSQMILDERAKKAEDWHRDAAVKARYTQPAPPITCATFAQDVLEGRAKVSEAHDHKHLPVTFGPASIVGGSLSNERERMTAQVFQPGHRLPTMSIEEAGLKEMEIMNKWQERNVKFMEEANSAWYKDNQKLKPSEEEEDEDDDDAAVEKARAFDDWKDDHPRGAGNKKLTPCG

SEQ ID NO: 740 - protein, 338 aa, Arabidopsis thaliana
  misc_feature (1)..(338): Ceres CLONE ID no. 19143
  misc_feature (67)..(257): Pfam Name: Ubie_methyltran Pfam Description: ubiE/COQ5 methyltransferase family
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
MASLMLNGAITFPKGLGSPGSNLHARSIPRPTLLSVTRTSTPRLSVATRCSSSSVSSSRPSAQPRFIQHKKEAYWFYRFLSIVYDHVINPGHWTEDMRDDALEPADLSHPDMRVVDVGGGTGFTTLGIVKTVKAKNVTILDQSPHQLAKAKQKEPLKECKIVEGDAEDLPFPTDYADRYVSAGSIEYWPDPQRGIREAYRVLKIGGKACLIGPVYPTFWLSRFFSDVWMLFPKEEEYIEWFKNAGFKDVQLKRIGPKWYRGVRRHGLIMGYSVTGVKPASGDSPLQLGPKEEDVEKPVNNPFSFLGRFLLGTLAAAWFVLIPIYMWIKDQIVPKDQPI

SEQ ID NO: 741 - DNA, 1023 bp, Populus balsamifera subsp. trichocarpa
  misc_feature (1)..(1023): Ceres ANNOT ID no. 1442860
  misc_feature 79077:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
atggcctcctcaatgctcaatggagctgaaaacctcactctgattagaggcataacccctaaagggctaggctttggggggtctgatttgcaagggaggcacttttctaaagtgaatgcagtcgctagtactagaatttcaaaggcaagaactttgacacccatgtgcagtttatcagcctctaggccagcttcccagcccagatttatccaacacaagaaagaggccttttggttctataggtttctctctattgtgtacgaccatgtgataaatcctgggcactggactgaggacatgagagatgaggcacttgaacctgcagatctcagtaacaggaatatgttggtggtggatgttggtggtggcactggtttcaccactttgggtatagttaagcacgtggatgccaaaaatgttaccatccttgatcaatctccacaccaacttgcaaaggcaaagcagaaagagcctttgaaggattgtaagattattgagggcgatgctgaggatctaccatttcgtactgattatgcggatagatatgtgtctgctgggagtattgagtactggcctgatccacaacggggcatcaaggaagcatacagggttttgaaactagggggcaaagcctgcttaattggtccagtgtacccaacattctggttgtctcgcttctttgctgatgcttggatgctcttcccaaaggaggaagagtacatcgaatggttccagaaggctggatttaaggatgttcaactgaagaggattggcccaaaatggtatcgtggtgttcgtaggcatgggctgatcatgggatgttctgtaaccggtgttaaacctgcatctggagattctcctttgcagcttggtccaaaggcagaggacgtgacagagcctgtaaagccattcgtgttccttatgcgcctcattttgggtgccatggcagcaacgtactatgtgttggttcccatttatatgtggctcaaagatcaaattgtacccaaaggtagaccaatctaa

SEQ ID NO: 742 - protein, 340 aa, Populus balsamifera subsp. trichocarpa
  misc_feature (1)..(340): Ceres ANNOT ID no. 1442860
  misc_feature (70)..(260): Pfam Name: Ubie_methyltran Pfam Description: ubiE/COQ5 methyltransferase family
  misc_feature: SWISSPROT Homolog: IN37_SPIOL 37 kDa inner envelope membrane protein, chloroplast precursor (E37) with e-value of 2.8e-135 and BLAST sequence identity of 73.5
  misc_feature: SWISSPROT Homolog: UBIE_CHLTE Menaquinone biosynthesis methyltransferase ubiE (EC 2.1.1.-) with e-value of 3.5e-11 and BLAST sequence identity of 32.7
  misc_feature: SWISSPROT Homolog: UBIE_RHIME Ubiquinone/menaquinone biosynthesis methyltransferase ubiE (EC 2.1.1.-) with e-value of 8.7e-10 and BLAST sequence identity of 34.6
  misc_feature: SWISSPROT Homolog: UBIE_BARQU Ubiquinone/menaquinone biosynthesis methyltransferase ubiE (EC 2.1.1.-) with e-value of 1.7e-09 and BLAST sequence identity of 34.5
  misc_feature: SWISSPROT Homolog: UBIE_AGRT5 Ubiquinone/menaquinone biosynthesis methyltransferase ubiE (EC 2.1.1.-) with e-value of 3.3e-09 and BLAST sequence identity of 31.4
  misc_feature 79191:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature (1)..(340): Functional Homolog of  Ceres CLONE ID no. 19143 at SEQ ID NO. 769 with e-value of 2.10E-143 and BLAST sequence identity of 80.4
MASSMLNGAENLTLIRGITPKGLGFGGSDLQGRHFSKVNAVASTRISKARTLTPMCSLSASRPASQPRFIQHKKEAFWFYRFLSIVYDHVINPGHWTEDMRDEALEPADLSNRNMLVVDVGGGTGFTTLGIVKHVDAKNVTILDQSPHQLAKAKQKEPLKDCKIIEGDAEDLPFRTDYADRYVSAGSIEYWPDPQRGIKEAYRVLKLGGKACLIGPVYPTFWLSRFFADAWMLFPKEEEYIEWFQKAGFKDVQLKRIGPKWYRGVRRHGLIMGCSVTGVKPASGDSPLQLGPKAEDVTEPVKPFVFLMRLILGAMAATYYVLVPIYMWLKDQIVPKGRPI

SEQ ID NO: 743 - DNA, 1077 bp, Populus balsamifera subsp. trichocarpa
  misc_feature (1)..(1077): Ceres ANNOT ID no. 1459442
  misc_feature 79297:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
atggcttctttattgctcaatggacctcaaaatgtgaacttcattggtggcataaccccatctgggctaggttttgtaggttcaaatcttcatgttagttgtttttcgtcgaaaaatatagtaccatgccataataggaatcaaaattcaagaatcttagcacccagatgttctttatcatctgcaaggcctgcttctcagcctaggttcatacaacacaagaaagaggcattttggttctatagattcctgtctatagtgtatgatcatatcattaaccctggtcattggactgaggatatgagggatgaggcacttgagcctgctgacctctatgataggaggatgacagtggtagatgtcggtggtggtactgggttcactactttgggtattgttaaacatgtggatgccaagaatgttacaattctagaccagtcacctcaccagcttgctaaggctaagcagaagaagcccttgaaggaatgcaagataattgaaggggatgctgaggatcttcccttccctactgattatgcagatcgttatgtatccgctggaagtattgagtactggccggatccccaacgtggcatcaaagaagcatacagagtgctgaaaataggagggaaagcatgtattataggtcccgtctacccaaccttctggctgtctagattttttgctgatgtgtggatgctcttcccaaaagaggaagagtacattgaatggtttaaaaaggctggatttaaagatgttaaactgaaaaggattggtccaaaatggtatcgtggtgtccgtcggcatggtttgataatgggttgctctgtgactggcgtaaagccactatcaggagactctcccctgcagaaaagggaggtaatttcatcagaagttcagatttatgagaagtgcgatgcacttggtccaaaggcagaggagattgagaagccagtgaatccattggtgttccttatgcgattcattctcggggcaatggcagcaacatactttattctggttccaatttacatgtggctcaaagatcaaattgtcccaaagggcatgcctatatga

SEQ ID NO: 744 - protein, 358 aa, Populus balsamifera subsp. trichocarpa
  misc_feature (1)..(358): Ceres ANNOT ID no. 1459442
  misc_feature (116)..(210): Pfam Name: Ubie_methyltran Pfam Description: ubiE/COQ5 methyltransferase family
  misc_feature: SWISSPROT Homolog: IN37_SPIOL 37 kDa inner envelope membrane protein, chloroplast precursor (E37) with e-value of 2.8e-135 and BLAST sequence identity of 73.5
  misc_feature: SWISSPROT Homolog: UBIE_CHLTE Menaquinone biosynthesis methyltransferase ubiE (EC 2.1.1.-) with e-value of 3.5e-11 and BLAST sequence identity of 32.7
  misc_feature: SWISSPROT Homolog: UBIE_RHIME Ubiquinone/menaquinone biosynthesis methyltransferase ubiE (EC 2.1.1.-) with e-value of 8.7e-10 and BLAST sequence identity of 34.6
  misc_feature: SWISSPROT Homolog: UBIE_BARQU Ubiquinone/menaquinone biosynthesis methyltransferase ubiE (EC 2.1.1.-) with e-value of 1.7e-09 and BLAST sequence identity of 34.5
  misc_feature: SWISSPROT Homolog: UBIE_AGRT5 Ubiquinone/menaquinone biosynthesis methyltransferase ubiE (EC 2.1.1.-) with e-value of 3.3e-09 and BLAST sequence identity of 31.4
  misc_feature 79411:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature (1)..(358): Functional Homolog of  Ceres CLONE ID no. 19143 at SEQ ID NO. 769 with e-value of 1.40E-139 and BLAST sequence identity of 80.1
MASLLLNGPQNVNFIGGITPSGLGFVGSNLHVSCFSSKNIVPCHNRNQNSRILAPRCSLSSARPASQPRFIQHKKEAFWFYRFLSIVYDHIINPGHWTEDMRDEALEPADLYDRRMTVVDVGGGTGFTTLGIVKHVDAKNVTILDQSPHQLAKAKQKKPLKECKIIEGDAEDLPFPTDYADRYVSAGSIEYWPDPQRGIKEAYRVLKIGGKACIIGPVYPTFWLSRFFADVWMLFPKEEEYIEWFKKAGFKDVKLKRIGPKWYRGVRRHGLIMGCSVTGVKPLSGDSPLQKREVISSEVQIYEKCDALGPKAEEIEKPVNPLVFLMRFILGAMAATYFILVPIYMWLKDQIVPKGMPI

SEQ ID NO: 745 - DNA, 1188 bp, Populus balsamifera subsp. trichocarpa
  misc_feature (1)..(1188): Ceres ANNOT ID no. 1452580
  misc_feature 79520:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
atgacctcctcagtgttcaatggagctgaaaacctcgctctaataagaggcataacccctaaagggttaggctttttggggtcagatttgcaagggaggcacttttctaaagtgagtttaatctctagcactagaatctcaaaggcaagaactttaacacccaagtgcagtttatcagcccctaggccagcttcacagcctaggtttatccaacacaagaaagaggctttttggttctataggtttctttcaattgtgtatgaccatgtcataaaccctgggcactggaccgaggacatgagagatgaggcacttgagcctgctgatctcagtgacaggaatacgatagtggtggatgttggtggcggcactggtttcaccactttgggtatagttaagcatgtggacgccaaaaatgtaaccatccttgatcaatctccgcaccagcttgcaaaggccaagcagaaagagcctttgaaggattgtaagattgttgagggcgatgccgaggatctaccatttcctaccgattatgctgatagatatgtgtctgctgggagtattgagtactggcctgatccccagcgtggcatcaaggaagcgtacagggttttgaagctagaaggtaaagcctgcttaattggtccagtgcacccaacattctggttgtctcgcttctttgctgatgtctggatgctcttccctaaggaggaagagtacattgagtggttccagaaggctgggtttaaggatgttcaactaaagaggattggtccaaagtggtatcgtggtgttcgtaggcacgggctgatcatgggatgttctgtaacaggtgttaaacctgcatctggagattctcctttgcaggtaactattcttgacttaccattgcatgataataactacccactttactctagctttgcatgtcatttaaatggagcttggcccaaaggcagaggatgtgtcaaagccagcgaacccgttcgtcttctttctgcgcttcattttgggtgccatggcagcaacgtactatgtgttggttcccatatatatgtggctcaaagatcagattgtacccaaagccatgccaaggctgctcggatatggagtttcttccaacaaaataggactaaagccactatgcttgagacaaagcgatgctgctcttctatgaagagctcctga

SEQ ID NO: 746 - protein, 395 aa, Populus balsamifera subsp. trichocarpa
  misc_feature (1)..(395): Ceres ANNOT ID no. 1452580
  misc_feature (70)..(260): Pfam Name: Ubie_methyltran Pfam Description: ubiE/COQ5 methyltransferase family
  misc_feature: SWISSPROT Homolog: IN37_SPIOL 37 kDa inner envelope membrane protein, chloroplast precursor (E37) with e-value of 2.8e-135 and BLAST sequence identity of 73.5
  misc_feature: SWISSPROT Homolog: UBIE_CHLTE Menaquinone biosynthesis methyltransferase ubiE (EC 2.1.1.-) with e-value of 3.5e-11 and BLAST sequence identity of 32.7
  misc_feature: SWISSPROT Homolog: UBIE_RHIME Ubiquinone/menaquinone biosynthesis methyltransferase ubiE (EC 2.1.1.-) with e-value of 8.7e-10 and BLAST sequence identity of 34.6
  misc_feature: SWISSPROT Homolog: UBIE_BARQU Ubiquinone/menaquinone biosynthesis methyltransferase ubiE (EC 2.1.1.-) with e-value of 1.7e-09 and BLAST sequence identity of 34.5
  misc_feature: SWISSPROT Homolog: UBIE_AGRT5 Ubiquinone/menaquinone biosynthesis methyltransferase ubiE (EC 2.1.1.-) with e-value of 3.3e-09 and BLAST sequence identity of 31.4
  misc_feature 79638:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature (1)..(395): Functional Homolog of  Ceres CLONE ID no. 19143 at SEQ ID NO. 769 with e-value of 7.60E-123 and BLAST sequence identity of 82.1
MTSSVFNGAENLALIRGITPKGLGFLGSDLQGRHFSKVSLISSTRISKARTLTPKCSLSAPRPASQPRFIQHKKEAFWFYRFLSIVYDHVINPGHWTEDMRDEALEPADLSDRNTIVVDVGGGTGFTTLGIVKHVDAKNVTILDQSPHQLAKAKQKEPLKDCKIVEGDAEDLPFPTDYADRYVSAGSIEYWPDPQRGIKEAYRVLKLEGKACLIGPVHPTFWLSRFFADVWMLFPKEEEYIEWFQKAGFKDVQLKRIGPKWYRGVRRHGLIMGCSVTGVKPASGDSPLQVTILDLPLHDNNYPLYSSFACHLNGAWPKGRGCVKASEPVRLLSALHFGCHGSNVLCVGSHIYVAQRSDCTQSHAKAARIWSFFQQNRTKATMLETKRCCSSMKSS

SEQ ID NO: 747 - protein, 238 aa, Arabidopsis thaliana
  misc_feature (1)..(238): Ceres CLONE ID no. 19188
  misc_feature (31)..(208): Pfam Name: TK Pfam Description: Thymidine kinase
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
MATLKASFLIKTLDNDVTGDFLSDLERRGSGAVHVIMGPMFSGKSTSLLRRIKSEISDGRSVAMLKSSKDTRYAKDSVVTHDGIGFPCWALPDLMSFPEKFGLDAYNKLDVIGIDEAQFFGDLYEFCCKVADDDGKIVIVAGLDGDYLRRSFGAVLDIIPIADSVTKLTARCEVCGHKAFFTLRKNCDTRTELIGGADVYMPVCRKHYITNHIVIKASKKVLEDSDKARAESCVAATI

SEQ ID NO: 748 - DNA, 642 bp, Populus balsamifera subsp. trichocarpa
  misc_feature (1)..(642): Ceres ANNOT ID no. 1445089
  misc_feature 79847:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
atggctgctttgacttcgattaacggtggccgctgtgaggccggtgaagtacatgtcatcattggccccatgtttgctggcaaaaccaccgatttactccgtcgtatcgaatctgagagcagcagtggcagaaatgtggcaatgataaaatcaagcaaggacacaagatatgcaaacgattcggtggtcacacatgatggcttgaaatttccttgctggtctttgccagatctcacctctttccatcacaagcttggagatgatgaatatcacaagcttgacgtgattggcattgatgaggctcaattttttgaagatctttatgaattctgttgcaaggctgctgatcatgatgggaaaactataattgtagctggccttgatggggattatttgaggaggagcttcggatctgtgcttgatgtaatacctcttgctgatacggtaacaaagctgactgcaaggtgtgaactttgtggcaagcgagccttctttaccttgaggaagacagcagagacccagacagaattgattggaggatctgatctctacatgcctgtttgccgccagcactatgtcagtgggcaagcagtcatagaatcaacaaggaacgtccttgaatcctataaggtttcccactga

SEQ ID NO: 749 - protein, 213 aa, Populus balsamifera subsp. trichocarpa
  misc_feature (1)..(213): Ceres ANNOT ID no. 1445089
  misc_feature (15)..(192): Pfam Name: TK Pfam Description: Thymidine kinase
  misc_feature: SWISSPROT Homolog: KITH_ORYSA Thymidine kinase (EC 2.7.1.21) with e-value of 6.3e-74 and BLAST sequence identity of 68.3
  misc_feature: SWISSPROT Homolog: KITH_SWPVK Thymidine kinase (EC 2.7.1.21) with e-value of 2.3e-35 and BLAST sequence identity of 44.2
  misc_feature: SWISSPROT Homolog: KITH_CHICK Thymidine kinase, cytosolic (EC 2.7.1.21) with e-value of 1.5e-33 and BLAST sequence identity of 45.9
  misc_feature: SWISSPROT Homolog: KITH_VARV Thymidine kinase (EC 2.7.1.21) with e-value of 2.4e-33 and BLAST sequence identity of 45.0
  misc_feature: SWISSPROT Homolog: KITH_YMTV Thymidine kinase (EC 2.7.1.21) with e-value of 1.0e-32 and BLAST sequence identity of 46.4
  misc_feature 79961:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature (1)..(213): Functional Homolog of  Ceres CLONE ID no. 19188 at SEQ ID NO. 776 with e-value of 1.50E-78 and BLAST sequence identity of 73.7
MAALTSINGGRCEAGEVHVIIGPMFAGKTTDLLRRIESESSSGRNVAMIKSSKDTRYANDSVVTHDGLKFPCWSLPDLTSFHHKLGDDEYHKLDVIGIDEAQFFEDLYEFCCKAADHDGKTIIVAGLDGDYLRRSFGSVLDVIPLADTVTKLTARCELCGKRAFFTLRKTAETQTELIGGSDLYMPVCRQHYVSGQAVIESTRNVLESYKVSH

SEQ ID NO: 750 - protein, 195 aa, Arabidopsis thaliana
  misc_feature (1)..(195): Ceres CLONE ID no. 19234
  misc_feature (97)..(145): Pfam Name: Rubredoxin Pfam Description: Rubredoxin
  misc_feature: Utility: Cold Growth Useful for making plants with increased tolerance to cold stress
  misc_feature: Phenotype: WHOLE PLANT - Cold Growth Useful for making plants with increased tolerance to cold stress
MASATFSFCPLSQSHPHSSLIKPTPFLRYGKKLHHLHHHIFITISYPSHHSRYLAVSRDDAATPLSSSDQTQETETKEVEDTIEKRRMEEKFAVLNTGIYECRSCGYKYDESAGDPSYPIPPGFQFDKLPEDWRCPTCGAAQSFFESKMVEIAGFAQNQQYGLGGNALTSGQKTGLIFGSLLLFFALFLSGYFIQ

SEQ ID NO: 751 - DNA, 594 bp, Populus balsamifera subsp. trichocarpa
  misc_feature (1)..(594): Ceres ANNOT ID no. 1469459
  misc_feature: Utility: Cold Growth Useful for making plants with increased tolerance to cold stress
  misc_feature 80136:<222: Transcription Factor
  misc_feature: Phenotype: WHOLE PLANT - Cold Growth Useful for making plants with increased tolerance to cold stress
atggcttgtgcagccgcaagagccactttgtccttccaccttccacaactttcccctccaaaatccagaaaccatttctcaaagctatcattcctctccattcataaaccccaaaagactcatcttttctctctacactccattgatgtctccagagaagacaagacgccaactttatcagattcaacccaaaccaatccaccaacagagtctcctcccgaagaagaagaagaagaagaagaagagccagagttcgataagagaaggttggaagagaagtttgcagttttaaacactgggatttatgagtgtaggtcttgtggctacaaatatgatgaggcagttggtgacccatcatatccattaccaccagggtttcagtttgacaagttacctgatgattggaggtgtccaacctgtggggctgcaaagagtttcttcgagagtaaaagtgtggagattgctgggtttgcacagaaccagcagtatggattaggaggcaatgcacttacttctggtcaaaagactattttgatatatgggaccttgttgttcttctttgttctgttcttgtcagggtattttctgcaatag

SEQ ID NO: 752 - protein, 197 aa, Populus balsamifera subsp. trichocarpa
  misc_feature (1)..(197): Ceres ANNOT ID no. 1469459
  misc_feature (99)..(147): Pfam Name: Rubredoxin Pfam Description: Rubredoxin
  misc_feature: SWISSPROT Homolog: RUBR_SYNY3 Rubredoxin (Rd) with e-value of 2.0e-20 and BLAST sequence identity of 43.8
  misc_feature: SWISSPROT Homolog: RUBR_ANAVT Rubredoxin (Rd) with e-value of 6.2e-19 and BLAST sequence identity of 45.5
  misc_feature: SWISSPROT Homolog: RUBR_ANASP Rubredoxin (Rd) with e-value of 1.0e-18 and BLAST sequence identity of 45.5
  misc_feature: SWISSPROT Homolog: RUBR_DESGI Rubredoxin (Rd) with e-value of 2.3e-12 and BLAST sequence identity of 52.0
  misc_feature: SWISSPROT Homolog: RUBR4_RHOER Rubredoxin 4 with e-value of 2.9e-12 and BLAST sequence identity of 52.7
  misc_feature: Utility: Cold Growth Useful for making plants with increased tolerance to cold stress
  misc_feature 80232:<222: Transcription Factor
  misc_feature: Phenotype: WHOLE PLANT - Cold Growth Useful for making plants with increased tolerance to cold stress
  misc_feature (1)..(197): Functional Homolog of  Ceres CLONE ID no. 19234 at SEQ ID NO. 779 with e-value of 8.80E-58 and BLAST sequence identity of 71.5
MACAAARATLSFHLPQLSPPKSRNHFSKLSFLSIHKPQKTHLFSLHSIDVSREDKTPTLSDSTQTNPPTESPPEEEEEEEEEPEFDKRRLEEKFAVLNTGIYECRSCGYKYDEAVGDPSYPLPPGFQFDKLPDDWRCPTCGAAKSFFESKSVEIAGFAQNQQYGLGGNALTSGQKTILIYGTLLFFFVLFLSGYFLQ

SEQ ID NO: 753 - DNA, 606 bp, Populus balsamifera subsp. trichocarpa
  misc_feature (1)..(606): Ceres ANNOT ID no. 1542250
  misc_feature: Utility: Cold Growth Useful for making plants with increased tolerance to cold stress
  misc_feature 80310:<222: Transcription Factor
  misc_feature: Phenotype: WHOLE PLANT - Cold Growth Useful for making plants with increased tolerance to cold stress
atggcttgtgcagctacaagagccactttctctttcaaccttcctcaaggacctcaacttccctctccgaagtccagaacccatctctccaaaatatcattcctttccattcataaaccccaaaagactcattttttctcccttcactccattgatgtctccaaagaagacaagacaccatctttatcagattcaagcctgaccaatccaccagctgagtctcctgttgaagaagaagaagaaggaggaggagaagaaccaaagtttgataagaggcggttagaagagaagtttgcagttttaaacactgggatttatgagtgtaggtcttgtggttacaaatatgacgagtcagttggtgacccatcatatccaataccaccagggtttcagtttgacaagctgcctggtgaatggaggtgtcctacttgtggcgctgcacagagtttctttgtgagtaaaagtgttgagattgctgggtttgcgcagaaccagcagtatggattaggaggcaatgcacttacatctggtcaaaaggctgttctaatatttgggaccttgttcgtcttctttgttttgttcttgtcagggtattttctgcaatag

SEQ ID NO: 754 - protein, 201 aa, Populus balsamifera subsp. trichocarpa
  misc_feature (1)..(201): Ceres ANNOT ID no. 1542250
  misc_feature (103)..(151): Pfam Name: Rubredoxin Pfam Description: Rubredoxin
  misc_feature: SWISSPROT Homolog: RUBR_SYNY3 Rubredoxin (Rd) with e-value of 2.0e-20 and BLAST sequence identity of 43.8
  misc_feature: SWISSPROT Homolog: RUBR_ANAVT Rubredoxin (Rd) with e-value of 6.2e-19 and BLAST sequence identity of 45.5
  misc_feature: SWISSPROT Homolog: RUBR_ANASP Rubredoxin (Rd) with e-value of 1.0e-18 and BLAST sequence identity of 45.5
  misc_feature: SWISSPROT Homolog: RUBR_DESGI Rubredoxin (Rd) with e-value of 2.3e-12 and BLAST sequence identity of 52.0
  misc_feature: SWISSPROT Homolog: RUBR4_RHOER Rubredoxin 4 with e-value of 2.9e-12 and BLAST sequence identity of 52.7
  misc_feature: Utility: Cold Growth Useful for making plants with increased tolerance to cold stress
  misc_feature 80408:<222: Transcription Factor
  misc_feature: Phenotype: WHOLE PLANT - Cold Growth Useful for making plants with increased tolerance to cold stress
  misc_feature (1)..(201): Functional Homolog of  Ceres CLONE ID no. 19234 at SEQ ID NO. 779 with e-value of 1.00E-54 and BLAST sequence identity of 70.4
MACAATRATFSFNLPQGPQLPSPKSRTHLSKISFLSIHKPQKTHFFSLHSIDVSKEDKTPSLSDSSLTNPPAESPVEEEEEGGGEEPKFDKRRLEEKFAVLNTGIYECRSCGYKYDESVGDPSYPIPPGFQFDKLPGEWRCPTCGAAQSFFVSKSVEIAGFAQNQQYGLGGNALTSGQKAVLIFGTLFVFFVLFLSGYFLQ

SEQ ID NO: 755 - protein, 307 aa, Arabidopsis thaliana
  misc_feature (1)..(307): Ceres CLONE ID no. 19340
  misc_feature (1)..(307): Also Known As Ceres CDNA ID no. 23358277
  misc_feature (1)..(307): Also Known As Ceres GEMINI ID 552A11
  misc_feature (118)..(182): Pfam Name: zf-DHHC Pfam Description: DHHC zinc finger domain
  misc_feature 80500:<222: Transcription Factor
  misc_feature: Phenotype: Activates expression of the gene endogenous to the AtHMGS (SEQ ID NO 4144) regalutory region Useful for modulating Terpenoid Biosynthesis
MHRSGTTMAWNVFKFCTALRGLGSIMILLVLGVVGVTYYAVVLTNYGPPLSQGGLDSLAALTILILFHFLLAMLLWSYFSVVFTDPGVVPPNWRPSTDEERGESDPLNSLDFVGLQSDSSSSNPRVRFCRKCNQLKPSRCHHCSVCGRCVLKMDHHCVWVVNCVGALNYKYFLLFLFYTFLETTLVTLVLMPHFIAFFSDEEIPGTPGTLATTFLAFVLNLAFALSVMGFLIMHISLVAGNTTTIEAYEKKTTTKWRYDLGKKKNFEQVFGMDKRYWLIPGYTEEDLRRMPELQGLEYPSKPDFDSQ

SEQ ID NO: 756 - DNA, 915 bp, Populus balsamifera subsp. trichocarpa
  misc_feature (1)..(915): Ceres ANNOT ID no. 1524357
  misc_feature 80585:<222: Transcription Factor
  misc_feature: Phenotype: Activates expression of the gene endogenous to the AtHMGS (SEQ ID NO 4144) regalutory region Useful for modulating Terpenoid Biosynthesis
atgcatagatccagagctgttatggcttggaatgtgttcaaattttgtacggccttaaggggtctaggctcgatcatgatcttgttggtgcttggcgttgttggtgtaacatattatgctgttgttttgaataattatggccctgctttgtatgatggtggcatcgattctctcgtttctcttgctgtcttgatcccattccattctttgttagtgatgctactgtggagttacttttctgttgttttaactgatccggggagcgtgcctcctaattggaggcctgctattgatgaggaaagaggggaggctgacccgttgaatggatcagagtttagtggagtgcagtctgaccaatcaaatcaaagaatccgatattgccggaagtgcaaccagctgaaaccacctcgttgccatcattgttctgtttgtgggaggtgtgtgctaaagatggaccatcattgcgtatgggttgtaaattgtgttggggccttgaattataagtattttcttctatttttgttctacacatttcttgagacaagtcttgtaactttatctctttcaccacactttatagcattctttagtgatggagaaattcctgggactccaggcacccttgcaaccacatttcttgcctttgtcttaaatctggcgtttgcattgagtgttctgggatttctgatcatgcacatatcgcttgtgtctgctaatactacaactattgaggcatacgagaagaagaccaccccaaaatggcgctatgaccttggtcgaaagaagaattttgagcaggctaataagcgatactggttcattccgacttattcagacgatgatttacggcgaatgcctgcacttcagggtcttgaatatccatcgaaacccgactttgattcccaggaattctag

SEQ ID NO: 757 - protein, 304 aa, Populus balsamifera subsp. trichocarpa
  misc_feature (1)..(304): Ceres ANNOT ID no. 1524357
  misc_feature (117)..(180): Pfam Name: zf-DHHC Pfam Description: DHHC zinc finger domain
  misc_feature: SWISSPROT Homolog: ZDH20_HUMAN Probable palmitoyltransferase ZDHHC20 (EC 2.3.1.-) (Zinc finger DHHC domain-containing protein 20) (DHHC-20) with e-value of 1.0e-41 and BLAST sequence identity of 35.3
  misc_feature: SWISSPROT Homolog: ZDHC2_MOUSE Palmitoyltransferase ZDHHC2 (EC 2.3.1.-) (Zinc finger DHHC domain-containing protein 2) (DHHC-2) with e-value of 4.6e-39 and BLAST sequence identity of 33.9
  misc_feature: SWISSPROT Homolog: ZDHC2_RAT Palmitoyltransferase ZDHHC2 (EC 2.3.1.-) (Zinc finger DHHC domain-containing protein 2) (DHHC-2) with e-value of 5.8e-39 and BLAST sequence identity of 33.9
  misc_feature: SWISSPROT Homolog: ZDH15_XENLA Palmitoyltransferase ZDHHC15 (EC 2.3.1.-) (Zinc finger DHHC domain-containing protein 15 homolog) (DHHC-15) with e-value of 5.2e-38 and BLAST sequence identity of 38.4
  misc_feature: SWISSPROT Homolog: ZDH15_RAT Palmitoyltransferase ZDHHC15 (EC 2.3.1.-) (Zinc finger DHHC domain-containing protein 15) (DHHC-15) with e-value of 6.7e-38 and BLAST sequence identity of 35.8
  misc_feature 80688:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(304): Functional Homolog of  Ceres CLONE ID no. 19340 at SEQ ID NO. 784 with e-value of 3.19E-140 and BLAST sequence identity of 84.4
MHRSRAVMAWNVFKFCTALRGLGSIMILLVLGVVGVTYYAVVLNNYGPALYDGGIDSLVSLAVLIPFHSLLVMLLWSYFSVVLTDPGSVPPNWRPAIDEERGEADPLNGSEFSGVQSDQSNQRIRYCRKCNQLKPPRCHHCSVCGRCVLKMDHHCVWVVNCVGALNYKYFLLFLFYTFLETSLVTLSLSPHFIAFFSDGEIPGTPGTLATTFLAFVLNLAFALSVLGFLIMHISLVSANTTTIEAYEKKTTPKWRYDLGRKKNFEQANKRYWFIPTYSDDDLRRMPALQGLEYPSKPDFDSQEF

SEQ ID NO: 758 - DNA, 1218 bp, Populus balsamifera subsp. trichocarpa
  misc_feature (1)..(1218): Ceres ANNOT ID no. 1497053
  misc_feature 80781:<222: Transcription Factor
  misc_feature: Phenotype: Activates expression of the gene endogenous to the AtHMGS (SEQ ID NO 4144) regalutory region Useful for modulating Terpenoid Biosynthesis
atgcatagatctagagctgttatggcttggaatgtgttcaagttttgtacggccttaaggggtttaggctcgatcatgatcttgttggtgctcggtgttgttgtcgtcacatattatgctgttgttttgaataattatggccctgctttatatgatggtgacattgattctctcgtttctcttgctgtcttgatcacattccattctttgctagtgatgctattatggagctacttctctgttgttttaactgatcctggtagtgtgcctcctaattggaggcctgctattgatgaggaaagaggggaggccgatccattgaatgggtcggaatgtagtggagtgcagtctgaccaattaaatcaaagaatccggtattgcaggaagtgcaaccagctgaaaccacctcgttgccatcattgttctgtctgtgggaggtgtgtgctaaagatggaccatcattgtgtatgggttgtaaattgtgttggggccttaaattataagtatttccttctatttttgttctatacatttcttgagacaagtcttgtaactttatctcttctaccacactttatagcattctttagtgatggagaaattcctggcactccaggcactcttgcaaccacatttcttgcctttgtcttaaatctggcatttgcattgagtgttctgggatttctgatcatgcacatatctctggtatctgccaatacaacaactattgagattatgtgtgaaaggtgtgagaatcctcatggcaggatggctataaaatacaatactcgtttcatactcaacaatctcactacattgtcaaagtgcaatatcatagcactctttcactgtaaatcagaaaaacatcatattagcatgccaatgttatgtagccatgataaatgcctattagctttaaggaatgcgttcaagcggcagaggcaaggtttccttgcctctgtcacctgggttcgagcctcagcgtgcacgcctgtcacccccgcggtgtcttacctgcctactgggcttgcagggtgttcagtgggtccggggattagttgtggtgcgcgtaagctgacccggacaccccgggtgtttggagcagataagcgatactggttcattccagcttattcagatgaagatacaaggcgaatgcctgcacttcagggtcttgaatatccatcaaaacctgattttgattcccaagaattctag

SEQ ID NO: 759 - protein, 405 aa, Populus balsamifera subsp. trichocarpa
  misc_feature (1)..(405): Ceres ANNOT ID no. 1497053
  misc_feature (116)..(180): Pfam Name: zf-DHHC Pfam Description: DHHC zinc finger domain
  misc_feature: SWISSPROT Homolog: ZDH20_HUMAN Probable palmitoyltransferase ZDHHC20 (EC 2.3.1.-) (Zinc finger DHHC domain-containing protein 20) (DHHC-20) with e-value of 1.0e-41 and BLAST sequence identity of 35.3
  misc_feature: SWISSPROT Homolog: ZDHC2_MOUSE Palmitoyltransferase ZDHHC2 (EC 2.3.1.-) (Zinc finger DHHC domain-containing protein 2) (DHHC-2) with e-value of 4.6e-39 and BLAST sequence identity of 33.9
  misc_feature: SWISSPROT Homolog: ZDHC2_RAT Palmitoyltransferase ZDHHC2 (EC 2.3.1.-) (Zinc finger DHHC domain-containing protein 2) (DHHC-2) with e-value of 5.8e-39 and BLAST sequence identity of 33.9
  misc_feature: SWISSPROT Homolog: ZDH15_XENLA Palmitoyltransferase ZDHHC15 (EC 2.3.1.-) (Zinc finger DHHC domain-containing protein 15 homolog) (DHHC-15) with e-value of 5.2e-38 and BLAST sequence identity of 38.4
  misc_feature: SWISSPROT Homolog: ZDH15_RAT Palmitoyltransferase ZDHHC15 (EC 2.3.1.-) (Zinc finger DHHC domain-containing protein 15) (DHHC-15) with e-value of 6.7e-38 and BLAST sequence identity of 35.8
  misc_feature 80894:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(405): Functional Homolog of  Ceres CLONE ID no. 19340 at SEQ ID NO. 784 with e-value of 5.20E-127 and BLAST sequence identity of 83.1
MHRSRAVMAWNVFKFCTALRGLGSIMILLVLGVVVVTYYAVVLNNYGPALYDGDIDSLVSLAVLITFHSLLVMLLWSYFSVVLTDPGSVPPNWRPAIDEERGEADPLNGSECSGVQSDQLNQRIRYCRKCNQLKPPRCHHCSVCGRCVLKMDHHCVWVVNCVGALNYKYFLLFLFYTFLETSLVTLSLLPHFIAFFSDGEIPGTPGTLATTFLAFVLNLAFALSVLGFLIMHISLVSANTTTIEIMCERCENPHGRMAIKYNTRFILNNLTTLSKCNIIALFHCKSEKHHISMPMLCSHDKCLLALRNAFKRQRQGFLASVTWVRASACTPVTPAVSYLPTGLAGCSVGPGISCGARKLTRTPRVFGADKRYWFIPAYSDEDTRRMPALQGLEYPSKPDFDSQEF

SEQ ID NO: 760 - DNA, 957 bp, Populus balsamifera subsp. trichocarpa
  misc_feature (1)..(957): Ceres ANNOT ID no. 1500296
  misc_feature 81005:<222: Transcription Factor
  misc_feature: Phenotype: Activates expression of the gene endogenous to the AtHMGS (SEQ ID NO 4144) regalutory region Useful for modulating Terpenoid Biosynthesis
atgcagaaatcaggaaagtcggtaatggcatggaacgtgttcaagttttgtacagcactgcgtgctcttggttccatcatgatagtattagtgcttggcataattggggttacatattatgttattgttgtagctaattatggtccagctctttttcacggtggcctggattcttttgtcgctttccttgtcttggttttgttccattccttgctggtgatgctattatggagctacttcactactgttctaactgatcctggtggtgtcccaccaaattggaggccatcaatagacgaggagagtggtgatgctgatccattggtgggattaggatatgaaggcacggatttaggtttaaatcaaccggctacattcggtgagccagctaatccacaactacgagtctgtcgaaaatgcaaccagtgtaaacctccccgttgccatcactgttctgtttgtggaaggtgtatattgaaaatggaccatcattgcgtatgggtcgtgaattgtgttggggcattgaactacaagtatttccttcttttcttgttttacacgtttctcttgacaactcttgtcactttatccttattgaggctgtttatagcatttttcactgatggtgtaataaatggaacaccgggaacccttgttgccacttttgtcacatttgttttgaacttatcatttgcattgagtattatgggcttcctggttatgcacatatcgttggtgttaggcaataccaccaccattgaggcattcgagaagaaaaccaatcctaaatggcgttatgaccttggtcgaaggaaaaactttgaacaggtgtttggggtggataagagatgctggttcatccctgcttattcagaagaggatttggaatgcatgccagtgcttcgaggttttgaatatccaacaagacccgacttggatgagctccagcagctctaa

SEQ ID NO: 761 - protein, 318 aa, Populus balsamifera subsp. trichocarpa
  misc_feature (1)..(318): Ceres ANNOT ID no. 1500296
  misc_feature (126)..(190): Pfam Name: zf-DHHC Pfam Description: DHHC zinc finger domain
  misc_feature: SWISSPROT Homolog: ZDH20_HUMAN Probable palmitoyltransferase ZDHHC20 (EC 2.3.1.-) (Zinc finger DHHC domain-containing protein 20) (DHHC-20) with e-value of 1.0e-41 and BLAST sequence identity of 35.3
  misc_feature: SWISSPROT Homolog: ZDHC2_MOUSE Palmitoyltransferase ZDHHC2 (EC 2.3.1.-) (Zinc finger DHHC domain-containing protein 2) (DHHC-2) with e-value of 4.6e-39 and BLAST sequence identity of 33.9
  misc_feature: SWISSPROT Homolog: ZDHC2_RAT Palmitoyltransferase ZDHHC2 (EC 2.3.1.-) (Zinc finger DHHC domain-containing protein 2) (DHHC-2) with e-value of 5.8e-39 and BLAST sequence identity of 33.9
  misc_feature: SWISSPROT Homolog: ZDH15_XENLA Palmitoyltransferase ZDHHC15 (EC 2.3.1.-) (Zinc finger DHHC domain-containing protein 15 homolog) (DHHC-15) with e-value of 5.2e-38 and BLAST sequence identity of 38.4
  misc_feature: SWISSPROT Homolog: ZDH15_RAT Palmitoyltransferase ZDHHC15 (EC 2.3.1.-) (Zinc finger DHHC domain-containing protein 15) (DHHC-15) with e-value of 6.7e-38 and BLAST sequence identity of 35.8
  misc_feature 81108:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(318): Functional Homolog of  Ceres CLONE ID no. 19340 at SEQ ID NO. 784 with e-value of 5.99E-123 and BLAST sequence identity of 72.4
MQKSGKSVMAWNVFKFCTALRALGSIMIVLVLGIIGVTYYVIVVANYGPALFHGGLDSFVAFLVLVLFHSLLVMLLWSYFTTVLTDPGGVPPNWRPSIDEESGDADPLVGLGYEGTDLGLNQPATFGEPANPQLRVCRKCNQCKPPRCHHCSVCGRCILKMDHHCVWVVNCVGALNYKYFLLFLFYTFLLTTLVTLSLLRLFIAFFTDGVINGTPGTLVATFVTFVLNLSFALSIMGFLVMHISLVLGNTTTIEAFEKKTNPKWRYDLGRRKNFEQVFGVDKRCWFIPAYSEEDLECMPVLRGFEYPTRPDLDELQQL

SEQ ID NO: 762 - protein, 210 aa, Arabidopsis thaliana
  misc_feature (1)..(210): Ceres CLONE ID no. 19481
  misc_feature (40)..(178): Pfam Name: Hin1 Pfam Description: Harpin-induced protein 1 (Hin1)
  misc_feature: Phenotype: FLOWER - Reduced fertility Useful for sterility, genetic confinement systems
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MTTKDCGNHGGGGGGGTASRICGVIIGFIIIVLITIFLVWIILQPTKPRFILQDATVYAFNLSQPNLLTSNFQITIASRNRNSRIGIYYDRLHVYATYRNQQITLRTAIPPTYQGHKEDNVWSPFVYGNSVPIAPFNAVALGDEQNRGFVTLIIRADGRVRWKVGTLITGKYHLHVRCQAFINLADKAAGVHVGENAVKYMLINKCSVNV

SEQ ID NO: 763 - DNA, 630 bp, Populus balsamifera subsp. trichocarpa
  misc_feature (1)..(630): Ceres ANNOT ID no. 1475146
  misc_feature 81292:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcatccaaagactgcggcagccacggccacagacgccgaaaaatcttccgtcgaatcttcgccggaatcctaatcttcctcctcatagtcctcatcataattctcttagtttgggccatcctccgtccttcaaaaccaaaattcatcctccaagatgctacagtttacgccttcaacgtttcatctccaaatgttctcacttccaacttccaagtcaccttatcctctcgcaaccccaatgacaaagtcgggatctactatgataaactcgatgtttatgccacataccgtaaccaacaaataactctacgtacttccatacctacttcttaccaaggacacaaagaaattgatgtttggtccccttttatctacggcagcgccgtgcctgtatctccgtacaattcagttgcattaagtcaagaccaagctacaggaactgtgttgctgatgatcaagattgatggtcgtgtccgattcaaagttggaacctttatttctgcgaaatatcatttgaatgttcggtgtcctgcttatattcagtttggtagcagaaccagtggaatcattgtcggtgagaacgccattaagtatcagctggtaacgagatgcagtgtgagcctttga

SEQ ID NO: 764 - protein, 209 aa, Populus balsamifera subsp. trichocarpa
  misc_feature (1)..(209): Ceres ANNOT ID no. 1475146
  misc_feature (39)..(177): Pfam Name: Hin1 Pfam Description: Harpin-induced protein 1 (Hin1)
  misc_feature 81366:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(209): Functional Homolog of  Ceres CLONE ID no. 19481 at SEQ ID NO. 791 with e-value of 7.29E-70 and BLAST sequence identity of 60.7
MSSKDCGSHGHRRRKIFRRIFAGILIFLLIVLIIILLVWAILRPSKPKFILQDATVYAFNVSSPNVLTSNFQVTLSSRNPNDKVGIYYDKLDVYATYRNQQITLRTSIPTSYQGHKEIDVWSPFIYGSAVPVSPYNSVALSQDQATGTVLLMIKIDGRVRFKVGTFISAKYHLNVRCPAYIQFGSRTSGIIVGENAIKYQLVTRCSVSL

SEQ ID NO: 765 - DNA, 687 bp, Populus balsamifera subsp. trichocarpa
  misc_feature (1)..(687): Ceres ANNOT ID no. 1454933
  misc_feature 81462:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgacatccaagaaagactgcggccaccacggccaaaaacgccgaagactcgtccgcctgttattcgccggaatcctaaccttcctcctcattgccctcatcataatcctcatagtttgggccatcctccgtccttcaaaaccaaaattcatcctccaagatgctacagtttacgcctttaacgtttcatatccaaacttcatcacttccaacttccaagtcaccgtatcctctcgcaacccggatgatagagtcggaatctactatgatagactcgatatatatgccacataccgtaaccaacaaataactctacgaacttccatacctacttcttaccaaggacacaaagagattaatgtttggtccccttttatttacggcaactccgtgccggtatctccgtacaattcagctgcattaagtcaagaccaaggtgcaggagttgtgatgctgatgatcaagattgatggtcgtgttcgattcaaagtcggaacctttatttctgcgaaatacaatttgcatgttaggtgtctgcttatattcagtttggtagcagaactaatggaattatggtcggtgacaacgtcgttaagtatcagctggcaacgagttgccataaaaatcatgaaacggacgtcgagacagagaggaaagttacaaaccctgtgtgcgcaagctatatga

SEQ ID NO: 766 - protein, 228 aa, Populus balsamifera subsp. trichocarpa
  misc_feature (1)..(228): Ceres ANNOT ID no. 1454933
  misc_feature (40)..(178): Pfam Name: Hin1 Pfam Description: Harpin-induced protein 1 (Hin1)
  misc_feature 81538:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(228): Functional Homolog of  Ceres CLONE ID no. 19481 at SEQ ID NO. 791 with e-value of 2.49E-60 and BLAST sequence identity of 61.7
MTSKKDCGHHGQKRRRLVRLLFAGILTFLLIALIIILIVWAILRPSKPKFILQDATVYAFNVSYPNFITSNFQVTVSSRNPDDRVGIYYDRLDIYATYRNQQITLRTSIPTSYQGHKEINVWSPFIYGNSVPVSPYNSAALSQDQGAGVVMLMIKIDGRVRFKVGTFISAKYNLHVRCLLIFSLVAELMELWSVTTSLSISWQRVAIKIMKRTSRQRGKLQTLCAQAI

SEQ ID NO: 767 - protein, 360 aa, Arabidopsis thaliana
  misc_feature (1)..(360): Ceres CLONE ID no. 19486
  misc_feature (28)..(73): Pfam Name: F-box Pfam Description: F-box domain
  misc_feature (293)..(321): Pfam Name: LRR_1 Pfam Description: Leucine Rich Repeat
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MVMGGEASMELDQCFQKMKMEGISIKEWKDIPVELLMRILSLVDDRNVIVASGVCTGWRDAISFGLTRLRLSWCNNNMNSLVLSLVPKFVKLQTLNLRQDKPQLEDNAVEAIANHCHELQELDLSKSLKITDRSLYALAHGCPDLTKLNLSGCTSFSDTAIAYLTRFCRKLKVLNLCGCVKAVTDNALEAIGNNCNQMQSLNLGWCENISDDGVMSLAYGCPDLRTLDLCGCVLITDESVVALADWCVHLRSLGLYYCRNITDRAIYSLAQSGVKNKPGSWKSVKKGKYDEEGLRSLNISQCTALTSSAVQAVCDSFPALHTCSGRHSLVMSGCLNLTTVHCACILQAHRAHNAVPHPAH

SEQ ID NO: 768 - DNA, 1134 bp, Populus balsamifera subsp. trichocarpa
  misc_feature (1)..(1134): Ceres ANNOT ID no. 1452204
  misc_feature 81782:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcaggtgaaggaaaggcgaggagtgaagacttgaacttgtgtttcgagaagctgatgatgcttgcttttggtggtggaaagactgggagtagtgaaggaggtgtgaaaatggaaggtgcggtgatcaccgagtggaaagatattcccgtggagctgttgttaaggattgtttctcttgttgatgataggactgtgattatggcttccggggtttgtagtggatggagggatgctatttgcatgggactcacccatctctgtctctcttggtgcaaaaacaacatgaacaacttggttctctctcttgctcctaaatttacaaaactccaaactcttgtgctgcgccaggataaaccacaacttgaggatcatgctgttgagactattgctagttactgccatgatttgcaggacttggatctcagcaaaagctttaagctcagtgatctctctctgtatgcattagctcacggttgtcctaatcttactaaactcaacatcagtgggtgtacggcattcagtgatgatggtcttgagtatcttacggagttttgccaaaaattaaagttcttgaatctctgtggatgcgtcaaaggtgcaactgaccgtgccttgcagggtattggacgcaactgcagtcagttgcagactttgaatctgggatggtgcgagaacgtgggtgatgttggagtaatgagtttagcgtatggatgtcctgatctcagaaccctcgacttgtgtgggtgtgtctgtataacagatgatagcgtgattgctttggcaaacaggtgcccccatctgagatccctcggtctgtactactgccgaaacatcacggatagagcaatgtattcccttgtccacaatcgagtgaagaacaagctttcaatgtgggaatcaatgaaaggcaggtgtgatgaggaaggattgagtcgtctaaatatcagtcagtgcacggcactcacacctcctgctgttcaggctctatgtgactcgtttcctgcacttcacacctgctcagggaggcattccctcgtcatgagtggctgtttgaacttgacatctgtgcattgtgtttgtgctgtccaggcacatcgctctgcaagttcttttcctcatccagcacattga

SEQ ID NO: 769 - protein, 377 aa, Populus balsamifera subsp. trichocarpa
  misc_feature (1)..(377): Ceres ANNOT ID no. 1452204
  misc_feature (162)..(190): Pfam Name: LRR_1 Pfam Description: Leucine Rich Repeat
  misc_feature (46)..(91): Pfam Name: F-box Pfam Description: F-box domain
  misc_feature: SWISSPROT Homolog: FBXL2_HUMAN F-box/LRR-repeat protein 2 F-box and leucine-rich repeat protein 2 (F-box protein FBL2/FBL3) with e-value of 2.9e-28 and BLAST sequence identity of 35.6
  misc_feature: SWISSPROT Homolog: FBXL2_MOUSE F-box/LRR-repeat protein 2 (F-box and leucine-rich repeat protein 2) with e-value of 2.1e-27 and BLAST sequence identity of 35.6
  misc_feature: SWISSPROT Homolog: FXL20_HUMAN F-box/LRR-repeat protein 20 F-box and leucine-rich repeat protein 20 with e-value of 5.9e-26 and BLAST sequence identity of 32.2
  misc_feature: SWISSPROT Homolog: FXL20_RAT F-box/LRR-repeat protein 20 F-box and leucine-rich repeat protein 20 with e-value of 1.7e-25 and BLAST sequence identity of 31.7
  misc_feature: SWISSPROT Homolog: FXL20_MOUSE F-box/LRR-repeat protein 20 F-box and leucine-rich repeat protein 20 with e-value of 2.3e-25 and BLAST sequence identity of 31.7
  misc_feature 81939:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(377): Functional Homolog of  Ceres CLONE ID no. 19486 at SEQ ID NO. 796 with e-value of 3.39E-147 and BLAST sequence identity of 76.0
MAGEGKARSEDLNLCFEKLMMLAFGGGKTGSSEGGVKMEGAVITEWKDIPVELLLRIVSLVDDRTVIMASGVCSGWRDAICMGLTHLCLSWCKNNMNNLVLSLAPKFTKLQTLVLRQDKPQLEDHAVETIASYCHDLQDLDLSKSFKLSDLSLYALAHGCPNLTKLNISGCTAFSDDGLEYLTEFCQKLKFLNLCGCVKGATDRALQGIGRNCSQLQTLNLGWCENVGDVGVMSLAYGCPDLRTLDLCGCVCITDDSVIALANRCPHLRSLGLYYCRNITDRAMYSLVHNRVKNKLSMWESMKGRCDEEGLSRLNISQCTALTPPAVQALCDSFPALHTCSGRHSLVMSGCLNLTSVHCVCAVQAHRSASSFPHPAH

SEQ ID NO: 770 - DNA, 1287 bp, Populus balsamifera subsp. trichocarpa
  misc_feature (1)..(1287): Ceres ANNOT ID no. 1443204
  misc_feature 82086:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcaggggaagcaaaagggaggagggaagacttgaacttgtattctgagaagccgatgatgcttgcttttgatggtggaaagagtgggattggtgcgggaggtgtggaaatcgaaggcttggtgatcactgagtggaaagatatccctatgaagctgttgttaaggattgtttctcttgttgatgataggaccttgattatggcttctggggtttgcagtggatggagggatgctatttgctcgggactcacccatctgtgtctctcttggtataacctttcttcctctgtctttataatcaaaatgttgttcaagctgattagcaatttgtcccggattgccatcttctccgaggccatgatcgaaaacattgctgattggttacaggaagtaacatggaaacatgctatctttgcaaacttgtgcaaaaacaacatgaacaacttggttctatctcttgctcctaaatttacaaaactgcaaactcttgtgctgcgccaagataaaccacaactcgaggataatgctgttgagactattgcaagttactgtcatgatctgcaggacctggatctcagcaaaagctttaagcttagtgatctctccttgtatgcattagctcacggttttcccaatcttaccaaactcaacatcagtggttgtacggcattcagcgatgtttctctagagtatctgacagaattttgccgaaaattaaaaattttaaatctctgtggatgtgtgaatggtgcaactgaccgtgccttgcaggcaattggacgcaactgcagtcagttgcaatctttgaatctgggatggtgtgagaatgtgagtgatgtcggagtaatgagtctagcatacggatgtcctgatatcagaacccttgacttgtgtggttgtgtctgtataacagatgacagcgtgattgctttggcaaataggtgtccccatcttagatccctctgtctgtactactgccggaacatcacagatagagcaatgtattcccttgtccacaaccgagtgaagaacaagcctgcaatgtgggaatcaatgaaaggcaggtatgatgaggaaggattgaagagtctcaacatcagtcagtgcacggcaatcacacctcctgctgttcaggctctatgtgactcgttccctgcacttcatacctgctcagggaggcattccctcgttatgagtggctgttggaacttaacttccgtgcattgtgcctgtgctgtccaagcacaccacaccgcaagttctattcctcatccggcacattga

SEQ ID NO: 771 - protein, 408 aa, Populus balsamifera subsp. trichocarpa
  misc_feature (1)..(408): Ceres ANNOT ID no. 1443204
  misc_feature (193)..(217): Pfam Name: LRR_1 Pfam Description: Leucine Rich Repeat
  misc_feature (26)..(71): Pfam Name: F-box Pfam Description: F-box domain
  misc_feature: SWISSPROT Homolog: FBXL2_HUMAN F-box/LRR-repeat protein 2 F-box and leucine-rich repeat protein 2 (F-box protein FBL2/FBL3) with e-value of 2.9e-28 and BLAST sequence identity of 35.6
  misc_feature: SWISSPROT Homolog: FBXL2_MOUSE F-box/LRR-repeat protein 2 (F-box and leucine-rich repeat protein 2) with e-value of 2.1e-27 and BLAST sequence identity of 35.6
  misc_feature: SWISSPROT Homolog: FXL20_HUMAN F-box/LRR-repeat protein 20 F-box and leucine-rich repeat protein 20 with e-value of 5.9e-26 and BLAST sequence identity of 32.2
  misc_feature: SWISSPROT Homolog: FXL20_RAT F-box/LRR-repeat protein 20 F-box and leucine-rich repeat protein 20 with e-value of 1.7e-25 and BLAST sequence identity of 31.7
  misc_feature: SWISSPROT Homolog: FXL20_MOUSE F-box/LRR-repeat protein 20 F-box and leucine-rich repeat protein 20 with e-value of 2.3e-25 and BLAST sequence identity of 31.7
  misc_feature 82249:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(408): Functional Homolog of  Ceres CLONE ID no. 19486 at SEQ ID NO. 796 with e-value of 3.49E-134 and BLAST sequence identity of 75.1
MLAFDGGKSGIGAGGVEIEGLVITEWKDIPMKLLLRIVSLVDDRTLIMASGVCSGWRDAICSGLTHLCLSWYNLSSSVFIIKMLFKLISNLSRIAIFSEAMIENIADWLQEVTWKHAIFANLCKNNMNNLVLSLAPKFTKLQTLVLRQDKPQLEDNAVETIASYCHDLQDLDLSKSFKLSDLSLYALAHGFPNLTKLNISGCTAFSDVSLEYLTEFCRKLKILNLCGCVNGATDRALQAIGRNCSQLQSLNLGWCENVSDVGVMSLAYGCPDIRTLDLCGCVCITDDSVIALANRCPHLRSLCLYYCRNITDRAMYSLVHNRVKNKPAMWESMKGRYDEEGLKSLNISQCTAITPPAVQALCDSFPALHTCSGRHSLVMSGCWNLTSVHCACAVQAHHTASSIPHPAH

SEQ ID NO: 772 - protein, 298 aa, Arabidopsis thaliana
  misc_feature (1)..(298): Ceres CLONE ID no. 19510
  misc_feature (104)..(199): Pfam Name: Mito_carr Pfam Description: Mitochondrial carrier protein
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MAEEKKAPISVWTTVKPFVNGGASGMLATCVIQPIDMIKVRIQLGQGSAASITTNMLKNEGVGAFYKGLSAGLLRQATYTTARLGSFKLLTAKAIESNDGKPLPLYQKALCGLTAGAIGACVGSPADLALIRMQADNTLPLAQRRNYTNAFHALTRISADEGVLALWKGCGPTVVRAMALNMGMLASYDQSAEYMRDNLGFGEMSTVVGASAVSGFCAAACSLPFDFVKTQIQKMQPDAQGKYPYTGSLDCAMKTLKEGGPLKFYSGFPVYCVRIAPHVMMTWIFLNQITKFQKKIGM

SEQ ID NO: 773 - DNA, 900 bp, Populus balsamifera subsp. trichocarpa
  misc_feature (1)..(900): Ceres ANNOT ID no. 1501412
  misc_feature 82515:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgggggaggagaagaaaccacaatcactcggtgtatggcctactgttaaaccttttgttaatggtggtgcatctggtatgcttgccacctgtgttatccagccaattgatatgattaaggtgaggattcaattgggtcaaggatcagctggtgaggtgacaaggaatatgataaagaatgagggttttggtgctttatacaaggggctttctgctggactgttgaggcaagccacttatacaactgcccggctcggaacattcaagattttgaccagcaaagcaattgaagccaatgatgggaagcccttacctctatatcagaaggctttgtgtgggctaacagctggtgcgattggagcatctgtgggcagcccagcggatttagcactcatccgtatgcaggctgatgccactttacctgttgctcagcgcagaaactactcaaatgctttcaatgccctctaccgaattgttgctgatgaaggggttttggcactctggaaaggtgctggccctactgttgtaagggcaatggctttgaacatggggatgcttgcttcttatgaccaaagtgttgagttttgcaaggattctcttggttttggtgaaggtgctacagtgttaggtgcaagtagtgtttctggatttttcgctgcagcttgtagtcttccatttgattatgtcaaaactcaaattcagaaaatgcaacctgatgcccaaggaaagtatccatacactggctccatggattgtgccttaaagacactcaagtcaggaggaccgttcaaattttacactggattccctgtttattgtgtcagaattgctcctcatgtcatgatgacctggatattccttaaccaaattcaaaagctggagaaatcagtcgggttgtag

SEQ ID NO: 774 - protein, 299 aa, Populus balsamifera subsp. trichocarpa
  misc_feature (1)..(299): Ceres ANNOT ID no. 1501412
  misc_feature (105)..(200): Pfam Name: Mito_carr Pfam Description: Mitochondrial carrier protein
  misc_feature: SWISSPROT Homolog: M2OM_MOUSE Mitochondrial 2-oxoglutarate/malate carrier protein (OGCP) (Solute carrier family 25 member 11) with e-value of 3.8e-58 and BLAST sequence identity of 45.2
  misc_feature: SWISSPROT Homolog: M2OM_HUMAN Mitochondrial 2-oxoglutarate/malate carrier protein (OGCP) (Solute carrier family 25 member 11) with e-value of 1.3e-57 and BLAST sequence identity of 44.9
  misc_feature: SWISSPROT Homolog: M2OM_BOVIN Mitochondrial 2-oxoglutarate/malate carrier protein (OGCP) (Solute carrier family 25 member 11) with e-value of 3.1e-56 and BLAST sequence identity of 44.2
  misc_feature: SWISSPROT Homolog: M2OM_RAT Mitochondrial 2-oxoglutarate/malate carrier protein (OGCP) (Solute carrier family 25 member 11) with e-value of 1.7e-55 and BLAST sequence identity of 44.2
  misc_feature: SWISSPROT Homolog: DIC_HUMAN Mitochondrial dicarboxylate carrier (Solute carrier family 25 member 10) with e-value of 4.6e-39 and BLAST sequence identity of 34.4
  misc_feature 82646:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(299): Functional Homolog of  Ceres CLONE ID no. 19510 at SEQ ID NO. 801 with e-value of 1.00E-134 and BLAST sequence identity of 84.2
MGEEKKPQSLGVWPTVKPFVNGGASGMLATCVIQPIDMIKVRIQLGQGSAGEVTRNMIKNEGFGALYKGLSAGLLRQATYTTARLGTFKILTSKAIEANDGKPLPLYQKALCGLTAGAIGASVGSPADLALIRMQADATLPVAQRRNYSNAFNALYRIVADEGVLALWKGAGPTVVRAMALNMGMLASYDQSVEFCKDSLGFGEGATVLGASSVSGFFAAACSLPFDYVKTQIQKMQPDAQGKYPYTGSMDCALKTLKSGGPFKFYTGFPVYCVRIAPHVMMTWIFLNQIQKLEKSVGL

SEQ ID NO: 775 - DNA, 900 bp, Populus balsamifera subsp. trichocarpa
  misc_feature (1)..(900): Ceres ANNOT ID no. 1490383
  misc_feature 82764:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgggagaggtgaagaaacctcaatcacgtggtgtttggcctactgtcaaaccttttgttaatggtggtgcctcgggtatgctcgccacctgtgttatccagcctattgatatgattaaggtgaggattcaattgggtcaaggatcagctactgaggtgacgaagactatgttaaagaatgagggttttggtgctttgtacaaggggctctctgctggactactgaggcaagccacttatacaactgcccgacttggaacattcaagattttgaccagcaaagcaattgaagccaatgatgggaagcccttacctctatatcagaaggctttgtgtgggctaactgccggtgcgattggagcatctgttggcagcccagcagatttagcacttatccgtatgcaggctgatgccactttaccagctgctcagcgcagaaattattcaaatgctttcaatgccctcttccgcattgtttccgatgaaggggttttggcactctggaaaggtgcaggccctactgttgtaagagcaatggcattgaacatggggatgcttgcttcttatgatcaaagtgttgagttttgcaaggattcacttggttttggtgaaatgtccactgtgataggtgcaagtactgtttcaggatttttcgctgcagcttgtagtcttccatttgattatgtcaaaactcaaattcagaaaatgcaacctgatgcccaaggaaagtatccatacactggctccatggattgtgcccttaagacactcaagttaggaggaccattcaagttttacactggattccctgtctattgtgttagaattgcgcctcatgttatgatgacctggatattccttaaccagattcaaaagctggagaaatctgctgggttgtag

SEQ ID NO: 776 - protein, 299 aa, Populus balsamifera subsp. trichocarpa
  misc_feature (1)..(299): Ceres ANNOT ID no. 1490383
  misc_feature (14)..(99): Pfam Name: Mito_carr Pfam Description: Mitochondrial carrier protein
  misc_feature: SWISSPROT Homolog: M2OM_MOUSE Mitochondrial 2-oxoglutarate/malate carrier protein (OGCP) (Solute carrier family 25 member 11) with e-value of 3.8e-58 and BLAST sequence identity of 45.2
  misc_feature: SWISSPROT Homolog: M2OM_HUMAN Mitochondrial 2-oxoglutarate/malate carrier protein (OGCP) (Solute carrier family 25 member 11) with e-value of 1.3e-57 and BLAST sequence identity of 44.9
  misc_feature: SWISSPROT Homolog: M2OM_BOVIN Mitochondrial 2-oxoglutarate/malate carrier protein (OGCP) (Solute carrier family 25 member 11) with e-value of 3.1e-56 and BLAST sequence identity of 44.2
  misc_feature: SWISSPROT Homolog: M2OM_RAT Mitochondrial 2-oxoglutarate/malate carrier protein (OGCP) (Solute carrier family 25 member 11) with e-value of 1.7e-55 and BLAST sequence identity of 44.2
  misc_feature: SWISSPROT Homolog: DIC_HUMAN Mitochondrial dicarboxylate carrier (Solute carrier family 25 member 10) with e-value of 4.6e-39 and BLAST sequence identity of 34.4
  misc_feature 82895:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(299): Functional Homolog of  Ceres CLONE ID no. 19510 at SEQ ID NO. 801 with e-value of 3.09E-133 and BLAST sequence identity of 85.1
MGEVKKPQSRGVWPTVKPFVNGGASGMLATCVIQPIDMIKVRIQLGQGSATEVTKTMLKNEGFGALYKGLSAGLLRQATYTTARLGTFKILTSKAIEANDGKPLPLYQKALCGLTAGAIGASVGSPADLALIRMQADATLPAAQRRNYSNAFNALFRIVSDEGVLALWKGAGPTVVRAMALNMGMLASYDQSVEFCKDSLGFGEMSTVIGASTVSGFFAAACSLPFDYVKTQIQKMQPDAQGKYPYTGSMDCALKTLKLGGPFKFYTGFPVYCVRIAPHVMMTWIFLNQIQKLEKSAGL

SEQ ID NO: 777 - DNA, 879 bp, Populus balsamifera subsp. trichocarpa
  misc_feature (1)..(879): Ceres ANNOT ID no. 1448419
  misc_feature 83013:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgggggaggagaagaaaccacaatcactcggtgtatggcctactgttaaaccttttgttaatggtggtgcatctggtatgcttgccacctgtgttatccagccaattgatatgattaaggtgaggattcaattgggtcaaggatcagctggtgaggtgacaaggaatatgataaagaatgagggttttggtgctttatacaaggggctttctgctggactgttgaggcaagccacttatacaactgcccggctcggaacattcaagattttgaccagcaaagcaattgaagccaatgatgggaagcccttacctctatatcagaaggctttgtgtgggctaacagctggtgcgattggagcatctgtgggcagcccagcggatttagcactcatccgtatgcaggctgatgccactttacctgttgctcagcgcagaaactactcaaatgctttcaatgccctctaccgaattgttgctgatgaaggggttttggcactctggaaaggtgctggccctactgttgtaagggcaatggctttgaacatggggatgcttgcttcttatgaccaaagtgttgagttttgcaaggattctcttggttttggtgaaggtgctacagtgttaggtgcaagtagtgtttctggatttttcgctgcagcttgtagtcttccatttgattatgtcaaaactcaaattcagaaaatgcaacctgatgcccaaggaaagtatccatacactggctccatggattgtgccttaaagacactcaagtcaggaggaccgttcaaattttacactggattccctgtttattgtgtcagaattgctcctcatgtcatgtttctggctggttctggtggttcacaccctgtttga

SEQ ID NO: 778 - protein, 292 aa, Populus balsamifera subsp. trichocarpa
  misc_feature (1)..(292): Ceres ANNOT ID no. 1448419
  misc_feature (105)..(200): Pfam Name: Mito_carr Pfam Description: Mitochondrial carrier protein
  misc_feature: SWISSPROT Homolog: M2OM_MOUSE Mitochondrial 2-oxoglutarate/malate carrier protein (OGCP) (Solute carrier family 25 member 11) with e-value of 3.8e-58 and BLAST sequence identity of 45.2
  misc_feature: SWISSPROT Homolog: M2OM_HUMAN Mitochondrial 2-oxoglutarate/malate carrier protein (OGCP) (Solute carrier family 25 member 11) with e-value of 1.3e-57 and BLAST sequence identity of 44.9
  misc_feature: SWISSPROT Homolog: M2OM_BOVIN Mitochondrial 2-oxoglutarate/malate carrier protein (OGCP) (Solute carrier family 25 member 11) with e-value of 3.1e-56 and BLAST sequence identity of 44.2
  misc_feature: SWISSPROT Homolog: M2OM_RAT Mitochondrial 2-oxoglutarate/malate carrier protein (OGCP) (Solute carrier family 25 member 11) with e-value of 1.7e-55 and BLAST sequence identity of 44.2
  misc_feature: SWISSPROT Homolog: DIC_HUMAN Mitochondrial dicarboxylate carrier (Solute carrier family 25 member 10) with e-value of 4.6e-39 and BLAST sequence identity of 34.4
  misc_feature 83142:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(292): Functional Homolog of  Ceres CLONE ID no. 19510 at SEQ ID NO. 801 with e-value of 4.39E-127 and BLAST sequence identity of 85.3
MGEEKKPQSLGVWPTVKPFVNGGASGMLATCVIQPIDMIKVRIQLGQGSAGEVTRNMIKNEGFGALYKGLSAGLLRQATYTTARLGTFKILTSKAIEANDGKPLPLYQKALCGLTAGAIGASVGSPADLALIRMQADATLPVAQRRNYSNAFNALYRIVADEGVLALWKGAGPTVVRAMALNMGMLASYDQSVEFCKDSLGFGEGATVLGASSVSGFFAAACSLPFDYVKTQIQKMQPDAQGKYPYTGSMDCALKTLKSGGPFKFYTGFPVYCVRIAPHVMFLAGSGGSHPV

SEQ ID NO: 779 - protein, 375 aa, Arabidopsis thaliana
  misc_feature (1)..(375): Ceres CLONE ID no. 19512
  misc_feature (1)..(375): Pfam Name: TFIIA Pfam Description: Transcription factor IIA, alpha/beta subunit
  misc_feature: Utility: High Sucrose Useful for making plants with enhanced tolerance to drought
  misc_feature: Phenotype: WHOLE PLANT - High Sucrose Useful for making plants with enhanced tolerance to drought
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSAHYQNGGSIPQQDGASDAIPEANFECAALRITYVGDRKIPRDLIGSSSKIPQVDGPMPDPYDEMLSTPNIYSYQGPNEEFNEARTPAPNEIQTSTPVAVPNDIIEDDEELLNEDDDDDELDDLESGEDMNTQHLVLAQFDKVTRTKSRWKCSLKDGIMHINDKDILFNKATGEFDF

SEQ ID NO: 780 - DNA, 1095 bp, Populus balsamifera subsp. trichocarpa
  misc_feature (1)..(1095): Ceres ANNOT ID no. 1515042
  misc_feature: Utility: High Sucrose Useful for making plants with enhanced tolerance to drought
  misc_feature 83372:<222: Transcription Factor
  misc_feature: Phenotype: WHOLE PLANT - High Sucrose Useful for making plants with enhanced tolerance to drought
atggcgtcatcggatgcaacaagccccgtttacatcaacgtcatcgaagacgtcatcaacaaggtccgcgacgagttcatcaataacggtgggcccggtgagaccgtcctttatgagcttcaaggactttgggagacgaaaatgatgcaagcaggtgctatatgtggtacaatagataggtcatcagctaataagctgccggtacctggtggtccaattactccagtacacgaccttaatgtaccgtatgaagggaccgaggaatatgagactcccactgctgagatactcttccctcctacaccaatgcaaacacccatgcagactgtggacaattcatccatgtataacattcctactggatctagtgattatcccacccctgtcagtgatgctgggggcagtaccgatggaaaagctgggagacccagccctttcatgcaacctcccacttggatgcatcaaaggccgcctcttagtgttgatgtcaatgttggcaagtcttcttatgttgaagggcgggatgaggtggacagagggacctctcaccaagccttgacacaggacttcttcatgccttctggaaaacggaagcgcgaggattttgctccgaaatataacaatggtggattcataccccagcaagatggagctggggattctgcttctgaggtttctcaggttgagctgaatattcctcaagtggatgggccaattcctgatccttatgatgatgtgctttctactcccaatatatacaattatcaaggagttgccaatgaagattacaacatagcaaacacaccagctcccaatgatccactggcaagtaccccagctgttgtcagtcaaaatgatgttgctgatgatgatgatgatgatgagccgctgaatgaagatgatgatgatgatgaggatctggatgatgtggaccaaggagaggagctgaatacgccgcaacatttggttttagctcaatttgacaaggtgacccgtaccaagagcaggtggaaatgcatactcaaggatggtattatgcatataaacaacaaggacattctctttaataaggtctgtcttccatcaaataattga

SEQ ID NO: 781 - protein, 364 aa, Populus balsamifera subsp. trichocarpa
  misc_feature (1)..(364): Ceres ANNOT ID no. 1515042
  misc_feature (1)..(357): Pfam Name: TFIIA Pfam Description: Transcription factor IIA, alpha/beta subunit
  misc_feature: SWISSPROT Homolog: TF2AA_RAT Transcription initiation factor IIA subunit 1 with e-value of 2.5e-18 and BLAST sequence identity of 29.1
  misc_feature: SWISSPROT Homolog: TF2AA_RAT General transcription factor IIA1 Contains: Transcription initiation factor IIA alpha chain (TFIIA p35 subunit); Transcription initiation factor IIA beta chain (TFIIA p19 subunit)]
  misc_feature: SWISSPROT Homolog: TOA1_YEAST Transcription initiation factor IIA large chain (TFIIA 32 kDa subunit) with e-value of 3.4e-18 and BLAST sequence identity of 48.6
  misc_feature: SWISSPROT Homolog: TF2AA_MOUSE Transcription initiation factor IIA subunit 1 with e-value of 1.0e-17 and BLAST sequence identity of 28.4
  misc_feature: SWISSPROT Homolog: TF2AA_MOUSE General transcription factor IIA1 Contains: Transcription initiation factor IIA alpha chain (TFIIA p35 subunit); Transcription initiation factor IIA beta chain (TFIIA p19 subunit)]
  misc_feature: SWISSPROT Homolog: TF2AA_HUMAN Transcription initiation factor IIA subunit 1 with e-value of 1.7e-17 and BLAST sequence identity of 28.4
  misc_feature: SWISSPROT Homolog: TF2AA_HUMAN General transcription factor IIA1 Contains: Transcription initiation factor IIA alpha chain (TFIIA p35 subunit); Transcription initiation factor IIA beta chain (TFIIA p19 subunit)]
  misc_feature: SWISSPROT Homolog: TF2AA_PONPY Transcription initiation factor IIA subunit 1 with e-value of 1.7e-17 and BLAST sequence identity of 28.4
  misc_feature: SWISSPROT Homolog: TF2AA_PONPY General transcription factor IIA1 Contains: Transcription initiation factor IIA alpha chain (TFIIA p35 subunit); Transcription initiation factor IIA beta chain (TFIIA p19 subunit)]
  misc_feature: Utility: High Sucrose Useful for making plants with enhanced tolerance to drought
  misc_feature 83519:<222: Transcription Factor
  misc_feature: Phenotype: WHOLE PLANT - High Sucrose Useful for making plants with enhanced tolerance to drought
  misc_feature (1)..(364): Functional Homolog of  Ceres CLONE ID no. 19512 at SEQ ID NO. 808 with e-value of 5.00E-119 and BLAST sequence identity of 72.3
MASSDATSPVYINVIEDVINKVRDEFINNGGPGETVLYELQGLWETKMMQAGAICGTIDRSSANKLPVPGGPITPVHDLNVPYEGTEEYETPTAEILFPPTPMQTPMQTVDNSSMYNIPTGSSDYPTPVSDAGGSTDGKAGRPSPFMQPPTWMHQRPPLSVDVNVGKSSYVEGRDEVDRGTSHQALTQDFFMPSGKRKREDFAPKYNNGGFIPQQDGAGDSASEVSQVELNIPQVDGPIPDPYDDVLSTPNIYNYQGVANEDYNIANTPAPNDPLASTPAVVSQNDVADDDDDDEPLNEDDDDDEDLDDVDQGEELNTPQHLVLAQFDKVTRTKSRWKCILKDGIMHINNKDILFNKVCLPSNN

SEQ ID NO: 782 - DNA, 1305 bp, Populus balsamifera subsp. trichocarpa
  misc_feature (1)..(1305): Ceres ANNOT ID no. 1492757
  misc_feature: Utility: High Sucrose Useful for making plants with enhanced tolerance to drought
  misc_feature 83627:<222: Transcription Factor
  misc_feature: Phenotype: WHOLE PLANT - High Sucrose Useful for making plants with enhanced tolerance to drought
atggcgtcatcggcaacaagcaccgtttacaccgaagttatagaagacgtcatcgacaaggtccgcgatgagttcatcaataacggtggccccggagagactgtccttagtgagctccaaggactttgggagaagaaattgatgcaagcgggtgttttatcgggtccaatagtgaggtcatcagctaataagcaactggtgcctggtggtcttactccagtccacgatcttaatgtaccttatgaagggactgaggaatatgagactcccactgctgagatactcttccctcctacacctttgcaaacccccatgcagacaccattgccaggaagtgcacaaacacctttacctgggaatgtgcaaacacctttacctgggaatgtgccgacacctttacctggtagtgtggacaattcatccatgtataacatttctactggatctagtagtgattatcccacccctgttagcgatgctgggggcagtactgatgtaaaagctgggagacccagccatttcatgcaatctccttcccctttgatgcatcaaaggccacctcttgatgtcaatgttggcaaggttttaactaataaatgttgtgcgtttgtagcttatgtggaagggcgggatgaggtggacagaggaggctctcatcaaaccttgacacaggacttcttcatgtcttctggaaaacggaagcgcggggattttgctccaaaatataacaatggtggattcataccccagcaagatggagctgtggattctgcatctgaggtttcacagatacctcaagtggatgggccaattcctgatccttatgatgacatgctttcaactcccaatatatacaattatcaaggagttgctaatgaagattacaatatcgcaaacacaccagctcccaatgatttacaggcaagtaccccagctgttgtcagtcaaaatgatgatgtagatgatgacgatgatgaaccactgaatgaagacgacgacgacgacgaggatctggatggtgtggaccaaggagaggagctgaacacacagcatttgattttagctcaatttgacaaggtgactcgtaccaagagcaggtggaaatgcacactcaaggatggcgttatgcatataaacaacagggacattctctttaacaaggtctgtgttccaccgaattatagatgcaagtatcatttacttttaagggcttatcctgagttgccattgggtgtgttgttgttcaatttgttcgcgacaaagatcaagctctatgctgctggtgcctgcctcaacttgctttag

SEQ ID NO: 783 - protein, 434 aa, Populus balsamifera subsp. trichocarpa
  misc_feature (1)..(434): Ceres ANNOT ID no. 1492757
  misc_feature (248)..(387): Pfam Name: TFIIA Pfam Description: Transcription factor IIA, alpha/beta subunit
  misc_feature: SWISSPROT Homolog: TF2AA_RAT Transcription initiation factor IIA subunit 1 with e-value of 2.5e-18 and BLAST sequence identity of 29.1
  misc_feature: SWISSPROT Homolog: TF2AA_RAT General transcription factor IIA1 Contains: Transcription initiation factor IIA alpha chain (TFIIA p35 subunit); Transcription initiation factor IIA beta chain (TFIIA p19 subunit)]
  misc_feature: SWISSPROT Homolog: TOA1_YEAST Transcription initiation factor IIA large chain (TFIIA 32 kDa subunit) with e-value of 3.4e-18 and BLAST sequence identity of 48.6
  misc_feature: SWISSPROT Homolog: TF2AA_MOUSE Transcription initiation factor IIA subunit 1 with e-value of 1.0e-17 and BLAST sequence identity of 28.4
  misc_feature: SWISSPROT Homolog: TF2AA_MOUSE General transcription factor IIA1 Contains: Transcription initiation factor IIA alpha chain (TFIIA p35 subunit); Transcription initiation factor IIA beta chain (TFIIA p19 subunit)]
  misc_feature: SWISSPROT Homolog: TF2AA_HUMAN Transcription initiation factor IIA subunit 1 with e-value of 1.7e-17 and BLAST sequence identity of 28.4
  misc_feature: SWISSPROT Homolog: TF2AA_HUMAN General transcription factor IIA1 Contains: Transcription initiation factor IIA alpha chain (TFIIA p35 subunit); Transcription initiation factor IIA beta chain (TFIIA p19 subunit)]
  misc_feature: SWISSPROT Homolog: TF2AA_PONPY Transcription initiation factor IIA subunit 1 with e-value of 1.7e-17 and BLAST sequence identity of 28.4
  misc_feature: SWISSPROT Homolog: TF2AA_PONPY General transcription factor IIA1 Contains: Transcription initiation factor IIA alpha chain (TFIIA p35 subunit); Transcription initiation factor IIA beta chain (TFIIA p19 subunit)]
  misc_feature: Utility: High Sucrose Useful for making plants with enhanced tolerance to drought
  misc_feature 83780:<222: Transcription Factor
  misc_feature: Phenotype: WHOLE PLANT - High Sucrose Useful for making plants with enhanced tolerance to drought
  misc_feature (1)..(434): Functional Homolog of  Ceres CLONE ID no. 19512 at SEQ ID NO. 808 with e-value of 6.09E-114 and BLAST sequence identity of 73.0
MASSATSTVYTEVIEDVIDKVRDEFINNGGPGETVLSELQGLWEKKLMQAGVLSGPIVRSSANKQLVPGGLTPVHDLNVPYEGTEEYETPTAEILFPPTPLQTPMQTPLPGSAQTPLPGNVQTPLPGNVPTPLPGSVDNSSMYNISTGSSSDYPTPVSDAGGSTDVKAGRPSHFMQSPSPLMHQRPPLDVNVGKVLTNKCCAFVAYVEGRDEVDRGGSHQTLTQDFFMSSGKRKRGDFAPKYNNGGFIPQQDGAVDSASEVSQIPQVDGPIPDPYDDMLSTPNIYNYQGVANEDYNIANTPAPNDLQASTPAVVSQNDDVDDDDDEPLNEDDDDDEDLDGVDQGEELNTQHLILAQFDKVTRTKSRWKCTLKDGVMHINNRDILFNKVCVPPNYRCKYHLLLRAYPELPLGVLLFNLFATKIKLYAAGACLNLL

SEQ ID NO: 784 - protein, 457 aa, Arabidopsis thaliana
  misc_feature (1)..(457): Ceres CLONE ID no. 19586
  misc_feature (79)..(404): Pfam Name: Aminotran_3 Pfam Description: Aminotransferase class-III
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 785 - DNA, 1356 bp, Populus balsamifera subsp. trichocarpa
  misc_feature (1)..(1356): Ceres ANNOT ID no. 1476446
  misc_feature 84054:<222: Transcription Factor
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgggttctctccagcacttcctcaacagtccgatctcggtccccttttctccaaatctcaatcatcgccgttcttttttcttacgagcatgccttaacctggacgtgcatgcaccggattcagtgaaacccaaaacccatttgaaaagtcgagaggttatggagatggaagggaaggtgttagttgggacatatgcaagaaacccagttgtgatttcgagtggaaaaggttgtaaattgtatgatcccgaagggagagagtacttggattgtacttctggtattgctgttaatgctcttggtcatggggatcctgattgggtcaaagctgttgttgagcaagctaatttgctcactcatgtcagcaatgttttctattcagttcctcaggtagagcttgctaaacgtcttgtggcttgttcatttgccgatcgtgtttttttcacgaactctggtacggaagcaaatgaagctgctataaagtttgcacggaagtatcaacgatttacaaatcctgagaagcagcaagcgacagagtttatttcatttagtaatagcttccatgggaggacaatgggggctctggcattgacaagcaaggagcagtatcgatttccttttgagcctgtcatgcctggagttaatttcctggaatatggtgacgtacaggctgcaacagaactgattaagtctggcaggattgctgctgtatttgtagaacctatacagggtgaaggtggtatttatagtgcaacaaaggaattcttacagtccttacgtagtgcttgtgatgatgctgggtctctcctggtttttgacgaggtccaatgtggcttaggtcgaactggttatctttgggcacacgaggcatatggtgtggtcccagatataatgacacttgccaagcctctcgcaggaggtctacctataggagctgcattggtgagtgaaaaagttgcagctgccataaaatatggagaccacgggagcacttttgctggtgggcctcttgtctgtaacgctgccattgctgttttagataaaatatcaaagccaggtttcttggccagtgtctctgagaaaggtcaatacttcaaagaacttttaattcacaaactaggaggaaattcacatgtgagagaagtacgaggtttgggacttataattgggatagagctggatgtatccgcttcacccctcgtagatgcctgccgagattccagtcttctaatattaactgctggaaaaggaaatgttgtcaggctggtccccccgttgatcatctcagaacaagaactggagcgtgctgctgagattatactggaatgtcttccagcacttgacaagactagttga

SEQ ID NO: 786 - protein, 451 aa, Populus balsamifera subsp. trichocarpa
  misc_feature (1)..(451): Ceres ANNOT ID no. 1476446
  misc_feature (71)..(395): Pfam Name: Aminotran_3 Pfam Description: Aminotransferase class-III
  misc_feature: SWISSPROT Homolog: ARGD_ALNGL Acetylornithine aminotransferase, (ACOAT) (Acetylornithine transaminase) (AOTA) with e-value of 2.8e-165 and BLAST sequence identity of 71.5
  misc_feature: SWISSPROT Homolog: ARGD_METJA Acetylornithine aminotransferase (EC 2.6.1.11) (ACOAT) with e-value of 1.1e-90 and BLAST sequence identity of 45.2
  misc_feature: SWISSPROT Homolog: ARGD_METTH Acetylornithine aminotransferase (EC 2.6.1.11) (ACOAT) with e-value of 1.3e-87 and BLAST sequence identity of 46.5
  misc_feature: SWISSPROT Homolog: ARGD_THEMA Acetylornithine aminotransferase (EC 2.6.1.11) (ACOAT) with e-value of 3.5e-87 and BLAST sequence identity of 44.9
  misc_feature: SWISSPROT Homolog: ARGD_THETN Acetylornithine aminotransferase (EC 2.6.1.11) (ACOAT) with e-value of 2.5e-86 and BLAST sequence identity of 44.1
  misc_feature 84213:<222: Transcription Factor
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(451): Functional Homolog of  Ceres CLONE ID no. 19586 at SEQ ID NO. 813 with e-value of 3.49E-173 and BLAST sequence identity of 79.6
MGSLQHFLNSPISVPFSPNLNHRRSFFLRACLNLDVHAPDSVKPKTHLKSREVMEMEGKVLVGTYARNPVVISSGKGCKLYDPEGREYLDCTSGIAVNALGHGDPDWVKAVVEQANLLTHVSNVFYSVPQVELAKRLVACSFADRVFFTNSGTEANEAAIKFARKYQRFTNPEKQQATEFISFSNSFHGRTMGALALTSKEQYRFPFEPVMPGVNFLEYGDVQAATELIKSGRIAAVFVEPIQGEGGIYSATKEFLQSLRSACDDAGSLLVFDEVQCGLGRTGYLWAHEAYGVVPDIMTLAKPLAGGLPIGAALVSEKVAAAIKYGDHGSTFAGGPLVCNAAIAVLDKISKPGFLASVSEKGQYFKELLIHKLGGNSHVREVRGLGLIIGIELDVSASPLVDACRDSSLLILTAGKGNVVRLVPPLIISEQELERAAEIILECLPALDKTS

SEQ ID NO: 787 - DNA, 1407 bp, Populus balsamifera subsp. trichocarpa
  misc_feature (1)..(1407): Ceres ANNOT ID no. 1451126
  misc_feature 84375:<222: Transcription Factor
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgaattctattcacatttcatcaaatcccattgtttctcactcactcactcaccaccgttggctctccacttcacacaaactctatccccaagtgatcaaaatcaacggcagaaaatcactgacaacatcatgcctcaatgtagacgtgaatgcgccagatatttcaagaaaagtaacagcccaaaacagcaaagaagtgatagagctagaagggaaggtaatggtagggacttacgggagagcgcctgttgttttggtgagtggcaaaggttgtaaattgtatgatgttgaagggcgtgagtatttggacatgacttcagggattgctgttaatgctttaggacactgtgatcctgattgggttaaggctgttgctgatcaagctcatgttttgactcatgttagcaatgtctactattctgttcctcaggtagagcttgctaagcgtctagtggattgctcgtttgctgatcgagtgttttttacaaattctggagcagaggcaaatgaagcagctatcaaatttgctaggaagttccaaagacactcaaaccctgacgtgaaagacccagctacagaattcatatctttcactaatagcttccatggcaggacaatgggtgcacttgctttaacaagcaaagaacaatatagaacaccttttgaacctgttatgcctggagtcacttttgtagaatatggaaatataaaggctacacaagaattaattcggcgtgggaaaactgctgcagtttttgtggaacccatccaaggtgaaggaggcatttatagtgcaacaaaggcgtttttggagttcttgcgaactgcttgtgatgatgctggggcactcctggtgtttgatgaggtgcaatgtggtttaggtagaactggatacctctgggcccatgaagcttatgggatcttcccagatataatgacactcgcaaaaccacttgctggaggtctacctattggtgccgctttggtgactgaaagagttgcttcatctataaattatggtgaccatggaagtacatttgctggtggttcccttgtttgcaatgcagcccttactgttctggagaaaatctcaaaaccagaatttttgtctagtgtatctaagaaagggctgtacttaaaagaaattttgcagcaaaagcttggcaggaactcacatgtgaaagaaatccgaggtcttgggtttattattggaattgagttggatgtcccagcctcaccactagtttctgcttgtcgaaattctggccttcttgtgttaactgctggaaaaggaaatgtcgtgagacttgtgcctccattgactgtaactaagcaggaacttcgtcttgcatctgatattctacaaaatgcaatgtctgtacttgatgagaataattcagagtag

SEQ ID NO: 788 - protein, 468 aa, Populus balsamifera subsp. trichocarpa
  misc_feature (1)..(468): Ceres ANNOT ID no. 1451126
  misc_feature (85)..(410): Pfam Name: Aminotran_3 Pfam Description: Aminotransferase class-III
  misc_feature: SWISSPROT Homolog: ARGD_ALNGL Acetylornithine aminotransferase, EC 2.6.1.11 (ACOAT) (Acetylornithine transaminase) (AOTA) with e-value of 2.8e-165 and BLAST sequence identity of 71.5
  misc_feature: SWISSPROT Homolog: ARGD_METJA Acetylornithine aminotransferase (EC 2.6.1.11) (ACOAT) with e-value of 1.1e-90 and BLAST sequence identity of 45.2
  misc_feature: SWISSPROT Homolog: ARGD_METTH Acetylornithine aminotransferase (EC 2.6.1.11) (ACOAT) with e-value of 1.3e-87 and BLAST sequence identity of 46.5
  misc_feature: SWISSPROT Homolog: ARGD_THEMA Acetylornithine aminotransferase (EC 2.6.1.11) (ACOAT) with e-value of 3.5e-87 and BLAST sequence identity of 44.9
  misc_feature: SWISSPROT Homolog: ARGD_THETN Acetylornithine aminotransferase (EC 2.6.1.11) (ACOAT) with e-value of 2.5e-86 and BLAST sequence identity of 44.1
  misc_feature 84536:<222: Transcription Factor
  misc_feature: Phenotype: WHOLE PLANT - Misc. Dwarf Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(468): Functional Homolog of  Ceres CLONE ID no. 19586 at SEQ ID NO. 813 with e-value of 2.59E-161 and BLAST sequence identity of 71.7
MNSIHISSNPIVSHSLTHHRWLSTSHKLYPQVIKINGRKSLTTSCLNVDVNAPDISRKVTAQNSKEVIELEGKVMVGTYGRAPVVLVSGKGCKLYDVEGREYLDMTSGIAVNALGHCDPDWVKAVADQAHVLTHVSNVYYSVPQVELAKRLVDCSFADRVFFTNSGAEANEAAIKFARKFQRHSNPDVKDPATEFISFTNSFHGRTMGALALTSKEQYRTPFEPVMPGVTFVEYGNIKATQELIRRGKTAAVFVEPIQGEGGIYSATKAFLEFLRTACDDAGALLVFDEVQCGLGRTGYLWAHEAYGIFPDIMTLAKPLAGGLPIGAALVTERVASSINYGDHGSTFAGGSLVCNAALTVLEKISKPEFLSSVSKKGLYLKEILQQKLGRNSHVKEIRGLGFIIGIELDVPASPLVSACRNSGLLVLTAGKGNVVRLVPPLTVTKQELRLASDILQNAMSVLDENNSE

SEQ ID NO: 789 - protein, 261 aa, Arabidopsis thaliana
  misc_feature (1)..(261): Ceres CLONE ID no. 19657
  misc_feature: Phenotype: WHOLE PLANT - Dark Green Useful for increasing chlorophyll and photosynthetic capacity
MAGLFDKQADLYLDARPNYPSEWFSKLADLTDHHGLAWDAATGNGQAALAVAEHYESVVATDVSESQLKLATPHPKINYRLTPTSMTDDELVELIGGENSVDLITVAQGVHWFDLPRFYSVATRLLRKPGGIIAVWGYNDVIVSPEFDAVQYRLHATTLPFWKYPYIQHIFDSYEALPFPFENVGMGSEGEPLKLEMPKTTSFEGIIRMFKSWSAIVTAREKGVELLPESLVRELETAWGGSDLVRSVVYKAFMIAGKVRV

SEQ ID NO: 790 - DNA, 783 bp, Populus balsamifera subsp. trichocarpa
  misc_feature (1)..(783): Ceres ANNOT ID no. 1456256
  misc_feature 84774:<222: Transcription Factor
  misc_feature: Phenotype: WHOLE PLANT - Dark Green Useful for increasing chlorophyll and photosynthetic capacity
atggcaggactgtttgacaagcaagctgatctatacttggatggaaggccgacttatccagcccaatggtattcaatgctagccgatcacacccttcaccactctttggcttgggatgttggcactggcaatggccaagctgctcttggtgttgctgagcactatgagcaagtaattggaactgatgtgagtgaagctcaattaaaacgttcaatgacacatccacgggttcgatacttccacaccccattatccatgtctgatgatgagataataagcttaattgggggtgaagattcagttgatttggtgactgtagcacaggctgtgcattggtttgatctaccaaaattttattccctcgttgcacgccttctaagaaagcctggaggtctacttgctgtttggtgctacaatgatgctgtagtgagtcctgcatttgattcagcatttaagcggtttcatgactcaactcttcctttttggcacccgaatgcctttctcgcaatcgaaggttataagagacttccatttccttttgagagtattggtttgggttctgaagagaaaccactagaacttgacatcccaaaggagatgtcatttgaggggtttttgaagatgatcagttcatggtcagcagtcgttacagccaaggaccaaggtgttgagttgctgtctcagaccgttgttaaagagttggagactgtttggggtggatctaaactggtcaggtctgtcatctacaaggcttttatgcttgctggaaaagtcaggctgtga

SEQ ID NO: 791 - protein, 260 aa, Populus balsamifera subsp. trichocarpa
  misc_feature (1)..(260): Ceres ANNOT ID no. 1456256
  misc_feature: SWISSPROT Homolog: YE05_YEAST Hypothetical 34.8 kDa protein in RAD24-BMH1 intergenic region with e-value of 6.2e-14 and BLAST sequence identity of 29.3
  misc_feature: SWISSPROT Homolog: YH09_YEAST Hypothetical 33.8 kDa protein in TWT1-FLO5 intergenic region with e-value of 2.1e-06 and BLAST sequence identity of 25.4
  misc_feature 84841:<222: Transcription Factor
  misc_feature: Phenotype: WHOLE PLANT - Dark Green Useful for increasing chlorophyll and photosynthetic capacity
  misc_feature (1)..(260): Functional Homolog of  Ceres CLONE ID no. 19657 at SEQ ID NO. 818 with e-value of 6.29E-96 and BLAST sequence identity of 65.3
MAGLFDKQADLYLDGRPTYPAQWYSMLADHTLHHSLAWDVGTGNGQAALGVAEHYEQVIGTDVSEAQLKRSMTHPRVRYFHTPLSMSDDEIISLIGGEDSVDLVTVAQAVHWFDLPKFYSLVARLLRKPGGLLAVWCYNDAVVSPAFDSAFKRFHDSTLPFWHPNAFLAIEGYKRLPFPFESIGLGSEEKPLELDIPKEMSFEGFLKMISSWSAVVTAKDQGVELLSQTVVKELETVWGGSKLVRSVIYKAFMLAGKVRL

SEQ ID NO: 792 - DNA, 783 bp, Populus balsamifera subsp. trichocarpa
  misc_feature (1)..(783): Ceres ANNOT ID no. 1503828
  misc_feature 84925:<222: Transcription Factor
  misc_feature: Phenotype: WHOLE PLANT - Dark Green Useful for increasing chlorophyll and photosynthetic capacity
atggcaggtttgtttgacaagcaggcatctatatatgtggatgcaaggccaagatatccaagcgaatggttctcaatgttggctgctctcacccctcaccactgtttagcttgggatgttggtactggcaatggtcaagcggctgttggtgtgtcggagcactacaagcaagtgatagcaactgacataagtgaagaacaactaaagcatgccaaaccacacccccaaattcgttacttgcataccccattaacaatgtccgatgatgaactagtgacattacttgggggtgaaaattcagttgatctcattactgtggcctcagctgtgcattggtttgatctggaaaagttctatccaatcgtcaggcgtgttctgagaaatcctggaggcatacttgcagtttggtgctactcaggaatccagcttagcccggaaattgatcttctcttaaggacccactttgagaggacctttccttttcgaaacccaaacgtcaagtatgcagtagagtgttacaagacacttccatttccttttgaaagtgtaggtgttgggagcgaggggcagccactggaattggagatgcaaaaggagatgtcttttgagggacttttgaagcttttaaagtcactttcatcatttaatacagccaagggacaaggtgtggatttactgtcagaagaggttgttagagaatttgagagtgcatggggcgggcctgaattggttagaactattatctataagacatatatgcttgcagggaaagttaagctctga

SEQ ID NO: 793 - protein, 260 aa, Populus balsamifera subsp. trichocarpa
  misc_feature (1)..(260): Ceres ANNOT ID no. 1503828
  misc_feature: SWISSPROT Homolog: YE05_YEAST Hypothetical 34.8 kDa protein in RAD24-BMH1 intergenic region with e-value of 6.2e-14 and BLAST sequence identity of 29.3
  misc_feature: SWISSPROT Homolog: YH09_YEAST Hypothetical 33.8 kDa protein in TWT1-FLO5 intergenic region with e-value of 2.1e-06 and BLAST sequence identity of 25.4
  misc_feature 84992:<222: Transcription Factor
  misc_feature: Phenotype: WHOLE PLANT - Dark Green Useful for increasing chlorophyll and photosynthetic capacity
  misc_feature (1)..(260): Functional Homolog of  Ceres CLONE ID no. 19657 at SEQ ID NO. 818 with e-value of 3.49E-86 and BLAST sequence identity of 61.0
MAGLFDKQASIYVDARPRYPSEWFSMLAALTPHHCLAWDVGTGNGQAAVGVSEHYKQVIATDISEEQLKHAKPHPQIRYLHTPLTMSDDELVTLLGGENSVDLITVASAVHWFDLEKFYPIVRRVLRNPGGILAVWCYSGIQLSPEIDLLLRTHFERTFPFRNPNVKYAVECYKTLPFPFESVGVGSEGQPLELEMQKEMSFEGLLKLLKSLSSFNTAKGQGVDLLSEEVVREFESAWGGPELVRTIIYKTYMLAGKVKL

SEQ ID NO: 794 - DNA, 783 bp, Populus balsamifera subsp. trichocarpa
  misc_feature (1)..(783): Ceres ANNOT ID no. 1450752
  misc_feature 85076:<222: Transcription Factor
  misc_feature: Phenotype: WHOLE PLANT - Dark Green Useful for increasing chlorophyll and photosynthetic capacity
atggcagagttgtttgacaagcaggcagcaatatatttggatgcgaggccaagatatccaagcgaatggttttcaatgctggcttctctaacccctgaccactctttagcttgggatgctggcacaggcaatggtcaagctgctattgatgtctcagagcattacaaacaagtgattgcaactgacataagtgaagagcagttaaagcatgctatacaacatccccaagttcaatactttcactctccatcatcaatgtctgatgatgaactagtgaacttaattgggggtgaaaattcagttgatttagttgttgtggctacagctgtgcattggtttgatctagaaaaattctaccctgtcgtcaatcgtgtgttaaaaaagcctggaggtgtggttgctgtttggagttacaatatcatccaagttagcccagatatggatcctctattaaggaaattctacgagggaacttttccttttcaaaacccaaaagccatgtacgcatttgagtgttacaagacacttccatttccttttgaaagtgtaggcgtaggttgtgaggggcagcctctggaattagacatgccaagggagatgtcgtttgagagacttttgaagttgttgagttcagcttctgctgtgaatacagcaaaggaacaaggtgtgaatttattgtctgaagaggttgtgagggagcttgagagtgcttggggtggacctgaattggttagaactgtcaactacaaatcatatatgcttgcaggaaaagtcaagctctaa

SEQ ID NO: 795 - protein, 260 aa, Populus balsamifera subsp. trichocarpa
  misc_feature (1)..(260): Ceres ANNOT ID no. 1450752
  misc_feature: SWISSPROT Homolog: YE05_YEAST Hypothetical 34.8 kDa protein in RAD24-BMH1 intergenic region with e-value of 6.2e-14 and BLAST sequence identity of 29.3
  misc_feature: SWISSPROT Homolog: YH09_YEAST Hypothetical 33.8 kDa protein in TWT1-FLO5 intergenic region with e-value of 2.1e-06 and BLAST sequence identity of 25.4
  misc_feature 85143:<222: Transcription Factor
  misc_feature: Phenotype: WHOLE PLANT - Dark Green Useful for increasing chlorophyll and photosynthetic capacity
  misc_feature (1)..(260): Functional Homolog of  Ceres CLONE ID no. 19657 at SEQ ID NO. 818 with e-value of 3.99E-85 and BLAST sequence identity of 59.6
MAELFDKQAAIYLDARPRYPSEWFSMLASLTPDHSLAWDAGTGNGQAAIDVSEHYKQVIATDISEEQLKHAIQHPQVQYFHSPSSMSDDELVNLIGGENSVDLVVVATAVHWFDLEKFYPVVNRVLKKPGGVVAVWSYNIIQVSPDMDPLLRKFYEGTFPFQNPKAMYAFECYKTLPFPFESVGVGCEGQPLELDMPREMSFERLLKLLSSASAVNTAKEQGVNLLSEEVVRELESAWGGPELVRTVNYKSYMLAGKVKL

SEQ ID NO: 796 - protein, 69 aa, Arabidopsis thaliana
  misc_feature (1)..(69): Ceres CLONE ID no. 20257
  misc_feature: Phenotype: INFLORESCENCE - Late Flowering Useful for modulating flowering time
MGGGGHGGGITYKGVTVHTPKTWHTVTGKGLCAVMWFWILYRAKQDGPVVMGWRHPWDGHGDHGHGDHH

SEQ ID NO: 797 - DNA, 207 bp, Populus balsamifera subsp. trichocarpa
  misc_feature (1)..(207): Ceres ANNOT ID no. 1442444
  misc_feature 85264:<222: Transcription Factor
  misc_feature: Phenotype: INFLORESCENCE - Late Flowering Useful for modulating flowering time
atggcaggagggcatggagagggtttcgcttacaagggcttgactatgcataagccaaagcgatggcatactgtaactggaaagggcttgtgtgctgtcatgtggttttgggtcttgtaccgggctaaacaagatggtcctgtagtattgggctggcggcatccgtgggagggccatgatgatcatggccatggacatgggcactag

SEQ ID NO: 798 - protein, 68 aa, Populus balsamifera subsp. trichocarpa
  misc_feature (1)..(68): Ceres ANNOT ID no. 1442444
  misc_feature 85297:<222: Transcription Factor
  misc_feature: Phenotype: INFLORESCENCE - Late Flowering Useful for modulating flowering time
  misc_feature (1)..(68): Functional Homolog of  Ceres CLONE ID no. 20257 at SEQ ID NO. 825 with e-value of 2.70E-31 and BLAST sequence identity of 80.3
MAGGHGEGFAYKGLTMHKPKRWHTVTGKGLCAVMWFWVLYRAKQDGPVVLGWRHPWEGHDDHGHGHGH

SEQ ID NO: 799 - DNA, 207 bp, Populus balsamifera subsp. trichocarpa
  misc_feature (1)..(207): Ceres ANNOT ID no. 1452966
  misc_feature 85345:<222: Transcription Factor
  misc_feature: Phenotype: INFLORESCENCE - Late Flowering Useful for modulating flowering time
atggcaggagggcatggagagggcatcaattacaaaggcttgactatgcataagccaaagcgatggcatgtagtcactggaaagggcttgtgtgctgtcatgtggttttgggtactttacagggcgaagcaagatggccctgtagtattgggctggagacatccgtgggagggccatggtgaccatggccatgagagtggacactag

SEQ ID NO: 800 - protein, 68 aa, Populus balsamifera subsp. trichocarpa
  misc_feature (1)..(68): Ceres ANNOT ID no. 1452966
  misc_feature 85378:<222: Transcription Factor
  misc_feature: Phenotype: INFLORESCENCE - Late Flowering Useful for modulating flowering time
  misc_feature (1)..(68): Functional Homolog of  Ceres CLONE ID no. 20257 at SEQ ID NO. 825 with e-value of 3.50E-31 and BLAST sequence identity of 80.3
MAGGHGEGINYKGLTMHKPKRWHVVTGKGLCAVMWFWVLYRAKQDGPVVLGWRHPWEGHGDHGHESGH

SEQ ID NO: 801 - protein, 96 aa, Arabidopsis thaliana
  misc_feature (1)..(96): Ceres CLONE ID no. 20676
  misc_feature (22)..(67): Pfam Name: Ribosomal_60s Pfam Description: 60s Acidic ribosomal protein
  misc_feature: Utility: MSX Useful for making plants tolerant to low nitrogen
  misc_feature: Phenotype: WHOLE PLANT - MSX Useful for making plants tolerant to low nitrogen
MSTVGELACSYAVMILEDEGIAITADKIATLVKAAGVSIESYWPMLFAKMAEKRNVTDLIMNVGAGGGGGAPAAEEKKKDEPAEESDGDLGFGLFD

SEQ ID NO: 802 - DNA, 333 bp, Populus balsamifera subsp. trichocarpa
  misc_feature (1)..(333): Ceres ANNOT ID no. 1444531
  misc_feature: Utility: MSX Useful for making plants tolerant to low nitrogen
  misc_feature 85487:<222: Transcription Factor
  misc_feature: Phenotype: WHOLE PLANT - MSX Useful for making plants tolerant to low nitrogen
atgtctactagcgagcttgcctgcacgtacgctgctgctattctctacgatgataacatcgccatcactgcagagaagattgcagaattggttaaagcagccaatgtgcaaattgaatctttctggccaagcttgtttgccaagcttcttgagaagcgcaacattgaggatctcatcttgaatgttggctctggtggcggtgctgctgtagctgttgctgccccagctggtggtgctcctgctgctgctgctcctgttgttgaggagaagaagaaggaagaggttaaggaggaaagtgaggatgaagacatgggattcagcttgtttgattag

SEQ ID NO: 803 - protein, 110 aa, Populus balsamifera subsp. trichocarpa
  misc_feature (1)..(110): Ceres ANNOT ID no. 1444531
  misc_feature (21)..(109): Pfam Name: Ribosomal_60s Pfam Description: 60s Acidic ribosomal protein
  misc_feature: SWISSPROT Homolog: RLA1_ARATH 60S acidic ribosomal protein P1 with e-value of 6.5e-40 and BLAST sequence identity of 81.4
  misc_feature: SWISSPROT Homolog: RLA1_MAIZE 60S acidic ribosomal protein P1 (L12) with e-value of 1.3e-27 and BLAST sequence identity of 61.3
  misc_feature: SWISSPROT Homolog: RLA1_CHLRE 60S acidic ribosomal protein P1 with e-value of 1.7e-23 and BLAST sequence identity of 54.5
  misc_feature: SWISSPROT Homolog: RLA1_DROME 60S acidic ribosomal protein P1 (RP21C) (Acidic ribosomal protein RPA2) with e-value of 2.2e-23 and BLAST sequence identity of 52.7
  misc_feature: SWISSPROT Homolog: RLA1_CAEEL 60S acidic ribosomal protein P1 with e-value of 3.6e-23 and BLAST sequence identity of 55.0
  misc_feature: Utility: MSX Useful for making plants tolerant to low nitrogen
  misc_feature 85573:<222: Transcription Factor
  misc_feature: Phenotype: WHOLE PLANT - MSX Useful for making plants tolerant to low nitrogen
  misc_feature (1)..(110): Functional Homolog of  Ceres CLONE ID no. 20676 at SEQ ID NO. 830 with e-value of 3.69E-27 and BLAST sequence identity of 73.6
MSTSELACTYAAAILYDDNIAITAEKIAELVKAANVQIESFWPSLFAKLLEKRNIEDLILNVGSGGGAAVAVAAPAGGAPAAAAPVVEEKKKEEVKEESEDEDMGFSLFD

SEQ ID NO: 804 - DNA, 330 bp, Populus balsamifera subsp. trichocarpa
  misc_feature (1)..(330): Ceres ANNOT ID no. 1467580
  misc_feature: Utility: MSX Useful for making plants tolerant to low nitrogen
  misc_feature 85633:<222: Transcription Factor
  misc_feature: Phenotype: WHOLE PLANT - MSX Useful for making plants tolerant to low nitrogen
atggctggtagtgagcttgcttgcatttacgctaccctcatcctccacgatgaagacatcgccatcacttcagataagattgctacactggtgaagtcagctaatgtgaatgtggaatcttactggccaagtctttttgctaagcttgctgaaaagagaaatgtgggtgatcttatcatgaatattggcgctggtggtggtgccgctgctcctattgctgtttcttcttctgctcctgccgctgcatctgccgctgctcctgctgttgaggagaagaaggaggaagctccagagagtgacgatgacatgggattcagcttgttcgattag

SEQ ID NO: 805 - protein, 109 aa, Populus balsamifera subsp. trichocarpa
  misc_feature (1)..(109): Ceres ANNOT ID no. 1467580
  misc_feature (21)..(108): Pfam Name: Ribosomal_60s Pfam Description: 60s Acidic ribosomal protein
  misc_feature: SWISSPROT Homolog: RLA1_ARATH 60S acidic ribosomal protein P1 with e-value of 6.5e-40 and BLAST sequence identity of 81.4
  misc_feature: SWISSPROT Homolog: RLA1_MAIZE 60S acidic ribosomal protein P1 (L12) with e-value of 1.3e-27 and BLAST sequence identity of 61.3
  misc_feature: SWISSPROT Homolog: RLA1_CHLRE 60S acidic ribosomal protein P1 with e-value of 1.7e-23 and BLAST sequence identity of 54.5
  misc_feature: SWISSPROT Homolog: RLA1_DROME 60S acidic ribosomal protein P1 (RP21C) (Acidic ribosomal protein RPA2) with e-value of 2.2e-23 and BLAST sequence identity of 52.7
  misc_feature: SWISSPROT Homolog: RLA1_CAEEL 60S acidic ribosomal protein P1 with e-value of 3.6e-23 and BLAST sequence identity of 55.0
  misc_feature: Utility: MSX Useful for making plants tolerant to low nitrogen
  misc_feature 85719:<222: Transcription Factor
  misc_feature: Phenotype: WHOLE PLANT - MSX Useful for making plants tolerant to low nitrogen
  misc_feature (1)..(109): Functional Homolog of  Ceres CLONE ID no. 20676 at SEQ ID NO. 830 with e-value of 6.09E-27 and BLAST sequence identity of 74.1
MAGSELACIYATLILHDEDIAITSDKIATLVKSANVNVESYWPSLFAKLAEKRNVGDLIMNIGAGGGAAAPIAVSSSAPAAASAAAPAVEEKKEEAPESDDDMGFSLFD

SEQ ID NO: 806 - DNA, 333 bp, Populus balsamifera subsp. trichocarpa
  misc_feature (1)..(333): Ceres ANNOT ID no. 1472925
  misc_feature: Utility: MSX Useful for making plants tolerant to low nitrogen
  misc_feature 85779:<222: Transcription Factor
  misc_feature: Phenotype: WHOLE PLANT - MSX Useful for making plants tolerant to low nitrogen
atgtctctgagtcagttcgcttgcacttacgccaccctcatcctccacgatgaagacatctccatcacctcggataagattgctacacttgtgaaagcagccaatgtgactgtggaatcttactggccaagtctttttgctaagcttgctgagaagagaaacgttggtgatcttatcatgaatattggtgctgctgctcctgttgctgttgctgttgcttcttctggtcctgcagccggtggggctgctgcggccgctgctccagctgttgaggagaagaaggaggaagccccagagagtgatgatgatatgggattcagcttgtttgattag

SEQ ID NO: 807 - protein, 110 aa, Populus balsamifera subsp. trichocarpa
  misc_feature (1)..(110): Ceres ANNOT ID no. 1472925
  misc_feature (21)..(109): Pfam Name: Ribosomal_60s Pfam Description: 60s Acidic ribosomal protein
  misc_feature: SWISSPROT Homolog: RLA1_ARATH 60S acidic ribosomal protein P1 with e-value of 6.5e-40 and BLAST sequence identity of 81.4
  misc_feature: SWISSPROT Homolog: RLA1_MAIZE 60S acidic ribosomal protein P1 (L12) with e-value of 1.3e-27 and BLAST sequence identity of 61.3
  misc_feature: SWISSPROT Homolog: RLA1_CHLRE 60S acidic ribosomal protein P1 with e-value of 1.7e-23 and BLAST sequence identity of 54.5
  misc_feature: SWISSPROT Homolog: RLA1_DROME 60S acidic ribosomal protein P1 (RP21C) (Acidic ribosomal protein RPA2) with e-value of 2.2e-23 and BLAST sequence identity of 52.7
  misc_feature: SWISSPROT Homolog: RLA1_CAEEL 60S acidic ribosomal protein P1 with e-value of 3.6e-23 and BLAST sequence identity of 55.0
  misc_feature: Utility: MSX Useful for making plants tolerant to low nitrogen
  misc_feature 85865:<222: Transcription Factor
  misc_feature: Phenotype: WHOLE PLANT - MSX Useful for making plants tolerant to low nitrogen
  misc_feature (1)..(110): Functional Homolog of  Ceres CLONE ID no. 20676 at SEQ ID NO. 830 with e-value of 3.80E-25 and BLAST sequence identity of 68.4
MSLSQFACTYATLILHDEDISITSDKIATLVKAANVTVESYWPSLFAKLAEKRNVGDLIMNIGAAAPVAVAVASSGPAAGGAAAAAAPAVEEKKEEAPESDDDMGFSLFD

SEQ ID NO: 808 - protein, 185 aa, Arabidopsis thaliana
  misc_feature (1)..(185): Ceres CLONE ID no. 20760
  misc_feature (28)..(129): Pfam Name: dCMP_cyt_deam Pfam Description: Cytidine and deoxycytidylate deaminase zinc-binding region
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
MEEAKVEAKDGTISVASAFSGHQQAVHDSDHKFLTQAVEEAYKGVDCGDGGPFGAVIVHNNEVVASCHNMVLKYTDPTAHAEVTAIREACKKLNKIELSECEIYASCEPCPMCFGAIHLSRLKRLVYGAKAEAAIAIGFDDFIADALRGTGVYQKSSLEIKKADGNGAAIAEQVFQNTKEKFRLY

SEQ ID NO: 809 - DNA, 561 bp, Populus balsamifera subsp. trichocarpa
  misc_feature (1)..(561): Ceres ANNOT ID no. 1462351
  misc_feature 86012:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
atggaggaagccgatgtggttgaaactaagaagggaacaatctcagtggcttctgcatttcctgttcatcaggaagctgtacaggacagagatcacaagttcctaacaaaagcagttgaagaagcttataaaggggttgacagtggagatggaggtcctttcggtgctgttgttgtcctcaacgatgaggttgttgtcgcttgtcataacatggtcttaaaacatactgatcctactgcccatgccgaggtcactgccattagagaggcatgtaaaaagctcaatcagattgagctttctgactgtgaaatatatgcctcttgtgagccctgccccatgtgctttggcgcgatccacctttcacgaattaagaggttggtttatggagccaaggctgaagcagctattgctattggcttcgatgattttattgctgatgcattgcgggggactagcttctatcagaagtcccagttggagatcaagagggcagatggcacccaggccatcattgcagaacaagtctttgagaaaacaaaggagaagtttcagatgtattaa

SEQ ID NO: 810 - protein, 186 aa, Populus balsamifera subsp. trichocarpa
  misc_feature (1)..(186): Ceres ANNOT ID no. 1462351
  misc_feature (29)..(130): Pfam Name: dCMP_cyt_deam Pfam Description: Cytidine and deoxycytidylate deaminase zinc-binding region
  misc_feature: SWISSPROT Homolog: GUAD_BACSU Guanine deaminase (EC 3.5.4.3) (Guanase) (Guanine aminase) (Guanine aminohydrolase) (GAH) (GDEase) with e-value of 5.5e-27 and BLAST sequence identity of 53.4
  misc_feature: SWISSPROT Homolog: TADA_AQUAE tRNA-specific adenosine deaminase (EC 3.5.4.-) with e-value of 6.2e-19 and BLAST sequence identity of 44.3
  misc_feature: SWISSPROT Homolog: YAAJ_BACSU Hypothetical protein yaaJ with e-value of 3.1e-17 and BLAST sequence identity of 42.0
  misc_feature: SWISSPROT Homolog: Y236_BUCBP Hypothetical protein bbp_236 with e-value of 1.7e-16 and BLAST sequence identity of 42.9
  misc_feature: SWISSPROT Homolog: TADA_HAEIN tRNA-specific adenosine deaminase (EC 3.5.4.-) with e-value of 7.4e-16 and BLAST sequence identity of 39.5
  misc_feature 86130:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature (1)..(186): Functional Homolog of  Ceres CLONE ID no. 20760 at SEQ ID NO. 837 with e-value of 4.90E-80 and BLAST sequence identity of 83.7
MEEADVVETKKGTISVASAFPVHQEAVQDRDHKFLTKAVEEAYKGVDSGDGGPFGAVVVLNDEVVVACHNMVLKHTDPTAHAEVTAIREACKKLNQIELSDCEIYASCEPCPMCFGAIHLSRIKRLVYGAKAEAAIAIGFDDFIADALRGTSFYQKSQLEIKRADGTQAIIAEQVFEKTKEKFQMY

SEQ ID NO: 811 - DNA, 567 bp, Populus balsamifera subsp. trichocarpa
  misc_feature (1)..(567): Ceres ANNOT ID no. 1488821
  misc_feature 86227:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
atggaggatgctagtgtagccaaagaccgaactatttctgtggcatctgccttttctgctcatcaacaggctgttcaggacagggaccataaattcctaactagagcagttgaagaagcttataaaggcgttgaatgcggagacggaggcccatttggtgctgtcgtcgttcaaaatgatgaaataatcatgagctgtcacaatatggttttgaagaacaccgatcccacagcacatgcagaagttacagctgtgagagaggcatgtaagaagctgaaccgaatcgagctctcggattgcgaaatatacgcatcctgcgagccatgtccgatgtgctttggtgccatccatctttcaagagtcaaggctttgcaacagaggttggtttatggagctgaagctgaagcagccattgcaattgggtttgatgatttcattgctgatgcactaagaggcactgggttctatcagaaggctcacttggagatcaaaaaagctgatggtagcggtgctgtcatcgcagagcaagtattcgaaaagacaaaggccaaatttaccatgtattga

SEQ ID NO: 812 - protein, 188 aa, Populus balsamifera subsp. trichocarpa
  misc_feature (1)..(188): Ceres ANNOT ID no. 1488821
  misc_feature (27)..(132): Pfam Name: dCMP_cyt_deam Pfam Description: Cytidine and deoxycytidylate deaminase zinc-binding region
  misc_feature: SWISSPROT Homolog: GUAD_BACSU Guanine deaminase (EC 3.5.4.3) (Guanase) (Guanine aminase) (Guanine aminohydrolase) (GAH) (GDEase) with e-value of 5.5e-27 and BLAST sequence identity of 53.4
  misc_feature: SWISSPROT Homolog: TADA_AQUAE tRNA-specific adenosine deaminase (EC 3.5.4.-) with e-value of 6.2e-19 and BLAST sequence identity of 44.3
  misc_feature: SWISSPROT Homolog: YAAJ_BACSU Hypothetical protein yaaJ with e-value of 3.1e-17 and BLAST sequence identity of 42.0
  misc_feature: SWISSPROT Homolog: Y236_BUCBP Hypothetical protein bbp_236 with e-value of 1.7e-16 and BLAST sequence identity of 42.9
  misc_feature: SWISSPROT Homolog: TADA_HAEIN tRNA-specific adenosine deaminase (EC 3.5.4.-) with e-value of 7.4e-16 and BLAST sequence identity of 39.5
  misc_feature 86345:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature (1)..(188): Functional Homolog of  Ceres CLONE ID no. 20760 at SEQ ID NO. 837 with e-value of 6.30E-80 and BLAST sequence identity of 83.6
MEDASVAKDRTISVASAFSAHQQAVQDRDHKFLTRAVEEAYKGVECGDGGPFGAVVVQNDEIIMSCHNMVLKNTDPTAHAEVTAVREACKKLNRIELSDCEIYASCEPCPMCFGAIHLSRVKALQQRLVYGAEAEAAIAIGFDDFIADALRGTGFYQKAHLEIKKADGSGAVIAEQVFEKTKAKFTMY

SEQ ID NO: 813 - DNA, 543 bp, Populus balsamifera subsp. trichocarpa
  misc_feature (1)..(543): Ceres ANNOT ID no. 1469462
  misc_feature 86442:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
atggaagctgaagaccaaactatttctgtggcatcttcttttgctggttatcaagaagctgttcaggatagagaccataaattcttaagtagagcagttgaagaagcttataaaggcgtcgaatgtggtgacggaggtccattcggtgctgtcgttgttcgaaatgatgaagtagtcatgagctgtcacaacatggttttgaaaaacactgatcccactgcacacgccgaagttactgttattagagaggcatgtaagaagctgaaccgaattgagctctcggattgcgaaatatatgcgtcctgcgagccttgtccaatgtgcttcggcgccatccatctctcaagactcaagaggttggtttacggagctgaagctgaagcagctattgcaattgggtttgatgatttcattgctgatgcattaagaggtactgggttctatcagaaggctcacttggagatcaagaaagccgacggtagtggtgctgttatcgcagaacaagtattcgaaaagaccaagtcgaaatttaccatgtattga

SEQ ID NO: 814 - protein, 180 aa, Populus balsamifera subsp. trichocarpa
  misc_feature (1)..(180): Ceres ANNOT ID no. 1469462
  misc_feature (23)..(124): Pfam Name: dCMP_cyt_deam Pfam Description: Cytidine and deoxycytidylate deaminase zinc-binding region
  misc_feature: SWISSPROT Homolog: GUAD_BACSU Guanine deaminase (EC 3.5.4.3) (Guanase) (Guanine aminase) (Guanine aminohydrolase) (GAH) (GDEase) with e-value of 5.5e-27 and BLAST sequence identity of 53.4
  misc_feature: SWISSPROT Homolog: TADA_AQUAE tRNA-specific adenosine deaminase (EC 3.5.4.-) with e-value of 6.2e-19 and BLAST sequence identity of 44.3
  misc_feature: SWISSPROT Homolog: YAAJ_BACSU Hypothetical protein yaaJ with e-value of 3.1e-17 and BLAST sequence identity of 42.0
  misc_feature: SWISSPROT Homolog: Y236_BUCBP Hypothetical protein bbp_236 with e-value of 1.7e-16 and BLAST sequence identity of 42.9
  misc_feature: SWISSPROT Homolog: TADA_HAEIN tRNA-specific adenosine deaminase (EC 3.5.4.-) with e-value of 7.4e-16 and BLAST sequence identity of 39.5
  misc_feature 86560:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: INFLORESCENCE - No Branching Useful for modifying plant architecture, ie amount of  branching
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature (1)..(180): Functional Homolog of  Ceres CLONE ID no. 20760 at SEQ ID NO. 837 with e-value of 1.70E-79 and BLAST sequence identity of 82.7
MEAEDQTISVASSFAGYQEAVQDRDHKFLSRAVEEAYKGVECGDGGPFGAVVVRNDEVVMSCHNMVLKNTDPTAHAEVTVIREACKKLNRIELSDCEIYASCEPCPMCFGAIHLSRLKRLVYGAEAEAAIAIGFDDFIADALRGTGFYQKAHLEIKKADGSGAVIAEQVFEKTKSKFTMY

SEQ ID NO: 815 - protein, 309 aa, Arabidopsis thaliana
  misc_feature (1)..(309): Ceres CLONE ID no. 20769
  misc_feature (1)..(309): Also Known As Ceres CDNA ID no. 23556763
  misc_feature (1)..(309): Also Known As Ceres GEMINI ID 534G9
  misc_feature (152)..(190): Pfam Name: CCT Pfam Description: CCT motif
  misc_feature (214)..(251): Pfam Name: GATA Pfam Description: GATA zinc finger
  misc_feature (77)..(112): Pfam Name: Zim Pfam Description: ZIM motif
  misc_feature 86689:<222: Transcription Factor
  misc_feature: Phenotype: Activates expression of the gene endogenous to the AtSQS1 (SEQ ID NO 4150) regalutory region Useful for modulating Terpenoid Biosynthesis
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 816 - DNA, 834 bp, Populus balsamifera subsp. trichocarpa
  misc_feature (1)..(834): Ceres ANNOT ID no. 1443644
  misc_feature 86774:<222: Transcription Factor
  misc_feature: Phenotype: Activates expression of the gene endogenous to the AtSQS1 (SEQ ID NO 4150) regalutory region Useful for modulating Terpenoid Biosynthesis
atgtacactccctcgcagcctatgaacgttcacaatcagatcgtctctcctggcgttgacgacgacggtgccccagccgatcctatcgaccaccaccatcacattcactacgaagacggcacccctgcagtcgttgtcgaagacgtctctcccgattccgtctacgttaccgccggtgtcgctgcgtcggaactcgggattcagcctagtgatggttcgagtcagctcaccctgacgtttcgtggacaagtttatgttttcgattccgttactcctgacaaggttcaagctgtattgttattactgggaggatgtgaattaactcctggtctggaactgactcctcaaaatcaaaggggtgtgggggagtacccaccgcggtgtactcaacctcaacgagcagcttcattaagtaggttccggcagaagagaaaagagcgatgctttgataagaaagttagatatggtgtccgtcaggaggttgcactcaggatgcagcggaataagggtcaattcacctctgccaagaagtctgagggaggatatggctgggatggtggtcaggattcagcacaagatgatagccaacatgaaacctcgtgtacacattgtggcactaattcaaaatccactccaatgatgcggcgtggtccatctggtccaaggtctctttgcaatgcctgtgggcttttttgggcaaacagaaggatgacagtagctctggtgctatcctattggcagtgggtagccgagtccaagtcttcattttcacttttttatgatgagagagctgacctcgaaaaaggaacagacttagagatgctaatggaatga

SEQ ID NO: 817 - protein, 270 aa, Populus balsamifera subsp. trichocarpa
  misc_feature (1)..(270): Ceres ANNOT ID no. 1443644
  misc_feature (132)..(170): Pfam Name: CCT Pfam Description: CCT motif
  misc_feature (194)..(231): Pfam Name: GATA Pfam Description: GATA zinc finger
  misc_feature (62)..(97): Pfam Name: Zim Pfam Description: ZIM motif
  misc_feature: SWISSPROT Homolog: GAT26_ARATH GATA transcription factor 26 (ZIM protein) with e-value of 6.5e-166 and BLAST sequence identity of 100.0
  misc_feature: SWISSPROT Homolog: GAT25_ARATH GATA transcription factor 25 (ZIM-like 2 protein) with e-value of 5.7e-48 and BLAST sequence identity of 49.6
  misc_feature: SWISSPROT Homolog: GAT27_ARATH GATA transcription factor 27 (ZIM-like 1 protein) with e-value of 1.1e-46 and BLAST sequence identity of 50.7
  misc_feature: SWISSPROT Homolog: GAT16_ARATH GATA transcription factor 16 with e-value of 7.8e-07 and BLAST sequence identity of 37.7
  misc_feature: SWISSPROT Homolog: GAT10_ARATH GATA transcription factor 10 (AtGATA-10) with e-value of 3.2e-06 and BLAST sequence identity of 25.8
  misc_feature 86884:<222: Transcription Factor
  misc_feature: Phenotype: Activates expression of the gene endogenous to the AtSQS1 (SEQ ID NO 4150) regalutory region Useful for modulating Terpenoid Biosynthesis
  misc_feature (1)..(270): Functional Homolog of  Ceres CLONE ID no. 20769 at SEQ ID NO. 844 with e-value of 5.29E-60 and BLAST sequence identity of 61.1
MNVHNQIVSPGVDDDGAPADPIDHHHHIHYEDGTPAVVVEDVSPDSVYVTAGVAASELGIQPSDGSSQLTLTFRGQVYVFDSVTPDKVQAVLLLLGGCELTPGLELTPQNQRGVGEYPPRCTQPQRAASLSRFRQKRKERCFDKKVRYGVRQEVALRMQRNKGQFTSAKKSEGGYGWDGGQDSAQDDSQHETSCTHCGTNSKSTPMMRRGPSGPRSLCNACGLFWANRRMTVALVLSYWQWVAESKSSFSLFYDERADLEKGTDLEMLME

SEQ ID NO: 818 - protein, 295 aa, Arabidopsis thaliana
  misc_feature (1)..(295): Ceres CLONE ID no. 20945
  misc_feature (77)..(173): Pfam Name: HCNGP Pfam Description: HCNGP-like protein
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Varying Petiole Lengths Useful for making plants that grow better in shade
  misc_feature: Phenotype: ROSETTE LEAVES - Lobed Shaped Useful for making plants with increased biomass and foliage
MDEEEKGRGGEDSRTPRLLDGVGASSSAHGTPRSLDNDESSRPDWSNRMIGESGVADGERGDDASGESSDTLLDQFLPPRPRERCSEELQRKIDKFLSLKKMGKSFNSEVRNRKEYRNPDFLLHAVSYQDIDQIGSCFSKDVFDPSGYDPSDFCDAIEIDMKNERERKEQESKKNQKLDFVSAGTQPGAVFAAQKPNIPIPGIPALATSGLPSIPTEIAARDGRPNKKSKWDKVDGDVKNPPLAAGTQDSISSIRSNAALVSATSAGSGYSAFAQQRRREVEGRRSSERKLERRS

SEQ ID NO: 819 - DNA, 1218 bp, Populus balsamifera subsp. trichocarpa
  misc_feature (1)..(1218): Ceres ANNOT ID no. 1519797
  misc_feature 87081:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Varying Petiole Lengths Useful for making plants that grow better in shade
  misc_feature: Phenotype: ROSETTE LEAVES - Lobed Shaped Useful for making plants with increased biomass and foliage
atggcgtcaagaaagaaacatttagaaggaatcgcattactctcaatgtacaacgacgacgaagaagacgatgatgaagaaatggaagatctcgaacaccaaccaaaccaatctaacgacatggagcaagatactctgcacgacgataacgccatgcttaccgaagaattccaggatacagaagaagcagaagcagctaccgctagtcggaattcaactcccgaaggaagtcttttaaggcctttgacgccgctgcagcagcagctgcaacaaggagggactattaatttggagacgaagagaagtagtagtaggagagggagacttgctattgttgattatggtcacgatgaagttgccatgtcccctgaacctgaggaaggggagttcgaagaggagcttcaaagtgccaatggtgctatccaagaaaaatcttctccagcaactgctcagattttatctcctagtgttcgagcaactccacagtcatctgaacatctagaaccatcgcaacctggtgaaataaatgataccactaaggaatcagaagctttcaatgctgaaggtgctaatgaggttcctgcagagggtgttgatctgttggataaatttctttccccaccacctaaagagaagtgcccagaggacctgcaaaaaaaaattgataaatttcttgctttgaaaaaaattgggagaagcttcaatgcagaagtccgcaataggaaggattataggaacccggacttcttactgcatgctgtgaggtatcaagatattgatcagatagggtcttgcttcagtaaagatgtatttgaccctcatggatacgaccaaagcgactactatcttgagatagaggctgatatgaggcgtgaaagggagaggaaggagcaagagctaaagagaagtccaaaggttgaatttgtttcagggggaactcagcctggagtggttgtacctccaacaaagttcagtttgcctattccagccgatgcagctccccgcgagggtagacagaacaagaagtcaaaatgggataaggtggatggtgatggaaggaatcctttaccagctggtggacatgattctttagctgctgcagcagctctgttatccgcagctaatgttggttctggatacacgggttttgtgcagcagaaacggcgagaggcagaagaaaaaagatctggagaaaggaagttggaaagaagatcttga

SEQ ID NO: 820 - protein, 378 aa, Populus balsamifera subsp. trichocarpa
  misc_feature (1)..(378): Ceres ANNOT ID no. 1519797
  misc_feature (178)..(274): Pfam Name: HCNGP Pfam Description: HCNGP-like protein
  misc_feature: SWISSPROT Homolog: HCNGP_MOUSE Transcriptional regulator protein HCNGP with e-value of 4.9e-16 and BLAST sequence identity of 35.4
  misc_feature: SWISSPROT Homolog: YAN3_SCHPO Hypothetical protein C3H1.03 in chromosome I with e-value of 4.3e-08 and BLAST sequence identity of 26.7
  misc_feature 87196:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Varying Petiole Lengths Useful for making plants that grow better in shade
  misc_feature: Phenotype: ROSETTE LEAVES - Lobed Shaped Useful for making plants with increased biomass and foliage
  misc_feature (1)..(378): Functional Homolog of  Ceres CLONE ID no. 20945 at SEQ ID NO. 847 with e-value of 2.30E-73 and BLAST sequence identity of 61.5
MEDLEHQPNQSNDMEQDTLHDDNAMLTEEFQDTEEAEAATASRNSTPEGSLLRPLTPLQQQLQQGGTINLETKRSSSRRGRLAIVDYGHDEVAMSPEPEEGEFEEELQSANGAIQEKSSPATAQILSPSVRATPQSSEHLEPSQPGEINDTTKESEAFNAEGANEVPAEGVDLLDKFLSPPPKEKCPEDLQKKIDKFLALKKIGRSFNAEVRNRKDYRNPDFLLHAVRYQDIDQIGSCFSKDVFDPHGYDQSDYYLEIEADMRRERERKEQELKRSPKVEFVSGGTQPGVVVPPTKFSLPIPADAAPREGRQNKKSKWDKVDGDGRNPLPAGGHDSLAAAAALLSAANVGSGYTGFVQQKRREAEEKRSGERKLERRS

SEQ ID NO: 821 - protein, 218 aa, Arabidopsis thaliana
  misc_feature (1)..(218): Ceres CLONE ID no. 21068
  misc_feature (80)..(144): Pfam Name: AP2 Pfam Description: AP2 domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
MDPLLIQSPFSGFSPEYSIGSSPESFSSSSSNNYSLPFNENDSEEMFLYGLIEQSTQQTYIDSELQDLPIKSVSSRKSEKSYRGVRRRPWGKFAAEIRDSTRNGIRVWLGTFESAEEAALAYDQAAFSMRGSSAILNFSAERVQESLSEIKCTYEDGCSPVVALKRKHSMRRRMTNKKTKDSDFDHRSVKLDNVVVFEDLGEQYLEELLGSSENSGTW

SEQ ID NO: 822 - DNA, 666 bp, Populus balsamifera subsp. trichocarpa
  misc_feature (1)..(666): Ceres ANNOT ID no. 1463333
  misc_feature 87420:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atggatgcctccatctttcactctgcaaattctgatttctcatccgaatcttgttttagatcaccagactctttttatagccaatcttttaaccaaagttctctccctttcaatgaaaatgactccgacgaaatgcttctttttgaactaatctcggaggccactcaagaaacatcaagaacaactttctgtaatggaattgttaaggaagaagaggtcagttcagttgccaaaagaactcccgacaaggaaaagtcctacaggggtgttaggaggcggccatggggcaaattcgcagcggagataagggattccacaaggaatggcataagggtatggttaggcacatttgacagtgcagaagcagctgctttggcttatgatcaagctgctttttcgatgagaggacctgggactatactaaatttcccagttgaaagagtgagggagtcgcttaaggatatgaagtgtagtcatcattatgaggatgggtgctcacctgtggtggctctaaagagaaagtactccatgagaaggaaattgggaagcaggggcaagaaagagaggaatgcaaggatagaaaatgtagtcgttttggaagatctaggtgctgattatttggaacaactgttgaattcatctggaaaggctacgagtccttggtga

SEQ ID NO: 823 - protein, 221 aa, Populus balsamifera subsp. trichocarpa
  misc_feature (1)..(221): Ceres ANNOT ID no. 1463333
  misc_feature (85)..(149): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 2.2e-110 and BLAST sequence identity of 97.7
  misc_feature: SWISSPROT Homolog: ERF15_ARATH Ethylene-responsive transcription factor 15 EREBP-15 (AtERF15) with e-value of 1.3e-40 and BLAST sequence identity of 47.5
  misc_feature: SWISSPROT Homolog: PTI5_LYCES Pathogenesis-related genes transcriptional activator PTI5 (PTO-interacting protein 5) with e-value of 3.3e-29 and BLAST sequence identity of 57.3
  misc_feature: SWISSPROT Homolog: ERF1_LYCES Ethylene-responsive transcription factor 1 EREBP-1 (ERF1-like protein) (LeERF1) with e-value of 7.0e-27 and BLAST sequence identity of 48.7
  misc_feature: SWISSPROT Homolog: ERF2_NICSY Ethylene-responsive transcription factor 2 EREBP-2 (NsERF2) with e-value of 8.9e-27 and BLAST sequence identity of 76.3
  misc_feature 87536:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(221): Functional Homolog of  Ceres CLONE ID no. 21068 at SEQ ID NO. 850 with e-value of 2.79E-61 and BLAST sequence identity of 63.2
MDASIFHSANSDFSSESCFRSPDSFYSQSFNQSSLPFNENDSDEMLLFELISEATQETSRTTFCNGIVKEEEVSSVAKRTPDKEKSYRGVRRRPWGKFAAEIRDSTRNGIRVWLGTFDSAEAAALAYDQAAFSMRGPGTILNFPVERVRESLKDMKCSHHYEDGCSPVVALKRKYSMRRKLGSRGKKERNARIENVVVLEDLGADYLEQLLNSSGKATSPW

SEQ ID NO: 824 - DNA, 687 bp, Populus balsamifera subsp. trichocarpa
  misc_feature (1)..(687): Ceres ANNOT ID no. 1505772
  misc_feature 87632:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atggaatcttctttgttttaccatgatcaatacctaaattctgatttctcccctgaatgttcttttggttctttagattcattttcatgggatgaacttcttttccagagcaattcacttccttttaacactaatgactcggaggaaatggtcctttttaatgctttagccaatggaccgcccaaggaatcctcagaatctaattcttcaagtggaattaaggaagaggaagtgacttcaaatgcgaaagaagaggaggaggctaagagagagaaatcttacagaggggttagaaggcggccatgggggaagtatgctgcagagataagggattctacaaggaatggcatcagggtttggctagggacctttgatagtgcagaggcagctgctttggcatatgatcaagcagcattttccatgcggggttcgatggctgttctcaattttcctgtggagatggtgagagagtcacttcaagacatgaattatagatgtgaagatgggtgttcgcctgtggtggcactgaagaggaaacactctatgagaagaaaatcaaagagttggaaaactaaagtaaatcaagtacctcatagtaggccacaaaatgtggtggttttggaggatttgggagctgactacctggaagagcttctgaattcatgtgacacttctaattcttggtga

SEQ ID NO: 825 - protein, 228 aa, Populus balsamifera subsp. trichocarpa
  misc_feature (1)..(228): Ceres ANNOT ID no. 1505772
  misc_feature (92)..(156): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 2.2e-110 and BLAST sequence identity of 97.7
  misc_feature: SWISSPROT Homolog: ERF15_ARATH Ethylene-responsive transcription factor 15 EREBP-15) (AtERF15) with e-value of 1.3e-40 and BLAST sequence identity of 47.5
  misc_feature: SWISSPROT Homolog: PTI5_LYCES Pathogenesis-related genes transcriptional activator PTI5 (PTO-interacting protein 5) with e-value of 3.3e-29 and BLAST sequence identity of 57.3
  misc_feature: SWISSPROT Homolog: ERF1_LYCES Ethylene-responsive transcription factor 1 EREBP-1 (ERF1-like protein) (LeERF1) with e-value of 7.0e-27 and BLAST sequence identity of 48.7
  misc_feature: SWISSPROT Homolog: ERF2_NICSY Ethylene-responsive transcription factor 2 EREBP-2 (NsERF2) with e-value of 8.9e-27 and BLAST sequence identity of 76.3
  misc_feature 87748:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(228): Functional Homolog of  Ceres CLONE ID no. 21068 at SEQ ID NO. 850 with e-value of 1.90E-55 and BLAST sequence identity of 61.9
MESSLFYHDQYLNSDFSPECSFGSLDSFSWDELLFQSNSLPFNTNDSEEMVLFNALANGPPKESSESNSSSGIKEEEVTSNAKEEEEAKREKSYRGVRRRPWGKYAAEIRDSTRNGIRVWLGTFDSAEAAALAYDQAAFSMRGSMAVLNFPVEMVRESLQDMNYRCEDGCSPVVALKRKHSMRRKSKSWKTKVNQVPHSRPQNVVVLEDLGADYLEELLNSCDTSNSW

SEQ ID NO: 826 - DNA, 681 bp, Populus balsamifera subsp. trichocarpa
  misc_feature (1)..(681): Ceres ANNOT ID no. 1495675
  misc_feature 87847:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atggaaccctctttgttttaccataatcaatacctaaattcagatctctcccctgaatcttcttttggttctttagattcatttccatgggatgatctttttcagagcagttcccttccttttaacaccagtgactcaggggagatggtactgtttaatgatttaggcgccgatggtgccaaggagtcctcggaatctaattcctcgagtggaattaaggaagaggaagtgacttcaaatgccaaagaagaggagccaaagaaagagaaatcctacagaggggttaggaggcggccatggggtaaatatgctgcagagataagggattctacaagaaatggcgtccgggtttggctaggaacctttgatagtgcagaggcggctgctttggcttatgatcaagcagcattttccatgcggggttcgatggctgtactaaatttctctgtggagatggtgagagaatcacttgaagacatgaagtatagatgtgaagatgggtgttcgcctgtggtggcacttaagaggagacactccgtgagaagaaaatcaacaagtaggaaaagtaaagtgaatcaagtagctaatactagacaacaaaatgtggtggttttggaggatttgggagctgactaccttgaagagcttctgaattcatgtgagagctctagttcttggtga

SEQ ID NO: 827 - protein, 226 aa, Populus balsamifera subsp. trichocarpa
  misc_feature (1)..(226): Ceres ANNOT ID no. 1495675
  misc_feature (90)..(154): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 2.2e-110 and BLAST sequence identity of 97.7
  misc_feature: SWISSPROT Homolog: ERF15_ARATH Ethylene-responsive transcription factor 15 EREBP-15 (AtERF15) with e-value of 1.3e-40 and BLAST sequence identity of 47.5
  misc_feature: SWISSPROT Homolog: PTI5_LYCES Pathogenesis-related genes transcriptional activator PTI5 (PTO-interacting protein 5) with e-value of 3.3e-29 and BLAST sequence identity of 57.3
  misc_feature: SWISSPROT Homolog: ERF1_LYCES Ethylene-responsive transcription factor 1 EREBP-1 (ERF1-like protein) (LeERF1) with e-value of 7.0e-27 and BLAST sequence identity of 48.7
  misc_feature: SWISSPROT Homolog: ERF2_NICSY Ethylene-responsive transcription factor 2 EREBP-2 (NsERF2) with e-value of 8.9e-27 and BLAST sequence identity of 76.3
  misc_feature 87963:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(226): Functional Homolog of  Ceres CLONE ID no. 21068 at SEQ ID NO. 850 with e-value of 7.40E-54 and BLAST sequence identity of 58.5
MEPSLFYHNQYLNSDLSPESSFGSLDSFPWDDLFQSSSLPFNTSDSGEMVLFNDLGADGAKESSESNSSSGIKEEEVTSNAKEEEPKKEKSYRGVRRRPWGKYAAEIRDSTRNGVRVWLGTFDSAEAAALAYDQAAFSMRGSMAVLNFSVEMVRESLEDMKYRCEDGCSPVVALKRRHSVRRKSTSRKSKVNQVANTRQQNVVVLEDLGADYLEELLNSCESSSSW

SEQ ID NO: 828 - DNA, 678 bp, Populus balsamifera subsp. trichocarpa
  misc_feature (1)..(678): Ceres ANNOT ID no. 1469576
  misc_feature 88062:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atggattcttcattttttcactaccaaaactcacaattctccccggaatcttcttcctccttcaattcccttgattcttcctcatgtaacgcacagaacttctacagccaaccccttccttttaacgaaaatgattcccaagaaatgcttctcttaggactcctcaatgaggcccccatcaactcttttgataccacatcatccaccaattccaactacgatgaggtaagttcaagagctgattatcaaggggaacagccccgagaaatctcttatagaggggttagaaggcggccctggggcaagtacgccgccgagataagggattcgacaagaaacggtgtgagagtttggctaggaacatttgatactgccgaggcggcggccttagcttatgatcaagctgcatttgcaatgagaggttcaatggcagtactaaattttcctgcccaaaaagtctacgagtcactcaaagaaacgggctatggcttccaagaaggacaatcaccaattttagcaatgaaaaaaagacattcaatgaacaggaaagccgagagtaggaagaggaaagagaaagaaataagaacggaaatggaaaatgtcgtcgtgctagaggatttaggggctgaatatttggaggaactgctagccatttcagagagtgctagtccttggtga

SEQ ID NO: 829 - protein, 225 aa, Populus balsamifera subsp. trichocarpa
  misc_feature (1)..(225): Ceres ANNOT ID no. 1469576
  misc_feature (90)..(154): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 2.2e-110 and BLAST sequence identity of 97.7
  misc_feature: SWISSPROT Homolog: ERF15_ARATH Ethylene-responsive transcription factor 15 EREBP-15 (AtERF15) with e-value of 1.3e-40 and BLAST sequence identity of 47.5
  misc_feature: SWISSPROT Homolog: PTI5_LYCES Pathogenesis-related genes transcriptional activator PTI5 (PTO-interacting protein 5) with e-value of 3.3e-29 and BLAST sequence identity of 57.3
  misc_feature: SWISSPROT Homolog: ERF1_LYCES Ethylene-responsive transcription factor 1 EREBP-1 (ERF1-like protein) (LeERF1) with e-value of 7.0e-27 and BLAST sequence identity of 48.7
  misc_feature: SWISSPROT Homolog: ERF2_NICSY Ethylene-responsive transcription factor 2 EREBP-2 (NsERF2) with e-value of 8.9e-27 and BLAST sequence identity of 76.3
  misc_feature 88178:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(225): Functional Homolog of  Ceres CLONE ID no. 21068 at SEQ ID NO. 850 with e-value of 1.40E-52 and BLAST sequence identity of 54.4
MDSSFFHYQNSQFSPESSSSFNSLDSSSCNAQNFYSQPLPFNENDSQEMLLLGLLNEAPINSFDTTSSTNSNYDEVSSRADYQGEQPREISYRGVRRRPWGKYAAEIRDSTRNGVRVWLGTFDTAEAAALAYDQAAFAMRGSMAVLNFPAQKVYESLKETGYGFQEGQSPILAMKKRHSMNRKAESRKRKEKEIRTEMENVVVLEDLGAEYLEELLAISESASPW

SEQ ID NO: 830 - DNA, 654 bp, Populus balsamifera subsp. trichocarpa
  misc_feature (1)..(654): Ceres ANNOT ID no. 1442758
  misc_feature 88277:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atggtgacgtcggcaaggtataggcaatcgtgggaccaatcccgccgccattcatttccatgggatgatctttttcagagcagttcccttccttttaacaccagtgactcaggggagatggtactgtttaatgatttaggcgccgatggtgccaaggagtcctcggaatctaattcctcgagtggaattaaggaagaggaagtgacttcaaatgccaaagaagaggagccaaagaaagagaaatcctacagaggggttaggaggcggccatggggtaaatatgctgcagagataagggattctacaagaaatggcgtccgggtttggctaggaacctttgatagtgcagaggcggctgctttggcttatgatcaagcagcattttccatgcggggttcgatggctgtactaaatttctctgtggagatggtgagagaatcacttgaagacatgaagtatagatgtgaagatgggtgttcgcctgtggtggcacttaagaggagacactccgtgagaagaaaatcaacaagtaggaaaagtaaagtgaatcaagtagctaatactagacaacaaaatgtggtggttttggaggatttgggagctgactaccttgaagagcttctgaattcatgtgagagctctagttcttggtga

SEQ ID NO: 831 - protein, 217 aa, Populus balsamifera subsp. trichocarpa
  misc_feature (1)..(217): Ceres ANNOT ID no. 1442758
  misc_feature (81)..(145): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 2.2e-110 and BLAST sequence identity of 97.7
  misc_feature: SWISSPROT Homolog: ERF15_ARATH Ethylene-responsive transcription factor 15 EREBP-15 (AtERF15) with e-value of 1.3e-40 and BLAST sequence identity of 47.5
  misc_feature: SWISSPROT Homolog: PTI5_LYCES Pathogenesis-related genes transcriptional activator PTI5 (PTO-interacting protein 5) with e-value of 3.3e-29 and BLAST sequence identity of 57.3
  misc_feature: SWISSPROT Homolog: ERF1_LYCES Ethylene-responsive transcription factor 1 EREBP-1 (ERF1-like protein) (LeERF1) with e-value of 7.0e-27 and BLAST sequence identity of 48.7
  misc_feature: SWISSPROT Homolog: ERF2_NICSY Ethylene-responsive transcription factor 2 EREBP-2 (NsERF2) with e-value of 8.9e-27 and BLAST sequence identity of 76.3
  misc_feature 88391:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(217): Functional Homolog of  Ceres CLONE ID no. 21068 at SEQ ID NO. 850 with e-value of 4.70E-52 and BLAST sequence identity of 60.9
MVTSARYRQSWDQSRRHSFPWDDLFQSSSLPFNTSDSGEMVLFNDLGADGAKESSESNSSSGIKEEEVTSNAKEEEPKKEKSYRGVRRRPWGKYAAEIRDSTRNGVRVWLGTFDSAEAAALAYDQAAFSMRGSMAVLNFSVEMVRESLEDMKYRCEDGCSPVVALKRRHSVRRKSTSRKSKVNQVANTRQQNVVVLEDLGADYLEELLNSCESSSSW

SEQ ID NO: 832 - protein, 87 aa, Arabidopsis thaliana
  misc_feature (1)..(87): Ceres CLONE ID no. 21075
  misc_feature (1)..(87): Also Known As Ceres CDNA ID no. 23386664
  misc_feature (1)..(87): Also Known As Ceres GEMINI ID 531F7
  misc_feature (22)..(86): Pfam Name: zf-Tim10_DDP Pfam Description: Tim10/DDP family zinc finger
  misc_feature 88507:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MDSYSSPPMGGSGSSVSPEVMMESVKTQLAQAYAEELIETLRTKCFDKCVTKPGSSLGGSESSCISRCVERYMEATAIISRSLFTQR

SEQ ID NO: 833 - DNA, 270 bp, Populus balsamifera subsp. trichocarpa
  misc_feature (1)..(270): Ceres ANNOT ID no. 1520467
  misc_feature 88558:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggattcgttttcttcacattcaagtatgggatctgggtcaccccaaatttcagctgaagacttgaaggaccagttaaagaatcaacttgcacaagcttatgcccaggagttccttgagactgtgagggagaaatgctttgaaaagtgcattacaagaccagggtcaagcctgagtgggagcgaaagtagctgcacctctaggtgtgtggaacgctacatcgaggctactggcatcatcagtagagcccttttcagtgcaccacgctga

SEQ ID NO: 834 - protein, 89 aa, Populus balsamifera subsp. trichocarpa
  misc_feature (1)..(89): Ceres ANNOT ID no. 1520467
  misc_feature (23)..(87): Pfam Name: zf-Tim10_DDP Pfam Description: Tim10/DDP family zinc finger
  misc_feature: SWISSPROT Homolog: TIM13_ARATH Mitochondrial import inner membrane translocase subunit Tim13 with e-value of 1.0e-41 and BLAST sequence identity of 100.0
  misc_feature: SWISSPROT Homolog: TIM13_ORYSA Mitochondrial import inner membrane translocase subunit Tim13 with e-value of 7.2e-25 and BLAST sequence identity of 64.7
  misc_feature: SWISSPROT Homolog: TI13B_XENLA Mitochondrial import inner membrane translocase subunit Tim13 B with e-value of 7.4e-16 and BLAST sequence identity of 46.4
  misc_feature: SWISSPROT Homolog: TIM13_HUMAN Mitochondrial import inner membrane translocase subunit Tim13 with e-value of 7.4e-16 and BLAST sequence identity of 50.0
  misc_feature: SWISSPROT Homolog: TIM13_MOUSE Mitochondrial import inner membrane translocase subunit Tim13 with e-value of 7.4e-16 and BLAST sequence identity of 45.8
  misc_feature 88642:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(89): Functional Homolog of  Ceres CLONE ID no. 21075 at SEQ ID NO. 861 with e-value of 8.89E-26 and BLAST sequence identity of 65.8
MDSFSSHSSMGSGSPQISAEDLKDQLKNQLAQAYAQEFLETVREKCFEKCITRPGSSLSGSESSCTSRCVERYIEATGIISRALFSAPR

SEQ ID NO: 835 - DNA, 270 bp, Populus balsamifera subsp. trichocarpa
  misc_feature (1)..(270): Ceres ANNOT ID no. 1494915
  misc_feature 88701:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggattcattttcttcacattcaagtatgggatctgggtcaccccaaatgtcagcagaagattttaaggaccagttaaagaatcaacttgcacaagcttatgcccaggagttccttgagactgtgagggacaaatgctttgccaagtgtataacaaaaccagggtcaagcctgagtgggagcgaaagtagctgcatctccaggtgtgtggaacgctacattgaggctactggcatcatcagtaaagctcttttcaatgcaccacgctga

SEQ ID NO: 836 - protein, 89 aa, Populus balsamifera subsp. trichocarpa
  misc_feature (1)..(89): Ceres ANNOT ID no. 1494915
  misc_feature (23)..(87): Pfam Name: zf-Tim10_DDP Pfam Description: Tim10/DDP family zinc finger
  misc_feature: SWISSPROT Homolog: TIM13_ARATH Mitochondrial import inner membrane translocase subunit Tim13 with e-value of 1.0e-41 and BLAST sequence identity of 100.0
  misc_feature: SWISSPROT Homolog: TIM13_ORYSA Mitochondrial import inner membrane translocase subunit Tim13 with e-value of 7.2e-25 and BLAST sequence identity of 64.7
  misc_feature: SWISSPROT Homolog: TI13B_XENLA Mitochondrial import inner membrane translocase subunit Tim13 B with e-value of 7.4e-16 and BLAST sequence identity of 46.4
  misc_feature: SWISSPROT Homolog: TIM13_HUMAN Mitochondrial import inner membrane translocase subunit Tim13 with e-value of 7.4e-16 and BLAST sequence identity of 50.0
  misc_feature: SWISSPROT Homolog: TIM13_MOUSE Mitochondrial import inner membrane translocase subunit Tim13 with e-value of 7.4e-16 and BLAST sequence identity of 45.8
  misc_feature 88785:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(89): Functional Homolog of  Ceres CLONE ID no. 21075 at SEQ ID NO. 861 with e-value of 2.40E-25 and BLAST sequence identity of 67.8
MDSFSSHSSMGSGSPQMSAEDFKDQLKNQLAQAYAQEFLETVRDKCFAKCITKPGSSLSGSESSCISRCVERYIEATGIISKALFNAPR

SEQ ID NO: 837 - protein, 133 aa, Arabidopsis thaliana
  misc_feature (1)..(133): Ceres CLONE ID no. 21374
  misc_feature (39)..(112): Pfam Name: MBD Pfam Description: Methyl-CpG binding domain
MSMKISEVEYKRTRFFARRKKVCPVKMLEILNYDSSRTWVIDKPGLPRTPRGFKRSLILRKDYSKMDAYYITPTGKKLKSRNEIAAFIDANQDYKYALLGDFNFTVPKVMEETVPSGILSDRTPKPSRKVTID

SEQ ID NO: 838 - DNA, 549 bp, Populus balsamifera subsp. trichocarpa
  misc_feature (1)..(549): Ceres ANNOT ID no. 1471763
  misc_feature 88892:<222: Transcription Factor
atggcactgaaagagcgtagtcccgaaacccctaaaacctcctccaagaatccacgagttgcagtgcgatcaattgatacatatgctgcacaatgcgacaaatgcttaaaatggagggtgattgcaactgaagaagagtatgaggagatcagaagtaaaatggaagagtctccatttgtttgcaacagaaaacctggtgtatcttgtgatgatcctgctgacattgagtacaatgccactcgaacctgggtcattgataggcctggcattccaaagacaccagaaggttttaaaaggagcttggttcttagacgtgatttctccaaaatggatgcttactatatcacacccacaggaaagaagctgagaacacgtaacgagatagcagcatttatagatgcaaatccaaaatacaaagatgtaaacctatctgacttcaattttacctctccgaaggtaatggaagacaccatcccagaagatgctgtgagaaaggtttcctctagtggaaatggcaacaaaaggaaggcattaaaggatgcagcttaa

SEQ ID NO: 839 - protein, 182 aa, Populus balsamifera subsp. trichocarpa
  misc_feature (1)..(182): Ceres ANNOT ID no. 1471763
  misc_feature (27)..(76): Pfam Name: zf-CW Pfam Description: CW-type Zinc Finger
  misc_feature (83)..(156): Pfam Name: MBD Pfam Description: Methyl-CpG binding domain
  misc_feature 88942:<222: Transcription Factor
  misc_feature (1)..(182): Functional Homolog of  Ceres CLONE ID no. 21374 at SEQ ID NO. 866 with e-value of 1.89E-32 and BLAST sequence identity of 72.9
MALKERSPETPKTSSKNPRVAVRSIDTYAAQCDKCLKWRVIATEEEYEEIRSKMEESPFVCNRKPGVSCDDPADIEYNATRTWVIDRPGIPKTPEGFKRSLVLRRDFSKMDAYYITPTGKKLRTRNEIAAFIDANPKYKDVNLSDFNFTSPKVMEDTIPEDAVRKVSSSGNGNKRKALKDAA

SEQ ID NO: 840 - DNA, 549 bp, Populus balsamifera subsp. trichocarpa
  misc_feature (1)..(549): Ceres ANNOT ID no. 1482788
  misc_feature 89004:<222: Transcription Factor
atggcactgaaagagcgtagtcctgaaacccctaaaacatcccccaagaatccacgagttgccgtgcgatcaattgatacatatgctgcacaatgcgacaaatgcttaaaatggagggtgattccgactgaagaagagtacgaggagataagaagtaaaatggaagagaatccatatgtttgtgacagaaaacctggcgtatcttgtgatgatcctgctgacattgagtacaatgccactcgaacctgggtcattgataggcctggtgttcccaagactccggaaggttttaaaaggagcttggtgcttagacgtgatttctcaaaaatggatgcttactatatcactcccacaggaaagaagctgagaacacgcaatgagatagcagcatttatagaagcaaatccaaaatacaaagatgtaaacctctctgccttcaattttacttctccaaaggtaatggaagacaccatccctgaagatgctgtgagaaaggttccctctagtgcaaatggcaacaaaaagaaggcattaaaggattcagcttga

SEQ ID NO: 841 - protein, 182 aa, Populus balsamifera subsp. trichocarpa
  misc_feature (1)..(182): Ceres ANNOT ID no. 1482788
  misc_feature (27)..(76): Pfam Name: zf-CW Pfam Description: CW-type Zinc Finger
  misc_feature (83)..(156): Pfam Name: MBD Pfam Description: Methyl-CpG binding domain
  misc_feature 89054:<222: Transcription Factor
  misc_feature (1)..(182): Functional Homolog of  Ceres CLONE ID no. 21374 at SEQ ID NO. 866 with e-value of 4.50E-31 and BLAST sequence identity of 70.5
MALKERSPETPKTSPKNPRVAVRSIDTYAAQCDKCLKWRVIPTEEEYEEIRSKMEENPYVCDRKPGVSCDDPADIEYNATRTWVIDRPGVPKTPEGFKRSLVLRRDFSKMDAYYITPTGKKLRTRNEIAAFIEANPKYKDVNLSAFNFTSPKVMEDTIPEDAVRKVPSSANGNKKKALKDSA

SEQ ID NO: 842 - protein, 153 aa, Arabidopsis thaliana
  misc_feature (1)..(153): Ceres CLONE ID no. 21563
  misc_feature (25)..(97): Pfam Name: Peptidase_S24 Pfam Description: Peptidase S24-like
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
MIVTSALIIWKALICVTGSESPVVVVLSESMEPGFQRGDILFLRMTDEPIRAGEIVVFSVDGREIPIVHRAIKVHERGDTKAVDVLTKGDNNDIDDIGLYAEGQLWLHRHHIMGRAVGFLPYVGWVTIIMTEKPIIKYILIGALGLLVITSKD

SEQ ID NO: 843 - DNA, 543 bp, Populus balsamifera subsp. trichocarpa
  misc_feature (1)..(543): Ceres ANNOT ID no. 1438905
  misc_feature 89216:<222: Transcription Factor
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
atgggttggatcggagacaccgtagactccattaaatcgatccagattcggcagctactcacccaggccgtcagtttaggaatgattgttacatctgcactgataatatggaaggcattgatgtgcatcactggcagtgaatctcctgtggtggttgttctctctggaagtatggaacctggcttcaagaggggtgacattttgttcttgcacatgagtaaagatcctattcgcacaggagaaattgttgtttttaatgttgatggtcgtgaaattccaattgtccatcgtgtgattaaggtccatgaaaggcaagatactggggaagttgatgtcctcacaaaaggagataacaattatggggatgataggcttttatatgctcaagggcagctttggcttcagcggcaccacatcatgggcagagctgttgggtttttaccttatgttggttgggtaaccattataatgactgaaaagcctattatcaagtatattcttatcggcgcgttgggattgcttgtcataacttcaaaggactaa

SEQ ID NO: 844 - protein, 153 aa, Populus balsamifera subsp. trichocarpa
  misc_feature (1)..(153): Ceres ANNOT ID no. 1438905
  misc_feature (25)..(97): Pfam Name: Peptidase_S24 Pfam Description: Peptidase S24-like
  misc_feature: SWISSPROT Homolog: SPC21_RAT Microsomal signal peptidase 21 kDa subunit (EC 3.4.-.-) (SPase 21 kDa subunit) (SPC21) (SEC11-like 3) with e-value of 2.5e-47 and BLAST sequence identity of 62.3
  misc_feature: SWISSPROT Homolog: SPC21_CANFA Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature: SWISSPROT Homolog: SPC21_HUMAN Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature: SWISSPROT Homolog: SPC21_MOUSE Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature: SWISSPROT Homolog: SPC21_PONPY Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature 89349:<222: Transcription Factor
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(153): Functional Homolog of  Ceres CLONE ID no. 21563 at SEQ ID NO. 871 with e-value of 1.39E-66 and BLAST sequence identity of 86.9
MIVTSALIIWKALMCITGSESPVVVVLSGSMEPGFKRGDILFLHMSKDPIRTGEIVVFNVDGREIPIVHRVIKVHERQDTGEVDVLTKGDNNYGDDRLLYAQGQLWLQRHHIMGRAVGFLPYVGWVTIIMTEKPIIKYILIGALGLLVITSKD

SEQ ID NO: 845 - DNA, 696 bp, Populus balsamifera subsp. trichocarpa
  misc_feature (1)..(696): Ceres ANNOT ID no. 1483143
  misc_feature 89454:<222: Transcription Factor
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
atggggtggatagcagagaacgtagagtcaatcaaatccatgaagatcagagacactctctctcaattgatcactcttgggatgatagtgtcgatggctttaataatatggaaagccttgatgtgtttaactggtagcgaatctcctgttgttgttgttctttctggtagcatggaacctgctttcaaacgagttaagaatcccatgtttttttttttgggagacattttgttcttgcatatgagcgaggccccctttcgcgcgggagagattgttgtgtataatgtagaattcccggtcataagaatgcggggcccactgttcctccatgtgggacccgctttaatgtgtaacgaggagcagtgctggtggagtgctgatagttcttcaaaaggaacaatgaggggagagccaattccaattgtccatcgagtagttgaggttcatgaacaggaaaatactggaaaggttgatatccttactaaaggagatgctaatgatgcggatgacaggggtttgtatgcttatggtcagtattggttgaagccacaacaaattatggggagagctgttgggttcatgccttacgccggttgggttacaatcgtgatgactgagaaacctattatcaaggtagtgtctaggtacatgcttataggcgctctaggtctgctggttataacctccaaggattaa

SEQ ID NO: 846 - protein, 231 aa, Populus balsamifera subsp. trichocarpa
  misc_feature (1)..(231): Ceres ANNOT ID no. 1483143
  misc_feature: SWISSPROT Homolog: SPC21_RAT Microsomal signal peptidase 21 kDa subunit (EC 3.4.-.-) (SPase 21 kDa subunit) (SPC21) (SEC11-like 3) with e-value of 2.5e-47 and BLAST sequence identity of 62.3
  misc_feature: SWISSPROT Homolog: SPC21_CANFA Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature: SWISSPROT Homolog: SPC21_HUMAN Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature: SWISSPROT Homolog: SPC21_MOUSE Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature: SWISSPROT Homolog: SPC21_PONPY Microsomal signal peptidase 21 kDa subunit (EC 3.4.-.-) (SPase 21 kDa subunit) (SPC21) (SEC11-like 3) with e-value of 3.2e-47 and BLAST sequence identity of 62.3
  misc_feature 89585:<222: Transcription Factor
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(231): Functional Homolog of  Ceres CLONE ID no. 21563 at SEQ ID NO. 871 with e-value of 3.59E-45 and BLAST sequence identity of 74.5
MGWIAENVESIKSMKIRDTLSQLITLGMIVSMALIIWKALMCLTGSESPVVVVLSGSMEPAFKRVKNPMFFFLGDILFLHMSEAPFRAGEIVVYNVEFPVIRMRGPLFLHVGPALMCNEEQCWWSADSSSKGTMRGEPIPIVHRVVEVHEQENTGKVDILTKGDANDADDRGLYAYGQYWLKPQQIMGRAVGFMPYAGWVTIVMTEKPIIKVVSRYMLIGALGLLVITSKD

SEQ ID NO: 847 - protein, 160 aa, Arabidopsis thaliana
  misc_feature (1)..(160): Ceres CLONE ID no. 21604
  misc_feature (1)..(160): Also Known As Ceres CDNA ID no. 23383311
  misc_feature (1)..(160): Also Known As Ceres GEMINI ID 533F7
  misc_feature (1)..(59): Pfam Name: Histone Pfam Description: Core histone H2A/H2B/H3/H4
  misc_feature 89725:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
MKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 848 - DNA, 858 bp, Populus balsamifera subsp. trichocarpa
  misc_feature (1)..(858): Ceres ANNOT ID no. 1473854
  misc_feature 89791:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggacaacaccaccaccaatcaccagcctcagcccacggcatacccaacgcaatccatcaccaccactccaccactacctccagcaggtggagcaccatcctcaaccccattccaccacctcctccaacaacaacagcaacaacttcaaatgttttggtcttaccaacgtcaagaaattgaacaagttaatgatttcaagaaccatcaactccctttagcaagaatcaagaaaatcatgaaagctgacgaggatgtgcgcatgatctctgctgaagcacctattctctttgctaaagcatgtgagcttttcattttagaactgacaattcgttcttggcttcacgctgaggaaaacaagagaaggactttacagaagaatgacattgctgctgctattacaagaactgacatttttgatttcttggttgatattgtacctagagatgagatcaaagaggaagctgctggtcttggtggaattgtcggtgctacggctagtggggtgccatattattaccctccgatgggacagcctgccgctgccactggagggatgatgatcggaaggccagccatggatcctgccactggggtgtatgttcaaccaccatctcaggcttggcagtctgtttggcagacagctgccaccgaagatggttcttatgggagtggtggtgcgagtggtggacaagggaatcttgatggacaagatggtttaatggctgttagatatcactttaatgaggatttcttttgcatgcccatgcttaaaggtgttagccacttgttggcaccttggtgggttttgtacgcttatgttggttggttcaagcacgcgacaatgaagaacttttga

SEQ ID NO: 849 - protein, 285 aa, Populus balsamifera subsp. trichocarpa
  misc_feature (1)..(285): Ceres ANNOT ID no. 1473854
  misc_feature (63)..(138): Pfam Name: Histone Pfam Description: Core histone H2A/H2B/H3/H4
  misc_feature: SWISSPROT Homolog: NFYC1_ARATH Nuclear transcription factor Y subunit C-1 (AtNF-YC-1) (Transcriptional activator HAP5A) with e-value of 2.6e-84 and BLAST sequence identity of 100.0
  misc_feature: SWISSPROT Homolog: NFYC4_ARATH Nuclear transcription factor Y subunit C-4 (AtNF-YC-4) with e-value of 8.9e-75 and BLAST sequence identity of 89.0
  misc_feature: SWISSPROT Homolog: NFYC3_ARATH Nuclear transcription factor Y subunit C-3 (AtNF-YC-3) with e-value of 1.9e-40 and BLAST sequence identity of 66.4
  misc_feature: SWISSPROT Homolog: NFYC9_ARATH Nuclear transcription factor Y subunit C-9 (AtNF-YC-9) (Transcriptional activator HAP5C) with e-value of 2.5e-38 and BLAST sequence identity of 64.7
  misc_feature: SWISSPROT Homolog: NFYC2_ARATH Nuclear transcription factor Y subunit C-2 (AtNF-YC-2) (Transcriptional activator HAP5B) with e-value of 5.6e-34 and BLAST sequence identity of 71.9
  misc_feature 89900:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(285): Functional Homolog of  Ceres CLONE ID no. 21604 at SEQ ID NO. 876 with e-value of 2.19E-68 and BLAST sequence identity of 90.9
MDNTTTNHQPQPTAYPTQSITTTPPLPPAGGAPSSTPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKEEAAGLGGIVGATASGVPYYYPPMGQPAAATGGMMIGRPAMDPATGVYVQPPSQAWQSVWQTAATEDGSYGSGGASGGQGNLDGQDGLMAVRYHFNEDFFCMPMLKGVSHLLAPWWVLYAYVGWFKHATMKNF

SEQ ID NO: 850 - DNA, 717 bp, Populus balsamifera subsp. trichocarpa
  misc_feature (1)..(717): Ceres ANNOT ID no. 1521997
  misc_feature 89995:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggacaacaccaacaccaacaccaatcaccagcctcaatccaccgcatacccgccacactccaccaccaccactccaccaccaccaccaccaggggcaccatcctcagccccattccaccacctccttcaacaacaacagcagcaacttcaaatgttttggtcttaccagcgtcaggaaattgaacaagttaatgatttcaagaaccatcaactccctctagcaagaatcaagaaaatcatgaaagctgatgaagatgtgcgcatgatctctgctgaagcacctattttgtttgctaaagcatgtgagcttttcattttagaactgacaattcgttcttggcttcatgctgaggaaaacaagagaaggactttacagaagaatgacattgctgctgctattaccagaactgacatttttgatttcttggttgatattgtacctagagatgagatcaaagaggaagctgctggtcttggtggaattgtcggcgctacggctagtggggtaccttattattaccctccgatgggacagcctgccgctgccgctgcgctagggatgatgattggaaggccagctgtggatcctgccactggggtttatgttcagccaccttctcaggcatggcaatctgtttggcagacagctgccgccgaggatggttcttatgggagtggtggtgccagtggtggacaaggcgaggttgttgtgtga

SEQ ID NO: 851 - protein, 158 aa, Populus balsamifera subsp. trichocarpa
  misc_feature (1)..(158): Ceres ANNOT ID no. 1521997
  misc_feature (1)..(59): Pfam Name: Histone Pfam Description: Core histone H2A/H2B/H3/H4
  misc_feature: SWISSPROT Homolog: NFYC1_ARATH Nuclear transcription factor Y subunit C-1 (AtNF-YC-1) (Transcriptional activator HAP5A) with e-value of 2.6e-84 and BLAST sequence identity of 100.0
  misc_feature: SWISSPROT Homolog: NFYC4_ARATH Nuclear transcription factor Y subunit C-4 (AtNF-YC-4) with e-value of 8.9e-75 and BLAST sequence identity of 89.0
  misc_feature: SWISSPROT Homolog: NFYC3_ARATH Nuclear transcription factor Y subunit C-3 (AtNF-YC-3) with e-value of 1.9e-40 and BLAST sequence identity of 66.4
  misc_feature: SWISSPROT Homolog: NFYC9_ARATH Nuclear transcription factor Y subunit C-9 (AtNF-YC-9) (Transcriptional activator HAP5C) with e-value of 2.5e-38 and BLAST sequence identity of 64.7
  misc_feature: SWISSPROT Homolog: NFYC2_ARATH Nuclear transcription factor Y subunit C-2 (AtNF-YC-2) (Transcriptional activator HAP5B) with e-value of 5.6e-34 and BLAST sequence identity of 71.9
  misc_feature 90098:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(158): Functional Homolog of  Ceres CLONE ID no. 21604 at SEQ ID NO. 876 with e-value of 1.49E-64 and BLAST sequence identity of 88.1
MKADEDVRMISAEAPILFAKACELFILELTIRSWLHAEENKRRTLQKNDIAAAITRTDIFDFLVDIVPRDEIKEEAAGLGGIVGATASGVPYYYPPMGQPAAAAALGMMIGRPAVDPATGVYVQPPSQAWQSVWQTAAAEDGSYGSGGASGGQGEVVV

SEQ ID NO: 852 - DNA, 747 bp, Populus balsamifera subsp. trichocarpa
  misc_feature (1)..(747): Ceres ANNOT ID no. 1468633
  misc_feature 90169:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggacaacaccaacaccaacaccaatcaccagcctcaatccaccgcatacccgccacactccaccaccaccactccaccaccaccaccaccaggggcaccatcctcagccccattccaccacctccttcaacaacaacagcagcaacttcaaatgttttggtcttaccagcgtcaggaaattgaacaagttaatgatttcaagaaccatcaactccctctagcaagaatcaagaaaatcatgaaagctgatgaagatgtgcgcatgatctctgctgaagcacctattttgtttgctaaagcatgtgagcttttcattttagaactgacaattcgttcttggcttcatgctgaggaaaacaagagaaggactttacagaagaatgacattgctgctgctattaccagaactgacatttttgatttcttggttgatattgtacctagagatgagatcaaagaggaagctgctggtcttggtggaattgtcggcgctacggctagtggggtaccttattattaccctccgatgggacagcctgccgctgccgctgcgctagggatgatgattggaaggccagctgtggatcctgccactggggtttatgttcagccaccttctcaggcatggcaatctgtttggcagacagctgccgccgaggatggttcttatgggagtggtggtgccagtggtggacaagggtttctcattttttttttgtacttattttttcgatttggagcgtga

SEQ ID NO: 853 - protein, 248 aa, Populus balsamifera subsp. trichocarpa
  misc_feature (1)..(248): Ceres ANNOT ID no. 1468633
  misc_feature (64)..(139): Pfam Name: Histone Pfam Description: Core histone H2A/H2B/H3/H4
  misc_feature: SWISSPROT Homolog: NFYC1_ARATH Nuclear transcription factor Y subunit C-1 (AtNF-YC-1) (Transcriptional activator HAP5A) with e-value of 2.6e-84 and BLAST sequence identity of 100.0
  misc_feature: SWISSPROT Homolog: NFYC4_ARATH Nuclear transcription factor Y subunit C-4 (AtNF-YC-4) with e-value of 8.9e-75 and BLAST sequence identity of 89.0
  misc_feature: SWISSPROT Homolog: NFYC3_ARATH Nuclear transcription factor Y subunit C-3 (AtNF-YC-3) with e-value of 1.9e-40 and BLAST sequence identity of 66.4
  misc_feature: SWISSPROT Homolog: NFYC9_ARATH Nuclear transcription factor Y subunit C-9 (AtNF-YC-9) (Transcriptional activator HAP5C) with e-value of 2.5e-38 and BLAST sequence identity of 64.7
  misc_feature: SWISSPROT Homolog: NFYC2_ARATH Nuclear transcription factor Y subunit C-2 (AtNF-YC-2) (Transcriptional activator HAP5B) with e-value of 5.6e-34 and BLAST sequence identity of 71.9
  misc_feature 90274:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(248): Functional Homolog of  Ceres CLONE ID no. 21604 at SEQ ID NO. 876 with e-value of 1.49E-64 and BLAST sequence identity of 88.8
MDNTNTNTNHQPQSTAYPPHSTTTTPPPPPPGAPSSAPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKEEAAGLGGIVGATASGVPYYYPPMGQPAAAAALGMMIGRPAVDPATGVYVQPPSQAWQSVWQTAAAEDGSYGSGGASGGQGFLIFFLYLFFRFGA

SEQ ID NO: 854 - protein, 268 aa, Arabidopsis thaliana
  misc_feature (1)..(268): Ceres CLONE ID no. 21634
  misc_feature (1)..(268): Also Known As Ceres CDNA ID no. 23382112
  misc_feature (1)..(268): Also Known As Ceres GEMINI ID 554F8
  misc_feature (9)..(135): Pfam Name: NAM Pfam Description: No apical meristem (NAM) protein
  misc_feature 90383:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRSGSMRLDEWVLCRIYKKRGASKLLNEQEGFMDEVLMEDETKVVINEAERRNDEEIMMMTSMKLPRTCSLAHLLEMDYMGPVSHIDNFSQFDHLHQPDSESSWFGDLQFNQDEILNHHRQAMFKF

SEQ ID NO: 855 - DNA, 852 bp, Populus balsamifera subsp. trichocarpa
  misc_feature (1)..(852): Ceres ANNOT ID no. 1458524
  misc_feature 90460:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgcaaggaaaaaccatctataaccagcttcctcctggttttaggttccaccctaccgatgaggaattgatcgtgtactaccttcgtaaccaagccacttccaggccatgccctgcatctattataccagaagttgatatttacaaatttgatccctggcaattacctgagaaggcagaatttggagaaaatgagtggtacttctttacccctcgtgaccgcaagtacccaaatggagtgaggcctaacagagcaaccgtgtcggggtattggaaggccacgggcacagacaaggccatccacagcggatctaaatatgttggtgtcaagaaagctcttgttttttacaagggcaggccaccaaagggtgccaagacagattggattatgcatgagtatcgcttaaatgatccaagaaaacaagccaacaagcaaaatggatccatgagattggatgactgggtcctatgtagaatttacaaaaagaggcacacgataggacatttagaggagaaaacagaaaatacagtagatgcccatttggacgtcaccccagctaatgatgttagtgaacaacaaatgatgaaatttccaagaacatgttctctttctcatctgttagaattggagtacctgggttcaatttcccaactcttgagtggtgacacatacaattcaaatcttgatctccaaaacctcatgagcaatgctggaactgaccacgttgaaaaaatccagctaggacagatgtctctccaacacacagatcgtgggaagtttcaggggaacctgcagggcagtaccttaaaccagccactatttatgaacccaacgatgtatggattccagtga

SEQ ID NO: 856 - protein, 283 aa, Populus balsamifera subsp. trichocarpa
  misc_feature (1)..(283): Ceres ANNOT ID no. 1458524
  misc_feature (10)..(136): Pfam Name: NAM Pfam Description: No apical meristem (NAM) protein
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 2.9e-147 and BLAST sequence identity of 98.5
  misc_feature: SWISSPROT Homolog: NAC18_ARATH NAC domain-containing protein 18 (ANAC018) NO APICAL MERISTEM protein (AtNAM) with e-value of 1.1e-60 and BLAST sequence identity of 65.5
  misc_feature: SWISSPROT Homolog: NAC68_ORYSA NAC domain-containing protein 68 (ONAC068) with e-value of 1.7e-57 and BLAST sequence identity of 61.5
  misc_feature: SWISSPROT Homolog: NAC2_ARATH NAC domain-containing protein 2 (ANAC002) with e-value of 2.2e-55 and BLAST sequence identity of 53.2
  misc_feature: SWISSPROT Homolog: NAC48_ORYSA NAC domain-containing protein 48 (ONAC048) with e-value of 1.2e-54 and BLAST sequence identity of 65.2
  misc_feature 90562:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(283): Functional Homolog of  Ceres CLONE ID no. 21634 at SEQ ID NO. 883 with e-value of 5.90E-84 and BLAST sequence identity of 75.5
MQGKTIYNQLPPGFRFHPTDEELIVYYLRNQATSRPCPASIIPEVDIYKFDPWQLPEKAEFGENEWYFFTPRDRKYPNGVRPNRATVSGYWKATGTDKAIHSGSKYVGVKKALVFYKGRPPKGAKTDWIMHEYRLNDPRKQANKQNGSMRLDDWVLCRIYKKRHTIGHLEEKTENTVDAHLDVTPANDVSEQQMMKFPRTCSLSHLLELEYLGSISQLLSGDTYNSNLDLQNLMSNAGTDHVEKIQLGQMSLQHTDRGKFQGNLQGSTLNQPLFMNPTMYGFQ

SEQ ID NO: 857 - DNA, 849 bp, Populus balsamifera subsp. trichocarpa
  misc_feature (1)..(849): Ceres ANNOT ID no. 1464441
  misc_feature 90650:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgcaaggaaaaaccaactctgagcagcttcctcctggttttaggttccaccctaccgatgaggaattgatcatgtactaccttcgtaaccaagccacatccaggccatgccctgcatcaattatcccagaagttgatatttacaaatttgatccttggcaattacctgagaaagcggattttggagaaaatgagtggtacttcttcacccctctcgaccgcaagtacccaaatggagtgaggcctaacagagcaactgtgtcagggtactggaaggccacgggcacagacaaggccatccatagtggctctaaatatgttggtgtcaagaaagctcttgttttttacaagggcaggccacctaagggtactaagaccgattggattatgcaggagtatcgcttaaatgattcgaataagccagccagcaagcagaatggatccatgagactagtcctgtgcagaatttacaggaagaggcatgcaataagacatttggaggagaaaacagaaaatccagtacatgcccatttggacgtcaccccagataatgatgctagagagcaacagatgatgaaaatctcaggaacatgttctctttctcgtctgttggaaatggagtacctgggttcaatttcccaactcttgagtggagacacgtataattcagattttgattcccagaacctcatgagcgatgctttgactgaccatgttataaaaattcagctaggagagatgtctcccgagcacacagataatggcaattttcaaggaaaccagcggggcagcacttctttaattaatcagcccctagttgtaaacccaatgatgtacggattccagtga

SEQ ID NO: 858 - protein, 282 aa, Populus balsamifera subsp. trichocarpa
  misc_feature (1)..(282): Ceres ANNOT ID no. 1464441
  misc_feature (10)..(136): Pfam Name: NAM Pfam Description: No apical meristem (NAM) protein
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 2.9e-147 and BLAST sequence identity of 98.5
  misc_feature: SWISSPROT Homolog: NAC18_ARATH NAC domain-containing protein 18 (ANAC018) NO APICAL MERISTEM protein (AtNAM) with e-value of 1.1e-60 and BLAST sequence identity of 65.5
  misc_feature: SWISSPROT Homolog: NAC68_ORYSA NAC domain-containing protein 68 (ONAC068) with e-value of 1.7e-57 and BLAST sequence identity of 61.5
  misc_feature: SWISSPROT Homolog: NAC2_ARATH NAC domain-containing protein 2 (ANAC002) with e-value of 2.2e-55 and BLAST sequence identity of 53.2
  misc_feature: SWISSPROT Homolog: NAC48_ORYSA NAC domain-containing protein 48 (ONAC048) with e-value of 1.2e-54 and BLAST sequence identity of 65.2
  misc_feature 90752:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(282): Functional Homolog of  Ceres CLONE ID no. 21634 at SEQ ID NO. 883 with e-value of 5.80E-77 and BLAST sequence identity of 70.1
MQGKTNSEQLPPGFRFHPTDEELIMYYLRNQATSRPCPASIIPEVDIYKFDPWQLPEKADFGENEWYFFTPLDRKYPNGVRPNRATVSGYWKATGTDKAIHSGSKYVGVKKALVFYKGRPPKGTKTDWIMQEYRLNDSNKPASKQNGSMRLVLCRIYRKRHAIRHLEEKTENPVHAHLDVTPDNDAREQQMMKISGTCSLSRLLEMEYLGSISQLLSGDTYNSDFDSQNLMSDALTDHVIKIQLGEMSPEHTDNGNFQGNQRGSTSLINQPLVVNPMMYGFQ

SEQ ID NO: 859 - protein, 241 aa, Arabidopsis thaliana
  misc_feature (1)..(241): Ceres CLONE ID no. 21759
  misc_feature (210)..(227): Pfam Name: ER_lumen_recept Pfam Description: ER lumen protein retaining receptor
  misc_feature: Utility: MSX Useful for making plants tolerant to low nitrogen
  misc_feature: Phenotype: WHOLE PLANT - MSX Useful for making plants tolerant to low nitrogen
MAALVLLRFIVHDHDNLFVAAEAVHSIGICVLIYKLMKEKTCAGLSLKSQELTAIFLAVRLYCSIVMEYDIHTILDLATLGTTLWVIFMIRFKLRASYMEDKDNFPLYYVLAPCVALAVFIHPSTSHNIINRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 860 - DNA, 819 bp, Populus balsamifera subsp. trichocarpa
  misc_feature (1)..(819): Ceres ANNOT ID no. 1450490
  misc_feature: Utility: MSX Useful for making plants tolerant to low nitrogen
  misc_feature 90928:<222: Transcription Factor
  misc_feature: Phenotype: WHOLE PLANT - MSX Useful for making plants tolerant to low nitrogen
atgagaccaccgaagagaccgatccaagtggtaacaacatgggtgcgacgacagcctccgaaggtcaaggcgtttttggcggtggtggcggggatgacagcgctggtgcttctccgattcatcgtacacgatcacgataacctctttgttgctgctgaggctgttcactccattggaatctctgtgcttatttataagttaatgaaagagaagacttgtgctgggctatcactgaaaactcaggagctgacagccatgttcttagctgtgaggctgtactgcagctttgtaatggaatatgatattcataccgtactggacttggcaacgttggctacaaccctgtgggttatttatacgatccgttttaaactgaagtcgagttacatggaggataaagacaactttgcattatattatgtggcggcaccttgtgctgttttagctttgcttattcatccatcaacatctcacaatctactgaaccggatcctctgggcattctgtgtatacctggaagctgtttctgtacttcctcagttgcgtgtcatgcagaacaccaagattgtcgagccattcactgctcattatgtatttgcattgggtgttgcaaggttcttgagctgtgcccattgggtcctccaggttttagatactcgtggacacttattggtagccttggggtacggattatggccttctatggttcttatctcagaaattgtccagactttcatcttagcagatttctgttattattatgtgaaaagtgtatttggagggcagcttgtgcttcgtcttccctctggagtggtgtaa

SEQ ID NO: 861 - protein, 241 aa, Populus balsamifera subsp. trichocarpa
  misc_feature (1)..(241): Ceres ANNOT ID no. 1450490
  misc_feature (16)..(52): Pfam Name: ER_lumen_recept Pfam Description: ER lumen protein retaining receptor
  misc_feature: SWISSPROT Homolog: ERD2_ENTHI ER lumen protein retaining receptor with e-value of 2.1e-27 and BLAST sequence identity of 34.1
  misc_feature: SWISSPROT Homolog: ERD2_DROME ER lumen protein retaining receptor with e-value of 9.0e-27 and BLAST sequence identity of 34.1
  misc_feature: SWISSPROT Homolog: ERD22_CAEEL Putative ER lumen protein retaining receptor C28H8.4 with e-value of 2.4e-26 and BLAST sequence identity of 31.9
  misc_feature: SWISSPROT Homolog: ERD2_PETHY ER lumen protein retaining receptor (HDEL receptor) (PGP169-12) with e-value of 2.4e-26 and BLAST sequence identity of 32.0
  misc_feature: SWISSPROT Homolog: ERD2_XENLA ER lumen protein retaining receptor (KDEL receptor) (KDEL endoplasmic reticulum protein retention receptor) with e-value of 2.4e-24 and BLAST sequence identity of 31.3
  misc_feature: Utility: MSX Useful for making plants tolerant to low nitrogen
  misc_feature 91030:<222: Transcription Factor
  misc_feature: Phenotype: WHOLE PLANT - MSX Useful for making plants tolerant to low nitrogen
  misc_feature (1)..(241): Functional Homolog of  Ceres CLONE ID no. 21759 at SEQ ID NO. 888 with e-value of 5.89E-116 and BLAST sequence identity of 90.4
MTALVLLRFIVHDHDNLFVAAEAVHSIGISVLIYKLMKEKTCAGLSLKTQELTAMFLAVRLYCSFVMEYDIHTVLDLATLATTLWVIYTIRFKLKSSYMEDKDNFALYYVAAPCAVLALLIHPSTSHNLLNRILWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 862 - DNA, 891 bp, Populus balsamifera subsp. trichocarpa
  misc_feature (1)..(891): Ceres ANNOT ID no. 1460694
  misc_feature: Utility: MSX Useful for making plants tolerant to low nitrogen
  misc_feature 91117:<222: Transcription Factor
  misc_feature: Phenotype: WHOLE PLANT - MSX Useful for making plants tolerant to low nitrogen
atgaggccaccgaggagaccgatccatgtggttacgacgtgggtgcgacggcagcctccgaaggtcaaggcgtttttggcggtggtggctggaatgtcagcgctggtgctcctcagattcatcgtacacgatcacgataacctctttgtggctgctgaggctgttcactccattggaatctctgtgcttatttataagttaatgaaagagaaaacttgtgctggattatctctgaaaactcaggagctgacagctatgttcttagctgtaaggttgtactgcagcttcgtaatggaatatgatatacataccatactggatttagctacgttggcaacaaccctgtgggttatttatatgatccgttttaatctgaagtcgagttacatggaggacaaagacaactttgcattatattatgtggtatatttctggttactcaataggaaagactatttaatttttcctgttacagttacatttgtttgtattaatgcggcaccctgtgctgttttggctttgcttattcatccgtcaacagctcataacctactgaaccggatcctctgggcattctgtgtatacctggaagctgtttctgtgcttcctcagttgcgggtcatgcaaaacaccaagattgttgagccattcactgctcattatgtatttgcattgggtgttgcaaggttcttgagctgtgcccattgggttctccaggttttagatactcggggacacttgttggtggccttggggtatggattatggccttctatggttcttatctcagaaatcgtccagactttcatcttagcagatttctgttattattatgtcaaaagtgtatttggagggcagcttgttctccgcctcccctctggagtggtgtaa

SEQ ID NO: 863 - protein, 265 aa, Populus balsamifera subsp. trichocarpa
  misc_feature (1)..(265): Ceres ANNOT ID no. 1460694
  misc_feature (16)..(52): Pfam Name: ER_lumen_recept Pfam Description: ER lumen protein retaining receptor
  misc_feature: SWISSPROT Homolog: ERD2_ENTHI ER lumen protein retaining receptor with e-value of 2.1e-27 and BLAST sequence identity of 34.1
  misc_feature: SWISSPROT Homolog: ERD2_DROME ER lumen protein retaining receptor with e-value of 9.0e-27 and BLAST sequence identity of 34.1
  misc_feature: SWISSPROT Homolog: ERD22_CAEEL Putative ER lumen protein retaining receptor C28H8.4 with e-value of 2.4e-26 and BLAST sequence identity of 31.9
  misc_feature: SWISSPROT Homolog: ERD2_PETHY ER lumen protein retaining receptor (HDEL receptor) (PGP169-12) with e-value of 2.4e-26 and BLAST sequence identity of 32.0
  misc_feature: SWISSPROT Homolog: ERD2_XENLA ER lumen protein retaining receptor (KDEL receptor) (KDEL endoplasmic reticulum protein retention receptor) with e-value of 2.4e-24 and BLAST sequence identity of 31.3
  misc_feature: Utility: MSX Useful for making plants tolerant to low nitrogen
  misc_feature 91221:<222: Transcription Factor
  misc_feature: Phenotype: WHOLE PLANT - MSX Useful for making plants tolerant to low nitrogen
  misc_feature (1)..(265): Functional Homolog of  Ceres CLONE ID no. 21759 at SEQ ID NO. 888 with e-value of 2.40E-110 and BLAST sequence identity of 90.4
MSALVLLRFIVHDHDNLFVAAEAVHSIGISVLIYKLMKEKTCAGLSLKTQELTAMFLAVRLYCSFVMEYDIHTILDLATLATTLWVIYMIRFNLKSSYMEDKDNFALYYVVYFWLLNRKDYLIFPVTVTFVCINAAPCAVLALLIHPSTAHNLLNRILWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 864 - DNA, 819 bp, Populus balsamifera subsp. trichocarpa
  misc_feature (1)..(819): Ceres ANNOT ID no. 1452864
  misc_feature: Utility: MSX Useful for making plants tolerant to low nitrogen
  misc_feature 91311:<222: Transcription Factor
  misc_feature: Phenotype: WHOLE PLANT - MSX Useful for making plants tolerant to low nitrogen
atgaaggcaacgaggaggccgatacaggcggtggcgagatgggtaaggaggcaaccaccaaagatgaaggcttttttagcggtggtttcagggttggcggctttggtttttcttagaatggttgttcgtgatcatgataacctctttgttgctgctgaggttgttcattctattggaatctctgttcttatttacaagctcatgaaggagaagacttgtgctggactttcactaaaatcacaggagctaatagctatatttttagctgttaggctctattgcagttttgtcatggagtatgacatacacactctacttgattcagctacgttgctgacaaccctttgggtaatctatacgatccgtttcaacttgaggtccagttacatggaaggcaaagataactttgcaatttactatttggtgataccatgtgctgtgctagctttgtatattcatccaagaacacatcaccacatagtcaacaggatttgctgggccttttgtgtttaccttgaatctatttcagtgttgcctcagctgcgagtaatgcaaaacacaaagattgttgaacccttcacggcacattatgtatttgcgcttggagttgccaggttcttgggttgtgcacattggatcctccaggtactggacactcgaggacgcctattgacagcactgggctatggaatgtggcctcttatggtcctactttcagaaattgtgcagacattcattcttgccgatttttgctactactacgtcaagagtgttcttggtggacaacttgttctaaggctcccctcaggagtggtgtaa

SEQ ID NO: 865 - protein, 251 aa, Populus balsamifera subsp. trichocarpa
  misc_feature (1)..(251): Ceres ANNOT ID no. 1452864
  misc_feature (220)..(237): Pfam Name: ER_lumen_recept Pfam Description: ER lumen protein retaining receptor
  misc_feature: SWISSPROT Homolog: ERD2_ENTHI ER lumen protein retaining receptor with e-value of 2.1e-27 and BLAST sequence identity of 34.1
  misc_feature: SWISSPROT Homolog: ERD2_DROME ER lumen protein retaining receptor with e-value of 9.0e-27 and BLAST sequence identity of 34.1
  misc_feature: SWISSPROT Homolog: ERD22_CAEEL Putative ER lumen protein retaining receptor C28H8.4 with e-value of 2.4e-26 and BLAST sequence identity of 31.9
  misc_feature: SWISSPROT Homolog: ERD2_PETHY ER lumen protein retaining receptor (HDEL receptor) (PGP169-12) with e-value of 2.4e-26 and BLAST sequence identity of 32.0
  misc_feature: SWISSPROT Homolog: ERD2_XENLA ER lumen protein retaining receptor (KDEL receptor) (KDEL endoplasmic reticulum protein retention receptor) with e-value of 2.4e-24 and BLAST sequence identity of 31.3
  misc_feature: Utility: MSX Useful for making plants tolerant to low nitrogen
  misc_feature 91413:<222: Transcription Factor
  misc_feature: Phenotype: WHOLE PLANT - MSX Useful for making plants tolerant to low nitrogen
  misc_feature (1)..(251): Functional Homolog of  Ceres CLONE ID no. 21759 at SEQ ID NO. 888 with e-value of 2.90E-107 and BLAST sequence identity of 82.5
MKAFLAVVSGLAALVFLRMVVRDHDNLFVAAEVVHSIGISVLIYKLMKEKTCAGLSLKSQELIAIFLAVRLYCSFVMEYDIHTLLDSATLLTTLWVIYTIRFNLRSSYMEGKDNFAIYYLVIPCAVLALYIHPRTHHHIVNRICWAFCVYLESISVLPQLRVMQNTKIVEPFTAHYVFALGVARFLGCAHWILQVLDTRGRLLTALGYGMWPLMVLLSEIVQTFILADFCYYYVKSVLGGQLVLRLPSGVV

SEQ ID NO: 866 - protein, 244 aa, Arabidopsis thaliana
  misc_feature (1)..(244): Ceres CLONE ID no. 21863
  misc_feature (1)..(244): Also Known As Ceres CDNA ID no. 23369680
  misc_feature (1)..(244): Also Known As Ceres GEMINI ID 553H9
  misc_feature (199)..(239): Pfam Name: zf-C3HC4 Pfam Description: Zinc finger, C3HC4 type (RING finger)
  misc_feature 91514:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELP

SEQ ID NO: 867 - DNA, 1212 bp, Populus balsamifera subsp. trichocarpa
  misc_feature (1)..(1212): Ceres ANNOT ID no. 1464854
  misc_feature 91594:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgtcatctccaactacgccgtcgtattggtgctatagatgcaaccgtttcgttcaggtttggagacaagactcggtaacttgcccagaatgtgaatccgggttcattgaagaaatcgaaaaccctccgcacatgattcaaacagaagcatcacgtgaaaggcaccgccgactttctcccgctgccggaacgatgttcatgatcggtaaccgctcaaacccccatcgccgtaaccgtcgcggtggagccgccgggagcggagaccggtccccgatcaatccagtgatcgtgcttcgtggcgggcctggaggggcggcggaggacgtagtgggagatgacggtggccgcggtggtggagggttcgagctttattatgatgacggtggtgggtccgggttgaggccgttgccgccgagcatgtcggaatttttattgggatcagggtttgagagattgttagatcagttaacacatattgaaatgaatggagggtttggccgctatgagaatcagcacccgccggcgtcaaagtcggcgattgaatcgatgcctacggtaattattaacgaatctcatacttttaccgaatcgcattgtgctgtttgtaaggaggcttttgaattagaatccgaagcacgagagatgccttgtaaacatatctatcatactgattgtatacttccttggttatctattcgtaattcttgtccggtttgtcgacatgaattgccttctggtgatgatgacggtgaggatggggttgggagtccgttacctgaagcagggaatggacagggaaataacgaggaggaggcagttgggctgacgatatggaggttacctggaggagggtatgcggtggggaggtttacaggggcgaggaggggagaaagagagttgcccgtggtttatacagagatggatggtgcgtttaacaatggtgggttgccgaggaggatatcttgggggtctagagggggtggaaggagggagaatggtggtggggttaatggtggtagagacggtggtaatagagggtttggttttgggagagttttgaggcattggtttgcttgttttggcgtgggacggggttcgagttcaaactccagagtcactgggaggaataggccttctcctgtttttagcagttcctcttcgatgaggagaaggggttggggcgctgagattaatactggaaggagacggtga

SEQ ID NO: 868 - protein, 403 aa, Populus balsamifera subsp. trichocarpa
  misc_feature (1)..(403): Ceres ANNOT ID no. 1464854
  misc_feature (199)..(239): Pfam Name: zf-C3HC4 Pfam Description: Zinc finger, C3HC4 type (RING finger)
  misc_feature (255)..(395): Pfam Name: DUF1117 Pfam Description: Protein of unknown function (DUF1117)
  misc_feature: SWISSPROT Homolog: CIP8_ARATH Ubiquitin-protein ligase CIP8 (EC 6.3.2.-) (COP1-interacting protein 8) with e-value of 8.0e-28 and BLAST sequence identity of 46.9
  misc_feature: SWISSPROT Homolog: RN126_XENTR RING finger protein 126 with e-value of 6.8e-25 and BLAST sequence identity of 40.2
  misc_feature: SWISSPROT Homolog: R126A_XENLA RING finger protein 126-A with e-value of 6.8e-25 and BLAST sequence identity of 40.2
  misc_feature: SWISSPROT Homolog: R126B_XENLA RING finger protein 126-B with e-value of 6.8e-25 and BLAST sequence identity of 39.2
  misc_feature: SWISSPROT Homolog: RN126_MOUSE RING finger protein 126 with e-value of 3.2e-23 and BLAST sequence identity of 43.3
  misc_feature 91716:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(403): Functional Homolog of  Ceres CLONE ID no. 21863 at SEQ ID NO. 895 with e-value of 1.90E-62 and BLAST sequence identity of 59.9
MSSPTTPSYWCYRCNRFVQVWRQDSVTCPECESGFIEEIENPPHMIQTEASRERHRRLSPAAGTMFMIGNRSNPHRRNRRGGAAGSGDRSPINPVIVLRGGPGGAAEDVVGDDGGRGGGGFELYYDDGGGSGLRPLPPSMSEFLLGSGFERLLDQLTHIEMNGGFGRYENQHPPASKSAIESMPTVIINESHTFTESHCAVCKEAFELESEAREMPCKHIYHTDCILPWLSIRNSCPVCRHELPSGDDDGEDGVGSPLPEAGNGQGNNEEEAVGLTIWRLPGGGYAVGRFTGARRGERELPVVYTEMDGAFNNGGLPRRISWGSRGGGRRENGGGVNGGRDGGNRGFGFGRVLRHWFACFGVGRGSSSNSRVTGRNRPSPVFSSSSSMRRRGWGAEINTGRRR

SEQ ID NO: 869 - DNA, 1359 bp, Populus balsamifera subsp. trichocarpa
  misc_feature (1)..(1359): Ceres ANNOT ID no. 1511378
  misc_feature 91834:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgtcatctccaacaacgccgtctttttggtgctatggatgcagccgtttcgttcaggtttggagacaagactcgttaacttgcgcagaatgtgaatccgggttcattgaagaaatcgaaaacccaccgcacgtaattcaaacagaaatatcgagtgaccgacaccgcaggttttctcccgctgccggaaccatgttcatgatcggtaaccgctcaaacccccataaccggaaccgacggggtggtggcgccgggagcggagaccggtctccgatgaatcctgtgatcttgcttcgtggtggggctggaggggcggcggatgacgtggtgggagacgacggtggccgaggtggtggtgggtttgagctttattacgatgacggtggtgggtccgggttgaggccgttgccgccgagcatgtcggagtttttgttgggatcagggtttgagagattgttagatcagttagcacagattgaaataaatggagggtttggtcggtatgagaatcagcatccaccggcctcgaaatccgcgattgaatcgatgcctacggtaattgttaatgaatcccatatttttactgaatctcattgtgctgtttgtaaagaggcttttgaattagaatccgaagcacgggagatgccttgtaaacatatttatcatactgattgtatacttccttggttatctattcgtaattcttgccctgtttgtcgacgtgagttgccttctggtgatgatgatggtggcgatggtgataatggggttgtgagtccgttgcctgaagcggggaatgggcagggaaataacgaggaggaggcagttggattgacgatatggaggttacccggaggagggtatgcggtggggaggtttacaggggcgaggaggggagaaagggagttgcctgtggtttatacagagatggatggtgcctttaacaatggtggattgccgaggaggatatcttgggggtctagagggggtggaaggagggaaaatggtggtgggggtagtggtggtaatagacggcttggttttgggagagttttgaggcactggtttgcttgttttggcacggggcagagttcgaatttggattccagagttacagggagcagtaggccatattcagtttttagcagttcctcttcaatgaggagaagagactgggctagagagattaacagtgcaaggagacggtgcttgttactgaaatgtatatatggagatttgagaatgactccaattgcgagttcaattcataatctatcgaaaactgatggtttgatgaattgtggaggaacaatgcaatctcaacaaatgacctgcgaagaagcattaggagcaagctag

SEQ ID NO: 870 - protein, 452 aa, Populus balsamifera subsp. trichocarpa
  misc_feature (1)..(452): Ceres ANNOT ID no. 1511378
  misc_feature (199)..(239): Pfam Name: zf-C3HC4 Pfam Description: Zinc finger, C3HC4 type (RING finger)
  misc_feature (261)..(394): Pfam Name: DUF1117 Pfam Description: Protein of unknown function (DUF1117)
  misc_feature: SWISSPROT Homolog: CIP8_ARATH Ubiquitin-protein ligase CIP8 (EC 6.3.2.-) (COP1-interacting protein 8) with e-value of 8.0e-28 and BLAST sequence identity of 46.9
  misc_feature: SWISSPROT Homolog: RN126_XENTR RING finger protein 126 with e-value of 6.8e-25 and BLAST sequence identity of 40.2
  misc_feature: SWISSPROT Homolog: R126A_XENLA RING finger protein 126-A with e-value of 6.8e-25 and BLAST sequence identity of 40.2
  misc_feature: SWISSPROT Homolog: R126B_XENLA RING finger protein 126-B with e-value of 6.8e-25 and BLAST sequence identity of 39.2
  misc_feature: SWISSPROT Homolog: RN126_MOUSE RING finger protein 126 with e-value of 3.2e-23 and BLAST sequence identity of 43.3
  misc_feature 91960:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(452): Functional Homolog of  Ceres CLONE ID no. 21863 at SEQ ID NO. 895 with e-value of 6.50E-62 and BLAST sequence identity of 58.5
MSSPTTPSFWCYGCSRFVQVWRQDSLTCAECESGFIEEIENPPHVIQTEISSDRHRRFSPAAGTMFMIGNRSNPHNRNRRGGGAGSGDRSPMNPVILLRGGAGGAADDVVGDDGGRGGGGFELYYDDGGGSGLRPLPPSMSEFLLGSGFERLLDQLAQIEINGGFGRYENQHPPASKSAIESMPTVIVNESHIFTESHCAVCKEAFELESEAREMPCKHIYHTDCILPWLSIRNSCPVCRRELPSGDDDGGDGDNGVVSPLPEAGNGQGNNEEEAVGLTIWRLPGGGYAVGRFTGARRGERELPVVYTEMDGAFNNGGLPRRISWGSRGGGRRENGGGGSGGNRRLGFGRVLRHWFACFGTGQSSNLDSRVTGSSRPYSVFSSSSSMRRRDWAREINSARRRCLLLKCIYGDLRMTPIASSIHNLSKTDGLMNCGGTMQSQQMTCEEALGAS

SEQ ID NO: 871 - DNA, 936 bp, Populus balsamifera subsp. trichocarpa
  misc_feature (1)..(936): Ceres ANNOT ID no. 1454043
  misc_feature 92087:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggcttcatcaatcgagtcctcattctggtgctacagatgcaaccgatccatccggctccccacccaagattcaattctctgccccgactgcggcggcggattcatcgaagaaatcggcatcacccgtccccaccaccgactcaccgccgcccatcgcacccgtctccgtaccggcggagaccactctcccttcaatccagtcatcatcctccgcggtgccactaccgacttagcatccgggaacttcgagctttactacgacgacggtgcagcgtcgggtctcaggcctttgcccgctagcatatcggagctcttgatggattctgggtttgaacgcctccttgatcagttgactcaaatggaaatcaacggcgtaggtcgattcgatcatccacaagcatctaaagcagccatcgaatcgatgccagtaataaaaatactgaattctcacgtttctatggaatcccaatgcgctgtttgcaaagaagcttttgaaattaataccgaggctcgcgaaatgccttgtaatcacatttatcattctgattgtattttaccctggttatcaatccgtaattcgtgtccggtttgtcgtcatgagttacccaccgaaactggaagtgggagtgggagaaattcgccggaatcagatgaggagaccgttggtttaatgatatggagattgcccggacgtggttttgcagttgggaggttttctggaggaaggagagcagcagagagggagctaccgcttgtgtttacggagatggatggtggatttaataatgcgggtttgcctaggagtatttcatgggctcctgatgggaggagatcaagagagagtggaggagtggggcgtgcttttcggaatttcttctcgtttttcaggaggattggaaggcgttcgagtaaccattctggtcaaagagcatga

SEQ ID NO: 872 - protein, 311 aa, Populus balsamifera subsp. trichocarpa
  misc_feature (1)..(311): Ceres ANNOT ID no. 1454043
  misc_feature (158)..(198): Pfam Name: zf-C3HC4 Pfam Description: Zinc finger, C3HC4 type (RING finger)
  misc_feature (203)..(298): Pfam Name: DUF1117 Pfam Description: Protein of unknown function (DUF1117)
  misc_feature: SWISSPROT Homolog: CIP8_ARATH Ubiquitin-protein ligase CIP8 (EC 6.3.2.-) (COP1-interacting protein 8) with e-value of 8.0e-28 and BLAST sequence identity of 46.9
  misc_feature: SWISSPROT Homolog: RN126_XENTR RING finger protein 126 with e-value of 6.8e-25 and BLAST sequence identity of 40.2
  misc_feature: SWISSPROT Homolog: R126A_XENLA RING finger protein 126-A with e-value of 6.8e-25 and BLAST sequence identity of 40.2
  misc_feature: SWISSPROT Homolog: R126B_XENLA RING finger protein 126-B with e-value of 6.8e-25 and BLAST sequence identity of 39.2
  misc_feature: SWISSPROT Homolog: RN126_MOUSE RING finger protein 126 with e-value of 3.2e-23 and BLAST sequence identity of 43.3
  misc_feature 92199:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(311): Functional Homolog of  Ceres CLONE ID no. 21863 at SEQ ID NO. 895 with e-value of 3.60E-52 and BLAST sequence identity of 56.7
MASSIESSFWCYRCNRSIRLPTQDSILCPDCGGGFIEEIGITRPHHRLTAAHRTRLRTGGDHSPFNPVIILRGATTDLASGNFELYYDDGAASGLRPLPASISELLMDSGFERLLDQLTQMEINGVGRFDHPQASKAAIESMPVIKILNSHVSMESQCAVCKEAFEINTEAREMPCNHIYHSDCILPWLSIRNSCPVCRHELPTETGSGSGRNSPESDEETVGLMIWRLPGRGFAVGRFSGGRRAAERELPLVFTEMDGGFNNAGLPRSISWAPDGRRSRESGGVGRAFRNFFSFFRRIGRRSSNHSGQRA

SEQ ID NO: 873 - protein, 375 aa, Arabidopsis thaliana
  misc_feature (1)..(375): Ceres CLONE ID no. 21868
  misc_feature (1)..(375): Also Known As Ceres CDNA ID no. 23557531
  misc_feature (1)..(375): Also Known As Ceres GEMINI ID 553D1
  misc_feature (122)..(185): Pfam Name: AP2 Pfam Description: AP2 domain
  misc_feature 92319:<222: Transcription Factor
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVKAMLGADAGAVTQEEENPVELWSLDEINFMLEGDF

SEQ ID NO: 874 - DNA, 1143 bp, Populus balsamifera subsp. trichocarpa
  misc_feature (1)..(1143): Ceres ANNOT ID no. 1446703
  misc_feature 92423:<222: Transcription Factor
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgtgtggcggtgctatcatctcagacttcatcgctccgacaaccaccgctcgatcttctcggcggttgacctcgggctttgagtggcttgaggtgaagaaacccttcaacaacaagcacttgaagccagttgttgctgatcccgaagatgattttgaggctgattttcaagagtttaaggatgagtctgatgtcgacgaggattatgatgtctttgctgatgccaagccttttgctttctctgctagtgtttctgaacctgctcaaaaacgtgggctccctcgtggttctactgctgttaaatctgctggattcagtggacctgctgaaaaatcagccaagaggaagagaaagaaccagtttagaggaattaggcagcgtccatggggaaaatgggctgctgagattcgtgatcccaggaaaggggtacgtgtctggttgggaacattcaatactgcagaagaagctgctagagcatatgattctgaggcacgaagaattcgtggcaagaaagctaaggtgaacttccctgatgaagctccatgtgcttcagcaaggcatccaattaaggaaaactcacagaaacgacttacgaaggcaaatttaagccaggattttagttacttgagcaacccagaaacggattataataatatgggctttgtggaagagaaaccacaagtgagccagtttggattaatgaattctttcccggccattggagattctggggtgacacccttgactccttctgacaatgcttctatgtatttcaattctgacaaggggagcaactcatttgattgtgactttgggtggggagaacaaggccctgaaatcttgtctgttcttgcagcaactccagaagttgatgaatccgtctttgtggatgctaatcctaagaagttgaaatcatactctgagaatgaagtgcctgttgaagagaagaatgggaaatctctgtccgaagagttgctggcttttgacaatcagttgatgaaccttcagatgccagatcttgtgggtaactgggaggcttctcttgatagcttccttaatggagacacaactcaggatggcacaaacgcagtggacttgtggagcttcgaagacttcccctccatggttgggggagtttattga

SEQ ID NO: 875 - protein, 380 aa, Populus balsamifera subsp. trichocarpa
  misc_feature (1)..(380): Ceres ANNOT ID no. 1446703
  misc_feature (119)..(182): Pfam Name: AP2 Pfam Description: AP2 domain
  misc_feature: SWISSPROT Homolog: AP23_ARATH AP2 domain transcription factor RAP2.3 (Related to AP2 protein 3) (Cadmium-induced protein AS30) with e-value of 9.4e-38 and BLAST sequence identity of 42.3
  misc_feature: SWISSPROT Homolog: ERF3_TOBAC Ethylene-responsive transcription factor 3 EREBP-5 (NtERF5) with e-value of 2.6e-23 and BLAST sequence identity of 72.4
  misc_feature: SWISSPROT Homolog: ERF5_ARATH Ethylene-responsive transcription factor 5 EREBP-5 (AtERF5) with e-value of 5.3e-22 and BLAST sequence identity of 52.3
  misc_feature: SWISSPROT Homolog: ERF4_TOBAC Ethylene-responsive transcription factor 4 EREBP-3 (NtERF3) with e-value of 8.6e-22 and BLAST sequence identity of 62.5
  misc_feature: SWISSPROT Homolog: ERF10_ARATH Ethylene-responsive transcription factor 10 EREBP-10 (AtERF10) with e-value of 1.5e-21 and BLAST sequence identity of 41.4
  misc_feature 92541:<222: Transcription Factor
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(380): Functional Homolog of  Ceres CLONE ID no. 21868 at SEQ ID NO. 902 with e-value of 1.79E-68 and BLAST sequence identity of 53.4
MCGGAIISDFIAPTTTARSSRRLTSGFEWLEVKKPFNNKHLKPVVADPEDDFEADFQEFKDESDVDEDYDVFADAKPFAFSASVSEPAQKRGLPRGSTAVKSAGFSGPAEKSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGLMNSFPAIGDSGVTPLTPSDNASMYFNSDKGSNSFDCDFGWGEQGPEILSVLAATPEVDESVFVDANPKKLKSYSENEVPVEEKNGKSLSEELLAFDNQLMNLQMPDLVGNWEASLDSFLNGDTTQDGTNAVDLWSFEDFPSMVGGVY

SEQ ID NO: 876 - protein, 197 aa, Arabidopsis thaliana
  misc_feature (1)..(197): Ceres CLONE ID no. 22007
  misc_feature (20)..(106): Pfam Name: X8 Pfam Description: X8 domain
  misc_feature: Phenotype: FLOWER - Reduced fertility Useful for sterility, genetic confinement systems
  misc_feature: Phenotype: INFLORESCENCE - Short Useful for modulating plant height
MKVLLGLLLLLSLTNSSSAIYCLCKDGIGDTELQTSIDYACGTLADCNPIHDKGTCYQPDTIKSHCDWAVNSYFQNAAQVPGSCNFSGTATTNPNPPSNLANGCIYPSSPSSTRSPPSTTPPTGTTPTNGTTPFPGTPFPGTPFPGTPPVFGPTGVFNPSNPGSGASSLGTSSVFTLCFSLLAFLWGSDVRFGFSHV

SEQ ID NO: 877 - DNA, 645 bp, Populus balsamifera subsp. trichocarpa
  misc_feature (1)..(645): Ceres ANNOT ID no. 1464350
  misc_feature 92727:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
atggctgttttagtgtttttaggtcttttcttggccctcactggccattcaagtgctacttactgcatatgcaaggatggggttggtgacacacagctgcaaaagagcctggattatgcttgtggagccggagctgactgtacccaaatcattcaaaatgccccttgttaccagcccaacactgtaaaagatcactgcagctatgctgttaacagctacttccagaagaagggccaagctgttgggagctgtgatttttcaggaactgccatgactagcgccactccccctcaaagtgtagcctctgggtgtacatatcctgcatctgcaactccaagcacagggacaggcaacaccccaacaaccaccactccaagcacaggcacaacacccaccggcacaggcacaacacctacaggcacaggcaccggcaccagcacaggcacaggcacaggcacaggcacaggcacaggcacaccttcatctataattcctaccccgccttcatcagtgttcaactcaggattgggcccaactggtttcaatgataatagtagtgaggctcctgcttttaagggcactaacttgtggttcattgcatctttgaccctcttgttttcaggcatatttttgttctggggttga

SEQ ID NO: 878 - protein, 214 aa, Populus balsamifera subsp. trichocarpa
  misc_feature (1)..(214): Ceres ANNOT ID no. 1464350
  misc_feature (20)..(106): Pfam Name: X8 Pfam Description: X8 domain
  misc_feature: SWISSPROT Homolog: E133_ARATH Putative glucan endo-1,3-beta-glucosidase 3 precursor with e-value of 7.0e-16 and BLAST sequence identity of 31.1
  misc_feature: SWISSPROT Homolog: E133_ARATH EC 3.2.1.39 ((1->3)-beta-glucan endohydrolase) ((1->3)- beta -glucanase) (Beta-1,3-endoglucanase) (Beta-1,3-glucanase)
  misc_feature: SWISSPROT Homolog: E131_ARATH Putative glucan endo-1,3-beta-glucosidase 1 precursor with e-value of 8.4e-16 and BLAST sequence identity of 37.1
  misc_feature: SWISSPROT Homolog: E131_ARATH EC 3.2.1.39 ((1->3)-beta-glucan endohydrolase)((1->3)- beta-glucanase) (Beta-1,3-endoglucanase) ( Beta-1,3-glucanase)
  misc_feature: SWISSPROT Homolog: E13B_WHEAT Glucan endo-1,3-beta-glucosidase precursor with e-value of 1.5e-14 and BLAST sequence identity of 36.6
  misc_feature: SWISSPROT Homolog: E13B_WHEAT EC 3.2.1.39 ((1->3)- beta-glucan endohydrolase) ((1->3)-beta-glucanase)( Beta-1,3-endoglucanase)
  misc_feature: SWISSPROT Homolog: E134_ARATH Putative glucan endo-1,3-beta-glucosidase 4 precursor with e-value of 4.4e-12 and BLAST sequence identity of 29.5
  misc_feature: SWISSPROT Homolog: E134_ARATH EC 3.2.1.39) ((1->3)-beta-glucan endohydrolase) ((1->3)-beta- glucanase) (Beta-1,3-glucanase)
  misc_feature: SWISSPROT Homolog: Y2082_MYCTU Hypothetical protein Rv2082 with e-value of 5.9e-06 and BLAST sequence identity of 37.9
  misc_feature 92856:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(214): Functional Homolog of  Ceres CLONE ID no. 22007 at SEQ ID NO. 905 with e-value of 1.99E-42 and BLAST sequence identity of 56.2
MAVLVFLGLFLALTGHSSATYCICKDGVGDTQLQKSLDYACGAGADCTQIIQNAPCYQPNTVKDHCSYAVNSYFQKKGQAVGSCDFSGTAMTSATPPQSVASGCTYPASATPSTGTGNTPTTTTPSTGTTPTGTGTTPTGTGTGTSTGTGTGTGTGTGTPSSIIPTPPSSVFNSGLGPTGFNDNSSEAPAFKGTNLWFIASLTLLFSGIFLFWG

SEQ ID NO: 879 - DNA, 555 bp, Populus balsamifera subsp. trichocarpa
  misc_feature (1)..(555): Ceres ANNOT ID no. 1458591
  misc_feature 92938:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
atggctgttttagtgtttttagtgtttttctgggcactcactggtcattcatatgccacctactgcatatgcaaggatgggattgctgacacacagctgcaaaaagccctggattatgcttgtggagccggagcagattgtacccaaatcgctcaaagcggtccttgctaccagcccaacactgtaaaagatcactgcagctatgctgttaacagctacttccagaagaaaggccaagctgttgggagctgtgattttgcaggaactgccgtgactagtgcgactctccctcaaaatgtagcctccgggtgtacatatcctgcatcagcaacttcaagcaccggcaacacatcaaactcgggcacagcaccgacgggcacaaacacaccatcttctataattccgcctcctccgtcagcagtgttcaccggattaggcccaacgggcaccactgttgtcaacggtgtggcttctcaatttaaaggcactaacttgtggttcatggcatcttctttaaccctcttgttttcagttccctttctgttgtggggttga

SEQ ID NO: 880 - protein, 184 aa, Populus balsamifera subsp. trichocarpa
  misc_feature (1)..(184): Ceres ANNOT ID no. 1458591
  misc_feature (20)..(106): Pfam Name: X8 Pfam Description: X8 domain
  misc_feature: SWISSPROT Homolog: E133_ARATH Putative glucan endo-1,3-beta-glucosidase 3 precursor with e-value of 7.0e-16 and BLAST sequence identity of 31.1
  misc_feature: SWISSPROT Homolog: E133_ARATH EC 3.2.1.39 ((1->3)-beta-glucan endohydrolase) ((1->3)- beta -glucanase) (Beta-1,3-endoglucanase) (Beta-1,3-glucanase)
  misc_feature: SWISSPROT Homolog: E131_ARATH Putative glucan endo-1,3-beta-glucosidase 1 precursor with e-value of 8.4e-16 and BLAST sequence identity of 37.1
  misc_feature: SWISSPROT Homolog: E131_ARATH EC 3.2.1.39 ((1->3)-beta-glucan endohydrolase)((1->3)- beta-glucanase) (Beta-1,3-endoglucanase) ( Beta-1,3-glucanase)
  misc_feature: SWISSPROT Homolog: E13B_WHEAT Glucan endo-1,3-beta-glucosidase precursor with e-value of 1.5e-14 and BLAST sequence identity of 36.6
  misc_feature: SWISSPROT Homolog: E13B_WHEAT EC 3.2.1.39 ((1->3)- beta-glucan endohydrolase) ((1->3)-beta-glucanase)( Beta-1,3-endoglucanase)
  misc_feature: SWISSPROT Homolog: E134_ARATH Putative glucan endo-1,3-beta-glucosidase 4 precursor with e-value of 4.4e-12 and BLAST sequence identity of 29.5
  misc_feature: SWISSPROT Homolog: E134_ARATH EC 3.2.1.39) ((1->3)-beta-glucan endohydrolase) ((1->3)-beta- glucanase) (Beta-1,3-glucanase)
  misc_feature: SWISSPROT Homolog: Y2082_MYCTU Hypothetical protein Rv2082 with e-value of 5.9e-06 and BLAST sequence identity of 37.9
  misc_feature 93065:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(184): Functional Homolog of  Ceres CLONE ID no. 22007 at SEQ ID NO. 905 with e-value of 7.20E-40 and BLAST sequence identity of 50.2
MAVLVFLVFFWALTGHSYATYCICKDGIADTQLQKALDYACGAGADCTQIAQSGPCYQPNTVKDHCSYAVNSYFQKKGQAVGSCDFAGTAVTSATLPQNVASGCTYPASATSSTGNTSNSGTAPTGTNTPSSIIPPPPSAVFTGLGPTGTTVVNGVASQFKGTNLWFMASSLTLLFSVPFLLWG

SEQ ID NO: 881 - protein, 405 aa, Arabidopsis thaliana
  misc_feature (1)..(405): Ceres CLONE ID no. 22350
  misc_feature (1)..(405): Also Known As Ceres CDNA ID no. 23368763
  misc_feature (1)..(405): Also Known As Ceres GEMINI ID 553B11
  misc_feature (105)..(266): Pfam Name: mTERF Pfam Description: mTERF
  misc_feature 93161:<222: Transcription Factor
  misc_feature: Phenotype: Activates expression of the gene endogenous to the PsROMT (SEQ ID NO 4161) regalutory region Useful for modulating Alkaloid Biosynthesis
MAVAIPQATSLTNLVFLTKLIPRGSFTTILPKHHRKPIFVFSLQTQFSSPVTTLTSKNPKDDEQQQKLSFTLNYLIDSCGLSPDSATVASRKLLLDSPERPNTVLNLLRDHGFTTAQISSLVKKRPVLLLANAESVLLPKLSFFLSIGVSKSLLARTLASDPTILTRSLVNQLIPSYNFLKSVLDSDEKIVAALRRTTWVFLEDHTKNLVPNINYMAETGVPEKCIKLLLTHFPEAVMQKNHEFQAIAKQAQEMGFNPQKSTFVLAIHALSGKGNKSIWDKCFEVYQRWGWSEDDIMCAFKKHPHCMMLSERKINRTMEYFVNEMNMAPRSIAQCPVVLFFSLEKRIIPRCSVTKVLVSNGLVKEDWSLTSLLVPVEKVFLEKLVIKYEEELPELMNLYLGCTKL

SEQ ID NO: 882 - DNA, 1203 bp, Populus balsamifera subsp. trichocarpa
  misc_feature (1)..(1203): Ceres ANNOT ID no. 1471704
  misc_feature 93264:<222: Transcription Factor
  misc_feature: Phenotype: Activates expression of the gene endogenous to the PsROMT (SEQ ID NO 4161) regalutory region Useful for modulating Alkaloid Biosynthesis
atggagctcatccaaaatatccgttgtgtaagattggacaatccatcatcaatcttctccttttccccttccaaaagacacttctccttctcacgagaattcaacaaaaacccacatgtctcttttccaaatcaaccgcttccaaaaccaatcagctgcaaaatttcaacagaacaagactctttcacaatcaactacctcgtacattcatgtgggttgcccttggaatctgcaatcttaacatcccaaaaggtacagtttcaatcccctgaaagaccagactccgttttggcccttttaagaaaccatggattctccagaacccagatctcaagtcttgttaaaaagcgcccatttcttcttttatccaatcctacgaatacacttttgcctaaacttgacttctttctctctttaggtatgtcaaggcctcaccttgccagaactctttcttcagacccaaccctattgactagaagcttggaaaaccaaattgtaccctcttataactttctcaaaaccatcttgcgttctgatgaaaagattgtttctgcttttaagcgtaccacttggatatttctagaggatctttcaaagaatcttataccaaatcttgagcttttgagaaaagtaggcgtgccacagtcttgcatttcgttattgcttacacatttccctgaagctatgatggaaaatcatgaagagtttagtgaaaatgtagaggaagtgagaaaaatgggatttgatccaaataaatcaacttttgtgctggctgtgcatgccctttgtggaaagtgcaataagtcaatttgggaacgctgttttgaggtttataagaggtggggttggactaaagatgacattctttcagcatttagaaagcatccccattgtatgatgctatcggagaagaaaatcatgaaaggactggatttttttgtgaacaagatggggtggccttcaaaggagattgtgcattgccctgttatcttgtttttaagcttagagaagagaattatccccaggtgtaaggttattcaggttttgtggtcaaagggtttgataaagaaagatatcagcttgaataccgtgttgcttcctgtggagaagcgctttctggagaggtttgtgaccaaatttgaagaggaagtacctcaattattgagtgtctatgaagggaaggtggatcctgagggagtatga

SEQ ID NO: 883 - protein, 400 aa, Populus balsamifera subsp. trichocarpa
  misc_feature (1)..(400): Ceres ANNOT ID no. 1471704
  misc_feature (97)..(258): Pfam Name: mTERF Pfam Description: mTERF
  misc_feature 93337:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(400): Functional Homolog of  Ceres CLONE ID no. 22350 at SEQ ID NO. 910 with e-value of 1.40E-116 and BLAST sequence identity of 62.1
MELIQNIRCVRLDNPSSIFSFSPSKRHFSFSREFNKNPHVSFPNQPLPKPISCKISTEQDSFTINYLVHSCGLPLESAILTSQKVQFQSPERPDSVLALLRNHGFSRTQISSLVKKRPFLLLSNPTNTLLPKLDFFLSLGMSRPHLARTLSSDPTLLTRSLENQIVPSYNFLKTILRSDEKIVSAFKRTTWIFLEDLSKNLIPNLELLRKVGVPQSCISLLLTHFPEAMMENHEEFSENVEEVRKMGFDPNKSTFVLAVHALCGKCNKSIWERCFEVYKRWGWTKDDILSAFRKHPHCMMLSEKKIMKGLDFFVNKMGWPSKEIVHCPVILFLSLEKRIIPRCKVIQVLWSKGLIKKDISLNTVLLPVEKRFLERFVTKFEEEVPQLLSVYEGKVDPEGV

SEQ ID NO: 884 - protein, 115 aa, Arabidopsis thaliana
  misc_feature (1)..(115): Ceres CLONE ID no. 22551
  misc_feature (12)..(83): Pfam Name: PABP Pfam Description: Poly-adenylate binding protein, unique domain
  misc_feature: Utility: ABA Useful for making plants with enhanced tolerance to drought
  misc_feature: Phenotype: WHOLE PLANT - ABA Useful for making plants with enhanced tolerance to drought
MNVMPYSQPMSAGQLATSLANATPAQQRTLLGESLYPLVDQIESEHAAKVTGMLLEMDQTEVLHLLESPEALNAKVSEALDVLRNVNQPSSQGSEGNKSGSPSDLLASLSINDHL

SEQ ID NO: 885 - DNA, 1932 bp, Populus balsamifera subsp. trichocarpa
  misc_feature (1)..(1932): Ceres ANNOT ID no. 1461019
  misc_feature: Utility: ABA Useful for making plants with enhanced tolerance to drought
  misc_feature 93512:<222: Transcription Factor
  misc_feature: Phenotype: WHOLE PLANT - ABA Useful for making plants with enhanced tolerance to drought
atggcacaggttcaagtaccggcgcagccacagaatgtgaatggaggggctaataacccaaattttgtaacgacatcgctttatgtgggtgatttggaagcgaatgtgactgattcccagttgtatgatctgtttaatcaagtgggtcaagtggtttccgtcagggtttgcagggacctgacgagccgcaggtcccttggttatggttatgttaactacagcaatcctcaagatgctgcaagggcattggaagtgctgaatttcactccagtgaatggaagtccaatcagggttatgtattcccatcgtgacccgagtgttcgcaaaagtggggcaggaaatatatttattaagaatttggacaaggcaattgaccacaaagcactgcatgacacattttcagtatttgggaacattctctcttgcaaggttgctactgacccctctggccagtcaaaaggctatgggtttgtgcagtttgacagcgaggaagctgctcaaaaagcgattgagaaactgaatggcatgctgttgaatgataagcaagtttacgtgggacctttccttcgcaagcaggaaagggatactgccactgacaagacaagattcaacaatgtttttgtgaagaatctatccgaaacgacagctgaggaggatttgaacaaagcttttggtgaatttggaactatcaccagtgttgtggtgatgagggatggtgatggaaagtctaggtgctttggatttgtgaactttgagaatgcagatgatgctgctaaagcagcggaggctcttaatggaaagaaatttgatgacaaggaatggtttgttgggaaagctcagaaaaaatatgaaagggaagtcgagttaaaacaacggtttgagcagagcatgaaggaagcagctgacaaatttcagggtgcaaatttgtacattaaaaatttagatgatagcataggtgatgagaaaattaaggagctgttttctccatttggtacaatcacgtcttgcaaggttatgcgagacccgaatggaataagcagaggatcagggtttgttgcattctcaactcctgaagaggcatcaagagctctattggagatgaacgggaaaatggttgctagcaaacctctatatgttgcccttgcacaaagaaaggaagatagaagagccaggttgcaggctcagttttctcaaatgcgaccagttgcaatggcaccttcagttggtcgtatgccaatgtacccccctactggtcccggtcttggacaacaaatattctatggacaaggcccacctgctatcatgccaccccagcctggatttgggtatcaacaacagctagtgcctggtatgaggcctggaggggctcctatgccaaatttctttgtgccaatggttcagcaggggcagcaaggtcagcgtcctggtggtcgacgggcaggtactggccagcaatcccagcagccagtccagctaatgcagcagcagatgcttcctaggggacgtgtctatcgctaccctccaggacgtggattgcctgatgttccaatgactggtgttgctggaggcatgctttctgttccatatgacatgggtggtatgccaatgcgtgatgcagcgctgtcccagccaattcccataggggctttggctactgcacttgcaaatgctactccagatcagcagagaacgatgctgggagaaaatctgtaccctcttgtggagcagctggaacctgaagccgcagctaaagtgacaggcatgcttctggagatggatcagactgaggttctgcacttgcttgagtcaccagaagctctcaaatcaaaggttaatgaggcgatggaggttctaaggactgttcagcagcaggccactggcacagctgatcaactagcctcattgtcactgaacgacaaccttgggccctag

SEQ ID NO: 886 - protein, 468 aa, Populus balsamifera subsp. trichocarpa
  misc_feature (1)..(468): Ceres ANNOT ID no. 1461019
  misc_feature (31)..(101): Pfam Name: RRM_1 Pfam Description: RNA recognition motif. (a.k.a. RRM RBD, or RNP domain)
  misc_feature (372)..(443): Pfam Name: PABP Pfam Description: Poly-adenylate binding protein, unique domain
  misc_feature: SWISSPROT Homolog: PABP2_ARATH Polyadenylate-binding protein 2 (Poly(A)-binding protein 2) (PABP 2) with e-value of 6.3e-27 and BLAST sequence identity of 70.8
  misc_feature: SWISSPROT Homolog: PABP5_ARATH Polyadenylate-binding protein 5 (Poly(A)-binding protein 5) (PABP 5) with e-value of 5.1e-21 and BLAST sequence identity of 61.6
  misc_feature: SWISSPROT Homolog: PABP3_ARATH Polyadenylate-binding protein 3 (Poly(A)-binding protein 3) (PABP 3) with e-value of 3.6e-20 and BLAST sequence identity of 67.1
  misc_feature: SWISSPROT Homolog: PABP_DROME Polyadenylate-binding protein (Poly(A)-binding protein) (PABP) with e-value of 1.3e-14 and BLAST sequence identity of 46.8
  misc_feature: SWISSPROT Homolog: PABP1_MOUSE Polyadenylate-binding protein 1 (Poly(A)-binding protein 1) (PABP 1) with e-value of 1.3e-14 and BLAST sequence identity of 43.8
  misc_feature: Utility: ABA Useful for making plants with enhanced tolerance to drought
  misc_feature 93662:<222: Transcription Factor
  misc_feature: Phenotype: WHOLE PLANT - ABA Useful for making plants with enhanced tolerance to drought
  misc_feature (1)..(468): Functional Homolog of  Ceres CLONE ID no. 22551 at SEQ ID NO. 913 with e-value of 1.89E-30 and BLAST sequence identity of 73.0
MLLNDKQVYVGPFLRKQERDTATDKTRFNNVFVKNLSETTAEEDLNKAFGEFGTITSVVVMRDGDGKSRCFGFVNFENADDAAKAAEALNGKKFDDKEWFVGKAQKKYEREVELKQRFEQSMKEAADKFQGANLYIKNLDDSIGDEKIKELFSPFGTITSCKVMRDPNGISRGSGFVAFSTPEEASRALLEMNGKMVASKPLYVALAQRKEDRRARLQAQFSQMRPVAMAPSVGRMPMYPPTGPGLGQQIFYGQGPPAIMPPQPGFGYQQQLVPGMRPGGAPMPNFFVPMVQQGQQGQRPGGRRAGTGQQSQQPVQLMQQQMLPRGRVYRYPPGRGLPDVPMTGVAGGMLSVPYDMGGMPMRDAALSQPIPIGALATALANATPDQQRTMLGENLYPLVEQLEPEAAAKVTGMLLEMDQTEVLHLLESPEALKSKVNEAMEVLRTVQQQATGTADQLASLSLNDNLGP

SEQ ID NO: 887 - DNA, 2127 bp, Populus balsamifera subsp. trichocarpa
  misc_feature (1)..(2127): Ceres ANNOT ID no. 1496766
  misc_feature: Utility: ABA Useful for making plants with enhanced tolerance to drought
  misc_feature 93791:<222: Transcription Factor
  misc_feature: Phenotype: WHOLE PLANT - ABA Useful for making plants with enhanced tolerance to drought
atggcgcagattcaggtgcatcaagcagcggctccagtacctggacccaacggagtggctgcgggacctggagcgatccagtttgtgccgacttcgctttatgttggagatcttgacttcaacgtgactgattcgcagctttacgatctgtttaatcaggtcggtcaggtggtttcggttagggtctgtagggatttgagcaccaggcgatcacttggttatggttatgttaactacagcaaccctcaggatgctgcaagggcattggatgtcttaaacttcactccactcaataacaagcctctcaggatcatgtattcacatcgggacccaagtattcgtaagagtggcatggcgaatatatttatcaagaatctggacaagactattgatcacaaagctttacatgacacgttttcttcattcggtaatattctttcttgcaaagtcgctactgatgcttctggccagtccaagggctatggttttgtacaatttgacagtgaagaggctgctcaaaatgcaatagataaattaaatggcatgctgattaatgataaacaagtgtatgttggaaactttctgcgcaaacaggaaagagatagtgctctaagtaacatcaaattcaacaacatttatgtgaaaaatcttgctgaatccacaacagacgaagacttgaagagtatttttgaagaacatggagcaattactagtgctgtagtgatgagggatgcagatggaaaatcaaaatgttttggatttgtcaattttgaaaatgtagatgatgctgccaaagctgtagaggctcttaacggcaagaaatttgatgataaggagtggtatgttggaaaagcccaaaaaaaatctgaaagagagcttgaactgaaagggcgatttgagcagagcctggagtctgttgaaaaataccaagccgtgaatttgtatatcaagaatctggacgatagtgttaatgatgaaaaactcaaggaattgttctctgactttggcactattacttcgtgcaaggttatgcacgaccctagtggtattagcagaggttctggatttgttgcgttctcaactcctgaagaagcatctagagctcttgcagagctgaatggaaaaatggttgttagcaaacccctgtatgttgcccctgctcaacggaaggaagagagaagagcaaggctacaggcacaattttctcaaatgaggccagttgccatggcaccttcagttgctcctcgtatgcaaatgtatcctcctggggctcccggtcttgggcagcaatttctatatgggcaaggacctccagcaatgattcctcaggctggatttggctatcaacagcaacttgtacctggaatgaggcctggtggtgctccaatgccaaattttttcgtgcctcttgttcagcagggtcagcaaggccagcgccctggagggcgacgtggaggtggccctgttcaacagacccagcagccagtccctctcatgcagcaacagatgcttcccaggggacgtgtctatcgttacccacctggtcgtaacatgccagatgttccgatgccaggtgttgctggtggcatgctttcagttccttatgacatgggtgtcatgccaatacgagatgctgctggcggacagcccatgcccattactgctttggctactgcccttgcaaatgcaacacctgaacagcaaaggacgatgctgggtgagggtctataccccctagtggatcagctggagcatgattcagcagccaaggttacaggcatgcttctagagatggatcaaactgaggttttgcacctgctcgagtcaccagaagctttgaaggcaaaagtggcagaggctatggaggttcttaggactgtagctgctcagcagcagatcaacaatccagcggaccatcttgcctcactgtctctgaatgaaaatcttgtttctttggtagacgagcattgcaccgttttcttgaaacaagtgagctctatgcgtggagaggaaccaagaatcccgaggatgataggaacccggaacccagatgaagaatattttttgttctgtgtagttcttgcctctgtgctatggaaagaggttcccactggtgaagttggttaa

SEQ ID NO: 888 - protein, 591 aa, Populus balsamifera subsp. trichocarpa
  misc_feature (1)..(591): Ceres ANNOT ID no. 1496766
  misc_feature (4)..(74): Pfam Name: RRM_1 Pfam Description: RNA recognition motif. (a.k.a. RRM RBD, or RNP domain)
  misc_feature (436)..(507): Pfam Name: PABP Pfam Description: Poly-adenylate binding protein, unique domain
  misc_feature: SWISSPROT Homolog: PABP2_ARATH Polyadenylate-binding protein 2 (Poly(A)-binding protein 2) (PABP 2) with e-value of 6.3e-27 and BLAST sequence identity of 70.8
  misc_feature: SWISSPROT Homolog: PABP5_ARATH Polyadenylate-binding protein 5 (Poly(A)-binding protein 5) (PABP 5) with e-value of 5.1e-21 and BLAST sequence identity of 61.6
  misc_feature: SWISSPROT Homolog: PABP3_ARATH Polyadenylate-binding protein 3 (Poly(A)-binding protein 3) (PABP 3) with e-value of 3.6e-20 and BLAST sequence identity of 67.1
  misc_feature: SWISSPROT Homolog: PABP_DROME Polyadenylate-binding protein (Poly(A)-binding protein) (PABP) with e-value of 1.3e-14 and BLAST sequence identity of 46.8
  misc_feature: SWISSPROT Homolog: PABP1_MOUSE Polyadenylate-binding protein 1 (Poly(A)-binding protein 1) (PABP 1) with e-value of 1.3e-14 and BLAST sequence identity of 43.8
  misc_feature: Utility: ABA Useful for making plants with enhanced tolerance to drought
  misc_feature 93947:<222: Transcription Factor
  misc_feature: Phenotype: WHOLE PLANT - ABA Useful for making plants with enhanced tolerance to drought
  misc_feature (1)..(591): Functional Homolog of  Ceres CLONE ID no. 22551 at SEQ ID NO. 913 with e-value of 6.29E-30 and BLAST sequence identity of 71.2
MANIFIKNLDKTIDHKALHDTFSSFGNILSCKVATDASGQSKGYGFVQFDSEEAAQNAIDKLNGMLINDKQVYVGNFLRKQERDSALSNIKFNNIYVKNLAESTTDEDLKSIFEEHGAITSAVVMRDADGKSKCFGFVNFENVDDAAKAVEALNGKKFDDKEWYVGKAQKKSERELELKGRFEQSLESVEKYQAVNLYIKNLDDSVNDEKLKELFSDFGTITSCKVMHDPSGISRGSGFVAFSTPEEASRALAELNGKMVVSKPLYVAPAQRKEERRARLQAQFSQMRPVAMAPSVAPRMQMYPPGAPGLGQQFLYGQGPPAMIPQAGFGYQQQLVPGMRPGGAPMPNFFVPLVQQGQQGQRPGGRRGGGPVQQTQQPVPLMQQQMLPRGRVYRYPPGRNMPDVPMPGVAGGMLSVPYDMGVMPIRDAAGGQPMPITALATALANATPEQQRTMLGEGLYPLVDQLEHDSAAKVTGMLLEMDQTEVLHLLESPEALKAKVAEAMEVLRTVAAQQQINNPADHLASLSLNENLVSLVDEHCTVFLKQVSSMRGEEPRIPRMIGTRNPDEEYFLFCVVLASVLWKEVPTGEVG

SEQ ID NO: 889 - DNA, 2172 bp, Populus balsamifera subsp. trichocarpa
  misc_feature (1)..(2172): Ceres ANNOT ID no. 1443824
  misc_feature: Utility: ABA Useful for making plants with enhanced tolerance to drought
  misc_feature 94097:<222: Transcription Factor
  misc_feature: Phenotype: WHOLE PLANT - ABA Useful for making plants with enhanced tolerance to drought
atggcgcagattcaggtgcatcaagcagcggctccagtacctggacccaacggagtggctgcgggacctggagcgatccagtttgtgccgacttcgctttatgttggagatcttgacttcaacgtgactgattcgcagctttacgatctgtttaatcaggtcggtcaggtggtttcggttagggtctgtagggatttgagcaccaggcgatcacttggttatggttatgttaactacagcaaccctcaggatgctgcaagggcattggatgtcttaaacttcactccactcaataacaagcctctcaggatcatgtattcacatcgggacccaagtattcgtaagagtggcatggcgaatatatttatcaagactaaccctgaccttatattctgcgttgcattttggggacttcagaatctggacaagactattgatcacaaagctttacatgacacgttttcttcattcggtaatattctttcttgcaaagtcgctactgatgcttctggccagtccaagggctatggttttgtacaatttgacagtgaagaggctgctcaaaatgcaatagataaattaaatggcatgctgattaatgataaacaagtgtatgttggaaactttctgcgcaaacaggaaagagatagtgctctaagtaacatcaaattcaacaacatttatgtgaaaaatcttgctgaatccacaacagacgaagacttgaagagtatttttgaagaacatggagcaattactagtgctgtagtgatgagggatgcagatggaaaatcaaaatgttttggatttgtcaattttgaaaatgtagatgatgctgccaaagctgtagaggctcttaacggcaagaaatttgatgataaggagtggtatgttggaaaagcccaaaaaaaatctgaaagagagcttgaactgaaagggcgatttgagcagagcctggagtctgttgaaaaataccaagccgtgaatttgtatatcaagaatctggacgatagtgttaatgatgaaaaactcaaggaattgttctctgactttggcactattacttcgtgcaaggttatgcacgaccctagtggtattagcagaggttctggatttgttgcgttctcaactcctgaagaagcatctagagctcttgcagagctgaatggaaaaatggttgttagcaaacccctgtatgttgcccctgctcaacggaaggaagagagaagagcaaggctacaggcacaattttctcaaatgaggccagttgccatggcaccttcagttgctcctcgtatgcaaatgtatcctcctggggctcccggtcttgggcagcaatttctatatgggcaaggacctccagcaatgattcctcaggctggatttggctatcaacagcaacttgtacctggaatgaggcctggtggtgctccaatgccaaattttttcgtgcctcttgttcagcagggtcagcaaggccagcgccctggagggcgacgtggaggtggccctgttcaacagacccagcagccagtccctctcatgcagcaacagatgcttcccaggggacgtgtctatcgttacccacctggtcgtaacatgccagatgttccgatgccaggtgttgctggtggcatgctttcagttccttatgacatgggtgtcatgccaatacgagatgctgctggcggacagcccatgcccattactgctttggctactgcccttgcaaatgcaacacctgaacagcaaaggacgatgctgggtgagggtctataccccctagtggatcagctggagcatgattcagcagccaaggttacaggcatgcttctagagatggatcaaactgaggttttgcacctgctcgagtcaccagaagctttgaaggcaaaagtggcagaggctatggaggttcttaggactgtagctgctcagcagcagatcaacaatccagcggaccatcttgcctcactgtctctgaatgaaaatcttgtttctttggtagacgagcattgcaccgttttcttgaaacaagtgagctctatgcgtggagaggaaccaagaatcccgaggatgataggaacccggaacccagatgaagaatattttttgttctgtgtagttcttgcctctgtgctatggaaagaggttcccactggtgaagttggttaa

SEQ ID NO: 890 - protein, 606 aa, Populus balsamifera subsp. trichocarpa
  misc_feature (1)..(606): Ceres ANNOT ID no. 1443824
  misc_feature (212)..(282): Pfam Name: RRM_1 Pfam Description: RNA recognition motif. (a.k.a. RRM RBD, or RNP domain)
  misc_feature (451)..(522): Pfam Name: PABP Pfam Description: Poly-adenylate binding protein, unique domain
  misc_feature: SWISSPROT Homolog: PABP2_ARATH Polyadenylate-binding protein 2 (Poly(A)-binding protein 2) (PABP 2) with e-value of 6.3e-27 and BLAST sequence identity of 70.8
  misc_feature: SWISSPROT Homolog: PABP5_ARATH Polyadenylate-binding protein 5 (Poly(A)-binding protein 5) (PABP 5) with e-value of 5.1e-21 and BLAST sequence identity of 61.6
  misc_feature: SWISSPROT Homolog: PABP3_ARATH Polyadenylate-binding protein 3 (Poly(A)-binding protein 3) (PABP 3) with e-value of 3.6e-20 and BLAST sequence identity of 67.1
  misc_feature: SWISSPROT Homolog: PABP_DROME Polyadenylate-binding protein (Poly(A)-binding protein) (PABP) with e-value of 1.3e-14 and BLAST sequence identity of 46.8
  misc_feature: SWISSPROT Homolog: PABP1_MOUSE Polyadenylate-binding protein 1 (Poly(A)-binding protein 1) (PABP 1) with e-value of 1.3e-14 and BLAST sequence identity of 43.8
  misc_feature: Utility: ABA Useful for making plants with enhanced tolerance to drought
  misc_feature 94255:<222: Transcription Factor
  misc_feature: Phenotype: WHOLE PLANT - ABA Useful for making plants with enhanced tolerance to drought
  misc_feature (1)..(606): Functional Homolog of  Ceres CLONE ID no. 22551 at SEQ ID NO. 913 with e-value of 6.99E-30 and BLAST sequence identity of 71.2
MANIFIKTNPDLIFCVAFWGLQNLDKTIDHKALHDTFSSFGNILSCKVATDASGQSKGYGFVQFDSEEAAQNAIDKLNGMLINDKQVYVGNFLRKQERDSALSNIKFNNIYVKNLAESTTDEDLKSIFEEHGAITSAVVMRDADGKSKCFGFVNFENVDDAAKAVEALNGKKFDDKEWYVGKAQKKSERELELKGRFEQSLESVEKYQAVNLYIKNLDDSVNDEKLKELFSDFGTITSCKVMHDPSGISRGSGFVAFSTPEEASRALAELNGKMVVSKPLYVAPAQRKEERRARLQAQFSQMRPVAMAPSVAPRMQMYPPGAPGLGQQFLYGQGPPAMIPQAGFGYQQQLVPGMRPGGAPMPNFFVPLVQQGQQGQRPGGRRGGGPVQQTQQPVPLMQQQMLPRGRVYRYPPGRNMPDVPMPGVAGGMLSVPYDMGVMPIRDAAGGQPMPITALATALANATPEQQRTMLGEGLYPLVDQLEHDSAAKVTGMLLEMDQTEVLHLLESPEALKAKVAEAMEVLRTVAAQQQINNPADHLASLSLNENLVSLVDEHCTVFLKQVSSMRGEEPRIPRMIGTRNPDEEYFLFCVVLASVLWKEVPTGEVG

SEQ ID NO: 891 - DNA, 1956 bp, Populus balsamifera subsp. trichocarpa
  misc_feature (1)..(1956): Ceres ANNOT ID no. 1486521
  misc_feature: Utility: ABA Useful for making plants with enhanced tolerance to drought
  misc_feature 94408:<222: Transcription Factor
  misc_feature: Phenotype: WHOLE PLANT - ABA Useful for making plants with enhanced tolerance to drought
atggcgcagattcagttgcatcaatcgggggcttcggtaccgggacccaacggagtggcggcgggacctggagcgatccagtttgtgccgacttcgctttatgttggtgatcttgacttcaacgtgactgattctcagctttacgacgtgtttaatcaggtcggccaggtggtttcggttagggtttgtagggatttgagtaccaggcgatctcttggctatggttatgttaactatagcaaccctcaggatgctgcaagggcattggatgtcttgaactttactccactcaataacaagcctatcaggatcatgtattcccatcgggacccaagtattcgtaagagtggcatggcaaatatatttatcaagaacctggacaagggtattgatcacaaagctttacacgacacattttcttcatttggcaatattctttcttgcaaagttgctactgatgcttctggccagtccaaaggctatggttttgtacaatttgacagcgaggaggctgcacaaaatgcaatagataaattaaatggcatgttggtcaatgataaacaagtgtatgttggacactttcttcgcaaacaggacagagatggtgctctatatagcataaaattcaacaatgtatttgtgaaaaatctggctgaatccacaacagatgaagagttgaagaatatttttgctgaacatggagcaattactagtgctgtggtgatgagggatgctgatggtaaatcaaaatgttttggatttgttaattttgaaagtgcagatgatgctgccaaagctgttgaggctcttaatggcaagaaaatcgatggtgaggagtggtatgttgggaaagcccagaaaaagtctgaaagagagcttgaactgaaagggcgatttgagcagagtatgaaggagactgttgacaaatttcaaggcttgaatttgtatatcaagaatctagatgatagcatcaatgatgaaaaactcaaggaattgttctctgactttggtgctattacttcgtgcaaggtcatgcgtgaccctagtggtattagcagaggttctggatttgttgccttctcaactcctgaagaagcatctcgagctcttgctgagatgaatggaaaaatgttgatcagcaaacccctgtatgttgcccttgctcaacggaaggaagagagaagagcaagacttcaggcacaattttctcaaatgaggccagttaccatggcaccttcagttgcttctcgtatgccaatgtatcctcctggtgctccaggtatgggacaacaatttctgtatgggcaaggacctccagccatgatgcctccccaggctggatttggctaccaacagcaacttgtccctggaatgaggcctggtggtgccccaatgccaaatttctttgttcctctggttcagcagggtcagcaaggccagcgacctggagggcgacgtgggggtggtcctgttcaacagacccagcagccagtccctctcatgcagcaacagatgcttccgaggggacgcgtgtatcgttacccaccaggtcgcaacatgccagatgtaccaatgccaggtgttgctggaggcatgctttctgttccttatgacatgggcggcatgccaatacgtgatgccgcacaacccatgcccattactgctttagctactgccctggcaaatgcaacacctgaacagcagaggacgatgctgggtgaaagtctataccccatagtggatcagcttgagcatgattcagcagccaaggttacaggcatgcttctggagatggatcaaactgaggtgttgcaccttcttgagtcaccagaggctttgaaggcaaaagtggcagaagctatggaggtccttaggactgtagctgctcagcagcagatcaacaatcaagcggatcagcttgggtcgctgtctctgaatgacaatcttgtctcttaa

SEQ ID NO: 892 - protein, 534 aa, Populus balsamifera subsp. trichocarpa
  misc_feature (1)..(534): Ceres ANNOT ID no. 1486521
  misc_feature (198)..(268): Pfam Name: RRM_1 Pfam Description: RNA recognition motif. (a.k.a. RRM RBD, or RNP domain)
  misc_feature (436)..(507): Pfam Name: PABP Pfam Description: Poly-adenylate binding protein, unique domain
  misc_feature: SWISSPROT Homolog: PABP2_ARATH Polyadenylate-binding protein 2 (Poly(A)-binding protein 2) (PABP 2) with e-value of 6.3e-27 and BLAST sequence identity of 70.8
  misc_feature: SWISSPROT Homolog: PABP5_ARATH Polyadenylate-binding protein 5 (Poly(A)-binding protein 5) (PABP 5) with e-value of 5.1e-21 and BLAST sequence identity of 61.6
  misc_feature: SWISSPROT Homolog: PABP3_ARATH Polyadenylate-binding protein 3 (Poly(A)-binding protein 3) (PABP 3) with e-value of 3.6e-20 and BLAST sequence identity of 67.1
  misc_feature: SWISSPROT Homolog: PABP_DROME Polyadenylate-binding protein (Poly(A)-binding protein) (PABP) with e-value of 1.3e-14 and BLAST sequence identity of 46.8
  misc_feature: SWISSPROT Homolog: PABP1_MOUSE Polyadenylate-binding protein 1 (Poly(A)-binding protein 1) (PABP 1) with e-value of 1.3e-14 and BLAST sequence identity of 43.8
  misc_feature: Utility: ABA Useful for making plants with enhanced tolerance to drought
  misc_feature 94558:<222: Transcription Factor
  misc_feature: Phenotype: WHOLE PLANT - ABA Useful for making plants with enhanced tolerance to drought
  misc_feature (1)..(534): Functional Homolog of  Ceres CLONE ID no. 22551 at SEQ ID NO. 913 with e-value of 8.09E-30 and BLAST sequence identity of 67.5
MANIFIKNLDKGIDHKALHDTFSSFGNILSCKVATDASGQSKGYGFVQFDSEEAAQNAIDKLNGMLVNDKQVYVGHFLRKQDRDGALYSIKFNNVFVKNLAESTTDEELKNIFAEHGAITSAVVMRDADGKSKCFGFVNFESADDAAKAVEALNGKKIDGEEWYVGKAQKKSERELELKGRFEQSMKETVDKFQGLNLYIKNLDDSINDEKLKELFSDFGAITSCKVMRDPSGISRGSGFVAFSTPEEASRALAEMNGKMLISKPLYVALAQRKEERRARLQAQFSQMRPVTMAPSVASRMPMYPPGAPGMGQQFLYGQGPPAMMPPQAGFGYQQQLVPGMRPGGAPMPNFFVPLVQQGQQGQRPGGRRGGGPVQQTQQPVPLMQQQMLPRGRVYRYPPGRNMPDVPMPGVAGGMLSVPYDMGGMPIRDAAQPMPITALATALANATPEQQRTMLGESLYPIVDQLEHDSAAKVTGMLLEMDQTEVLHLLESPEALKAKVAEAMEVLRTVAAQQQINNQADQLGSLSLNDNLVS

SEQ ID NO: 893 - DNA, 1935 bp, Populus balsamifera subsp. trichocarpa
  misc_feature (1)..(1935): Ceres ANNOT ID no. 1441125
  misc_feature: Utility: ABA Useful for making plants with enhanced tolerance to drought
  misc_feature 94699:<222: Transcription Factor
  misc_feature: Phenotype: WHOLE PLANT - ABA Useful for making plants with enhanced tolerance to drought
atggcacaagttcaagtaccagttcaaccacagagtgtgaatgcaggggctaataaccctaattttgtgacgacgtcgctttacgtgggtgatctggaagcaagtgtgactgattcccagctgtatgatctgtttaatcaagtgggtcaagtggtttcagtcagggtttgcagggacttgacgagccgtaggtcccttggctatggttatgttaactacagcaatcctcaagatgctgcgagggcattagaaatgctgaattttactcccctgaatggaagtccaatcagggttatgtattctcatcgtgacccaactattcgcaaaagtggggctggaaatatatttattaagaatttggacaaggcaattgaccacaaagctttgcatgatactttttcggcatttgggaacatcctctcttgcaaggttgctactgacccatctggccagtctaaaggctatggttttgtgcagtttgacagtgaagaagctgcccaaaaagcaattgagaaactgaatggcatgctgttgaatgataagcaagtttatgtgggaccgttccttcgcaagcaggaaagggacactgctactgacaagatgagattcaacaatgtctttgtgaagaatctatccgaaacaacaactgaggaggatttgaacaaaacttttggtgaatttggaaccatcactagtattgtggtgatgagggatggcgatggaaaatccaagtgttttggatttgttaactttgagaatgcagaagatgctgctaaagcagttgaggctcttaacgggaaaaaaattgatgataaggaatggtttgttgggaaagctcagaaaaaatatgaaagggaagttgaattaaagcagcgatttgagcagagtatgaaggaagcagctgacaaatttcagggtgcaaacttgtacatcaaaaatttagatgatagcataggtgatgagaagcttaaggagctgttttctccatttggtacaatcacgtcgtgcaaggttatgcgagacccaaatggaataagcagaggatcagggtttgttgcattttcaactcctgaagaggcatctagagctctcttggagatgaatggaaaaattgttgttagcaaacctctatatgttgcacttgcacaaagaaaggaggatagaagagccaggctacaggctcaattttctcaaatgcgaccagttgcaatggcaccttcagttggccctcgtatgcctatgtatccccctgcgggtccaggtcttggacagcaaatattttatggacaagccccacctgctatcataccaccccagcctgggtttgggtatcaacagcagctagtgcctggtatgaggcctggcggggctcctatgccaaatttctttgtgccaatggttcagcagggtcagcagggtcagcgacctggaggtcgacgggcaggagctggtcagcaatcccagcagccagtcccacttatgcagcaacagatgcttcctagggggcgtgtctatcgctaccctccaggacgtggcttgcctgatgttccaatgactggtgttgctggaggcatgcttcctgttccatatgacatgggtggcatgccaatgcgtgatgcagcattgtctcagtcaattcctgttggggctttggctactgcacttgcaaatgctactccagatcagcagagaacgatgcttggcgaaaatctgtaccctctcgtggaacagctggagcctgaagcagcggctaaagtgacaggcatgcttctggagatggatcaaactgaggttctgcacttgcttgagtcaccagaagctctcaaagcaaaggttaatgaagcaatggaggttctaaggactgttcagcagcaggccactggcacagctgatcaactagcttctttgtcattgaatgacaaccttgtgccctag

SEQ ID NO: 894 - protein, 546 aa, Populus balsamifera subsp. trichocarpa
  misc_feature (1)..(546): Ceres ANNOT ID no. 1441125
  misc_feature (108)..(178): Pfam Name: RRM_1 Pfam Description: RNA recognition motif. (a.k.a. RRM RBD, or RNP domain)
  misc_feature (450)..(521): Pfam Name: PABP Pfam Description: Poly-adenylate binding protein, unique domain
  misc_feature: SWISSPROT Homolog: PABP2_ARATH Polyadenylate-binding protein 2 (Poly(A)-binding protein 2) (PABP 2) with e-value of 6.3e-27 and BLAST sequence identity of 70.8
  misc_feature: SWISSPROT Homolog: PABP5_ARATH Polyadenylate-binding protein 5 (Poly(A)-binding protein 5) (PABP 5) with e-value of 5.1e-21 and BLAST sequence identity of 61.6
  misc_feature: SWISSPROT Homolog: PABP3_ARATH Polyadenylate-binding protein 3 (Poly(A)-binding protein 3) (PABP 3) with e-value of 3.6e-20 and BLAST sequence identity of 67.1
  misc_feature: SWISSPROT Homolog: PABP_DROME Polyadenylate-binding protein (Poly(A)-binding protein) (PABP) with e-value of 1.3e-14 and BLAST sequence identity of 46.8
  misc_feature: SWISSPROT Homolog: PABP1_MOUSE Polyadenylate-binding protein 1 (Poly(A)-binding protein 1) (PABP 1) with e-value of 1.3e-14 and BLAST sequence identity of 43.8
  misc_feature: Utility: ABA Useful for making plants with enhanced tolerance to drought
  misc_feature 94849:<222: Transcription Factor
  misc_feature: Phenotype: WHOLE PLANT - ABA Useful for making plants with enhanced tolerance to drought
  misc_feature (1)..(546): Functional Homolog of  Ceres CLONE ID no. 22551 at SEQ ID NO. 913 with e-value of 1.59E-29 and BLAST sequence identity of 73.0
MYSHRDPTIRKSGAGNIFIKNLDKAIDHKALHDTFSAFGNILSCKVATDPSGQSKGYGFVQFDSEEAAQKAIEKLNGMLLNDKQVYVGPFLRKQERDTATDKMRFNNVFVKNLSETTTEEDLNKTFGEFGTITSIVVMRDGDGKSKCFGFVNFENAEDAAKAVEALNGKKIDDKEWFVGKAQKKYEREVELKQRFEQSMKEAADKFQGANLYIKNLDDSIGDEKLKELFSPFGTITSCKVMRDPNGISRGSGFVAFSTPEEASRALLEMNGKIVVSKPLYVALAQRKEDRRARLQAQFSQMRPVAMAPSVGPRMPMYPPAGPGLGQQIFYGQAPPAIIPPQPGFGYQQQLVPGMRPGGAPMPNFFVPMVQQGQQGQRPGGRRAGAGQQSQQPVPLMQQQMLPRGRVYRYPPGRGLPDVPMTGVAGGMLPVPYDMGGMPMRDAALSQSIPVGALATALANATPDQQRTMLGENLYPLVEQLEPEAAAKVTGMLLEMDQTEVLHLLESPEALKAKVNEAMEVLRTVQQQATGTADQLASLSLNDNLVP

SEQ ID NO: 895 - DNA, 2031 bp, Populus balsamifera subsp. trichocarpa
  misc_feature (1)..(2031): Ceres ANNOT ID no. 1494024
  misc_feature: Utility: ABA Useful for making plants with enhanced tolerance to drought
  misc_feature 94993:<222: Transcription Factor
  misc_feature: Phenotype: WHOLE PLANT - ABA Useful for making plants with enhanced tolerance to drought
atggcacaagttcaagtaccagttcaaccacagagtgtgaatgcaggggctaataaccctaattttgtgacgacgtcgctttacgtgggtgatctggaagcaagtgtgactgattcccagctgtatgatctgtttaatcaagtgggtcaagtggtttcagtcagggtttgcagggacttgacgagccgtaggtcccttggctatggttatgttaactacagcaatcctcaagatgctgcgagggcattagaaatgctgaattttactcccctgaatggaagtccaatcagggttatgtattctcatcgtgacccaactattcgcaaaagtggggctggaaatatatttattaagaatttggacaaggcaattgaccacaaagctttgcatgatactttttcggcatttgggaacatcctctcttgcaaggttgctactgacccatctggccagtctaaaggctatggttttgtgcagtttgacagtgaagaagctgcccaaaaagcaattgagaaactgaatggcatgctgttgaatgataagcaagtttatgtgggaccgttccttcgcaagcaggaaagggacactgctactgacaagatgagattcaacaatgtctttgtgaagaatctatccgaaacaacaactgaggaggatttgaacaaaacttttggtgaatttggaaccatcactagtattgtggtgatgagggatggcgatggaaaatccaagtgttttggatttgttaactttgagaatgcagaagatgctgctaaagcagttgaggctcttaacgggaaaaaaattgatgataaggaatggtttgttgggaaagctcagaaaaaatatgaaagggaagttgaattaaagcagcgatttgagcagagtatgaaggaagcagctgacaaatttcagggtgcaaacttgtacatcaaaaatttagatgatagcataggtgatgagaagcttaaggagctgttttctccatttggtacaatcacgtcgtgcaagcgccagtggctttcaaaaaccaccacctgctgctcgattcagtctagttccgtttctatactttttgtctcctggtgtgagaaagtaccatactttttctccatgatgattatatcgagctgttcatataaacaaataacttttatatttgtaattatagtatcacaaacatgttttcacctacaggttatgcgagacccaaatggaataagcagaggatcagggtttgttgcattttcaactcctgaagaggcatctagagctctcttggagatgaatggaaaaattgttgttagcaaacctctatatgttgcacttgcacaaagaaaggaggatagaagagccaggctacaggctcaattttctcaaatgcgaccagttgcaatggcaccttcagttggccctcgtatgcctatgtatccccctgcgggtccaggtcttggacagcaaatattttatggacaagccccacctgctatcataccaccccagggtcagcagggtcagcgacctggaggtcgacgggcaggagctggtcagcaatcccagcagccagtcccacttatgcagcaacagatgcttcctagggggcgtgtctatcgctaccctccaggacgtggcttgcctgatgttccaatgactggtgttgctggaggcatgcttcctgttccatatgacatgggtggcatgccaatgcgtgatgcagcattgtctcagtcaattcctgttggggctttggctactgcacttgcaaatgctactccagatcagcagagaacgatgcttggcgaaaatctgtaccctctcgtggaacagctggagcctgaagcagcggctaaagtgacaggcatgcttctggagatggatcaaactgaggttctgcacttgcttgagtcaccagaagctctcaaagcaaaggttaatgaagcaatggaggttctaaggactgttcagcagcaggccactggcacagctgatcaactagcttctttgtcattgaatgacaaccttgtgccctag

SEQ ID NO: 896 - protein, 578 aa, Populus balsamifera subsp. trichocarpa
  misc_feature (1)..(578): Ceres ANNOT ID no. 1494024
  misc_feature (288)..(343): Pfam Name: RRM_1 Pfam Description: RNA recognition motif. (a.k.a. RRM RBD, or RNP domain)
  misc_feature (482)..(553): Pfam Name: PABP Pfam Description: Poly-adenylate binding protein, unique domain
  misc_feature: SWISSPROT Homolog: PABP2_ARATH Polyadenylate-binding protein 2 (Poly(A)-binding protein 2) (PABP 2) with e-value of 6.3e-27 and BLAST sequence identity of 70.8
  misc_feature: SWISSPROT Homolog: PABP5_ARATH Polyadenylate-binding protein 5 (Poly(A)-binding protein 5) (PABP 5) with e-value of 5.1e-21 and BLAST sequence identity of 61.6
  misc_feature: SWISSPROT Homolog: PABP3_ARATH Polyadenylate-binding protein 3 (Poly(A)-binding protein 3) (PABP 3) with e-value of 3.6e-20 and BLAST sequence identity of 67.1
  misc_feature: SWISSPROT Homolog: PABP_DROME Polyadenylate-binding protein (Poly(A)-binding protein) (PABP) with e-value of 1.3e-14 and BLAST sequence identity of 46.8
  misc_feature: SWISSPROT Homolog: PABP1_MOUSE Polyadenylate-binding protein 1 (Poly(A)-binding protein 1) (PABP 1) with e-value of 1.3e-14 and BLAST sequence identity of 43.8
  misc_feature: Utility: ABA Useful for making plants with enhanced tolerance to drought
  misc_feature 95145:<222: Transcription Factor
  misc_feature: Phenotype: WHOLE PLANT - ABA Useful for making plants with enhanced tolerance to drought
  misc_feature (1)..(578): Functional Homolog of  Ceres CLONE ID no. 22551 at SEQ ID NO. 913 with e-value of 1.99E-29 and BLAST sequence identity of 73.0
MYSHRDPTIRKSGAGNIFIKNLDKAIDHKALHDTFSAFGNILSCKVATDPSGQSKGYGFVQFDSEEAAQKAIEKLNGMLLNDKQVYVGPFLRKQERDTATDKMRFNNVFVKNLSETTTEEDLNKTFGEFGTITSIVVMRDGDGKSKCFGFVNFENAEDAAKAVEALNGKKIDDKEWFVGKAQKKYEREVELKQRFEQSMKEAADKFQGANLYIKNLDDSIGDEKLKELFSPFGTITSCKRQWLSKTTTCCSIQSSSVSILFVSWCEKVPYFFSMMIISSCSYKQITFIFVIIVSQTCFHLQVMRDPNGISRGSGFVAFSTPEEASRALLEMNGKIVVSKPLYVALAQRKEDRRARLQAQFSQMRPVAMAPSVGPRMPMYPPAGPGLGQQIFYGQAPPAIIPPQGQQGQRPGGRRAGAGQQSQQPVPLMQQQMLPRGRVYRYPPGRGLPDVPMTGVAGGMLPVPYDMGGMPMRDAALSQSIPVGALATALANATPDQQRTMLGENLYPLVEQLEPEAAAKVTGMLLEMDQTEVLHLLESPEALKAKVNEAMEVLRTVQQQATGTADQLASLSLNDNLVP

SEQ ID NO: 897 - protein, 165 aa, Arabidopsis thaliana
  misc_feature (1)..(165): Ceres CLONE ID no. 23322
  misc_feature (8)..(87): Pfam Name: C2 Pfam Description: C2 domain
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: SILIQUES - Long Useful for increasing seed/fruit yield or modifying fruit content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Other Useful for making ornamental plants with modified flowers
MEELVGLLRIRVKRGINLAQRDTLSSDPFVVITMGSQKLKTRVVENNCNPEWNEELTLALRHPDEPVNLIVYDKDTFTSHDKMGDAKIDIKPFLEVHKMGLQELPDGTEIKRVVPNRENCLAEASSIVSNNGKIVQNMILLLRNVECGEVEIQLEWIDIPGSRGL

SEQ ID NO: 898 - DNA, 516 bp, Populus balsamifera subsp. trichocarpa
  misc_feature (1)..(516): Ceres ANNOT ID no. 1512337
  misc_feature 95399:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: SILIQUES - Long Useful for increasing seed/fruit yield or modifying fruit content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Other Useful for making ornamental plants with modified flowers
atggacagctttcttggccttctcagaatccgggtgaaacgcggcgtaaatcttgccgttcgcgaccttggctccagtgatccttatgttgtcatcaccatgggaaaccagaaattgaagactcgagtggtgaaaaaaaactgcaatccagtgtggaatgaggagcttactctttcaattacagatctcaatgttccaatcaatttaacagtttttgacaaagacacgttcactgtggatgacaaaatgggtgaagcaggcatagacctccaaccatatatcgcaagtctaaagatgggcctgcaaaatctcccgaaaggttgtgtggtctcaagagttcagccaagccagaacaactgccttgctgatgagagctgcattgtttgggatgatggaaaactccaccaagacatgattctcagattaagaaatgtagagtctggtgaagttacgattcaaatcgagtggattgatgttccaggttgtcgaggattgaaaactgaaggtacgggctaa

SEQ ID NO: 899 - protein, 171 aa, Populus balsamifera subsp. trichocarpa
  misc_feature (1)..(171): Ceres ANNOT ID no. 1512337
  misc_feature (8)..(87): Pfam Name: C2 Pfam Description: C2 domain
  misc_feature: SWISSPROT Homolog: NEDD4_HUMAN E3 ubiquitin-protein ligase NEDD4 (EC 6.3.2.-) with e-value of 5.7e-09 and BLAST sequence identity of 32.3
  misc_feature: SWISSPROT Homolog: YC31_SCHPO Hypothetical protein C962.01 in chromosome III with e-value of 2.3e-08 and BLAST sequence identity of 35.1
  misc_feature: SWISSPROT Homolog: MYOF_HUMAN Myoferlin (Fer-1-like protein 3) with e-value of 3.6e-08 and BLAST sequence identity of 38.3
  misc_feature: SWISSPROT Homolog: YNI7_YEAST Hypothetical 132.5 kDa protein in TOP2-MKT1 intergenic region with e-value of 8.6e-08 and BLAST sequence identity of 32.1
  misc_feature: SWISSPROT Homolog: NEDD4_MOUSE E3 ubiquitin-protein ligase NEDD4 with e-value of 1.2e-07 and BLAST sequence identity of 28.0
  misc_feature: SWISSPROT Homolog: NEDD4_MOUSE EC 6.3.2.- (Neural precursor cell expressed developmentally down-regulated protein 4)
  misc_feature 95542:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: SILIQUES - Long Useful for increasing seed/fruit yield or modifying fruit content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(171): Functional Homolog of  Ceres CLONE ID no. 23322 at SEQ ID NO. 926 with e-value of 7.40E-54 and BLAST sequence identity of 64.2
MDSFLGLLRIRVKRGVNLAVRDLGSSDPYVVITMGNQKLKTRVVKKNCNPVWNEELTLSITDLNVPINLTVFDKDTFTVDDKMGEAGIDLQPYIASLKMGLQNLPKGCVVSRVQPSQNNCLADESCIVWDDGKLHQDMILRLRNVESGEVTIQIEWIDVPGCRGLKTEGTG

SEQ ID NO: 900 - DNA, 582 bp, Populus balsamifera subsp. trichocarpa
  misc_feature (1)..(582): Ceres ANNOT ID no. 1517094
  misc_feature 95657:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: SILIQUES - Long Useful for increasing seed/fruit yield or modifying fruit content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Other Useful for making ornamental plants with modified flowers
atggacaaccttcttggccttctcagaatccgggtgaaacgaggcaacaatcttgccgttcgcgatcttggtaccagtgatccttatgctgtcatcaccatgggaaaacagaaattgaaaactcgagtggtgaaaaaaaactgcaatccagagtggaacgaggagcttactctttcaatcacagatctcaatgttccaatcaatttaactgtttttgacaaagacagatttaccgtggatgataaaatgggtgaagcagaaatagacatcaaagcatatatcgcgagtctaaagatgggattgcaaaatctcccaaacggttgtgtggtctcaagaattaagccaagccggaacaactgccttgctgacgagagctgcgttgtttgggataacggcaaaatcctgcaagacatgattctcagattaagaaatgtagagtccggtgaagtgatgattcaaatcgagtggatgaatgttccaggttgtcggggattggaaattggagatttcaagctgcctgacagtaagcaacaagtgatctctagtgacatgatatctgtgcttcaatgttatggcttctag

SEQ ID NO: 901 - protein, 193 aa, Populus balsamifera subsp. trichocarpa
  misc_feature (1)..(193): Ceres ANNOT ID no. 1517094
  misc_feature (8)..(87): Pfam Name: C2 Pfam Description: C2 domain
  misc_feature: SWISSPROT Homolog: NEDD4_HUMAN E3 ubiquitin-protein ligase NEDD4 (EC 6.3.2.-) with e-value of 5.7e-09 and BLAST sequence identity of 32.3
  misc_feature: SWISSPROT Homolog: YC31_SCHPO Hypothetical protein C962.01 in chromosome III with e-value of 2.3e-08 and BLAST sequence identity of 35.1
  misc_feature: SWISSPROT Homolog: MYOF_HUMAN Myoferlin (Fer-1-like protein 3) with e-value of 3.6e-08 and BLAST sequence identity of 38.3
  misc_feature: SWISSPROT Homolog: YNI7_YEAST Hypothetical 132.5 kDa protein in TOP2-MKT1 intergenic region with e-value of 8.6e-08 and BLAST sequence identity of 32.1
  misc_feature: SWISSPROT Homolog: NEDD4_MOUSE E3 ubiquitin-protein ligase NEDD4 with e-value of 1.2e-07 and BLAST sequence identity of 28.0
  misc_feature: SWISSPROT Homolog: NEDD4_MOUSE EC 6.3.2.- (Neural precursor cell expressed developmentally down-regulated protein 4)
  misc_feature 95802:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: SILIQUES - Long Useful for increasing seed/fruit yield or modifying fruit content
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(193): Functional Homolog of  Ceres CLONE ID no. 23322 at SEQ ID NO. 926 with e-value of 1.20E-53 and BLAST sequence identity of 63.6
MDNLLGLLRIRVKRGNNLAVRDLGTSDPYAVITMGKQKLKTRVVKKNCNPEWNEELTLSITDLNVPINLTVFDKDRFTVDDKMGEAEIDIKAYIASLKMGLQNLPNGCVVSRIKPSRNNCLADESCVVWDNGKILQDMILRLRNVESGEVMIQIEWMNVPGCRGLEIGDFKLPDSKQQVISSDMISVLQCYGF

SEQ ID NO: 902 - protein, 272 aa, Arabidopsis thaliana
  misc_feature (1)..(272): Ceres CLONE ID no. 23439
  misc_feature (12)..(239): Pfam Name: Sterol_desat Pfam Description: Sterol desaturase
  misc_feature: Utility: Metabolic Profiling Useful for making plants with enhanced metabolite accumulation
  misc_feature: Phenotype: WHOLE PLANT - Metabolic Profiling Useful for making plants with enhanced metabolite accumulation
MDSLVESGWKYLVTHFSDFQLACIGSFILHESVFFLSGLPYIFLERTGFLSNYKIQTKSNTPEAQGKCIARLLLYHCCVNLPLMMASYPVFRFMGMESSFPLPSWKVVSAQILFYFIIEDFVFYWGHRILHTKWLYKNVHSVHHEYATPFGLTSEYAHPAEILFLGFATIVGPALTGPHLITLWLWMMLRVIETVEAHCGYHFPWSPSNFLPLYGGSLILMWESFAYSADFHDYHHRLLYTKSGNYSSTFVYMDWIFGTDKGYRKLKALKET

SEQ ID NO: 903 - DNA, 810 bp, Populus balsamifera subsp. trichocarpa
  misc_feature (1)..(810): Ceres ANNOT ID no. 1461748
  misc_feature: Utility: Metabolic Profiling Useful for making plants with enhanced metabolite accumulation
  misc_feature 96017:<222: Transcription Factor
  misc_feature: Phenotype: WHOLE PLANT - Metabolic Profiling Useful for making plants with enhanced metabolite accumulation
atggcctccctcatcgaatcttgctggctgtatttgatcacgcatttcagcgattttcagttggcatgtcttggaagtttctttcttcatgaaagcatcttcttcttgtctggtattcctttcatatatcttgaaagggctggatggctgaaaaagtacaaaatccagatgaaaaacaacactcctgcatctcaagagaaatgtattattcgcctacttttatatcattttggtgttaacctaccagttatgctggcctcctatcctgtcttcagacacatgggcatgcaaagtagtcttccattcccgtcctggaatgtaattctaacgcagataacattctacttcatcctggaagattttatattctactggggacatcggattttacacacaaaatggctgtacaagcatgtgcacagtgttcatcatgaatatgctacaccatttggattaacttctgaatatgctcaccctgctgaaatactgttccttggctttgctaccattattggtcctgccatcactgggccccatctgcttactttgtggttatggatggtactaagggtcctggagacggttgaagcacattgtggttatcatttcccatggagcctctccaacttcttacctttgtatggaggtgctgattttcatgactaccatcaccggttgctgtatactaaatctggaaactactcatctactttcacctacatggactgggtattcggtaccgataaaggttacagaaagttgcaagcattgaagaatgctggagtggaaaatggcggcaagcaaatgtaa

SEQ ID NO: 904 - protein, 269 aa, Populus balsamifera subsp. trichocarpa
  misc_feature (1)..(269): Ceres ANNOT ID no. 1461748
  misc_feature (12)..(224): Pfam Name: Sterol_desat Pfam Description: Sterol desaturase
  misc_feature: SWISSPROT Homolog: ERG25_RAT C-4 methylsterol oxidase (EC 1.14.13.72) (Neuropep 1) (RANP-1) with e-value of 1.7e-48 and BLAST sequence identity of 38.8
  misc_feature: SWISSPROT Homolog: ERG25_HUMAN C-4 methylsterol oxidase (EC 1.14.13.72) (Methylsterol monooxygenase) with e-value of 2.2e-48 and BLAST sequence identity of 38.5
  misc_feature: SWISSPROT Homolog: ERG25_PONPY C-4 methylsterol oxidase (EC 1.14.13.72) (Methylsterol monooxygenase) with e-value of 2.2e-48 and BLAST sequence identity of 38.5
  misc_feature: SWISSPROT Homolog: ERG25_MOUSE C-4 methylsterol oxidase (EC 1.14.13.72) (Methylsterol monooxygenase) with e-value of 2.8e-48 and BLAST sequence identity of 38.1
  misc_feature: SWISSPROT Homolog: ERG25_SCHPO C-4 methylsterol oxidase (EC 1.14.13.72) (Methylsterol monooxygenase) with e-value of 3.4e-43 and BLAST sequence identity of 35.5
  misc_feature: Utility: Metabolic Profiling Useful for making plants with enhanced metabolite accumulation
  misc_feature 96122:<222: Transcription Factor
  misc_feature: Phenotype: WHOLE PLANT - Metabolic Profiling Useful for making plants with enhanced metabolite accumulation
  misc_feature (1)..(269): Functional Homolog of  Ceres CLONE ID no. 23439 at SEQ ID NO. 931 with e-value of 2.30E-121 and BLAST sequence identity of 82.1
MASLIESCWLYLITHFSDFQLACLGSFFLHESIFFLSGIPFIYLERAGWLKKYKIQMKNNTPASQEKCIIRLLLYHFGVNLPVMLASYPVFRHMGMQSSLPFPSWNVILTQITFYFILEDFIFYWGHRILHTKWLYKHVHSVHHEYATPFGLTSEYAHPAEILFLGFATIIGPAITGPHLLTLWLWMVLRVLETVEAHCGYHFPWSLSNFLPLYGGADFHDYHHRLLYTKSGNYSSTFTYMDWVFGTDKGYRKLQALKNAGVENGGKQM

SEQ ID NO: 905 - DNA, 801 bp, Populus balsamifera subsp. trichocarpa
  misc_feature (1)..(801): Ceres ANNOT ID no. 1492747
  misc_feature: Utility: Metabolic Profiling Useful for making plants with enhanced metabolite accumulation
  misc_feature 96212:<222: Transcription Factor
  misc_feature: Phenotype: WHOLE PLANT - Metabolic Profiling Useful for making plants with enhanced metabolite accumulation
atggttttctttttgatgcagtatttgatcacgcacttcagtgattttcagttggcatgtcttggaagtttctttcttcatgaaagcgtcttcttcttgtctggacttcctttcatatatctcgaaagggctggatggctgaaaaagtacaaaattcagatgaaaaacaacacccctgcagctcaggagaaatgtattgttcgcttactcttgtatcattttggtgttaatctaccagttatgctagcctcctatcctgtcttcagacacatgggcatgcaaagtagtcttccattcccgtcctggaaagtaattctaatgcagataacattctacttcatcctggaagattttatattctattggggacaccggttcttacatacaaaatggctgtacaagcatgtgcacagtatccatcatgaatatgctacaccatttggattaacttccgaatatgctcaccctgctgagatactgttccttggttttgctactattgttggtcctgccatcacaggcccccatctggtaactttgtggttatggatggtactaagggtcctggagacagttgaagcacattgtggttatcatttcccctggagcctctccaattttttacctttgtatggaggtgctgattttcatgactaccatcaccgcttgctgtatactaaatctggaaactactcatctactttcacgtacatggactgggtatttggtaccgataaaggttacagaaagctgcaagcattgaagaatgctggagtggaaaatggcggcaagcaaacctaa

SEQ ID NO: 906 - protein, 261 aa, Populus balsamifera subsp. trichocarpa
  misc_feature (1)..(261): Ceres ANNOT ID no. 1492747
  misc_feature (4)..(219): Pfam Name: Sterol_desat Pfam Description: Sterol desaturase
  misc_feature: SWISSPROT Homolog: ERG25_RAT C-4 methylsterol oxidase (EC 1.14.13.72) Methylsterol monooxygenase (Neuropep 1) (RANP-1) with e-value of 1.7e-48 and BLAST sequence identity of 38.8
  misc_feature: SWISSPROT Homolog: ERG25_HUMAN C-4 methylsterol oxidase (EC 1.14.13.72) (Methylsterol monooxygenase) with e-value of 2.2e-48 and BLAST sequence identity of 38.5
  misc_feature: SWISSPROT Homolog: ERG25_PONPY C-4 methylsterol oxidase (EC 1.14.13.72) (Methylsterol monooxygenase) with e-value of 2.2e-48 and BLAST sequence identity of 38.5
  misc_feature: SWISSPROT Homolog: ERG25_MOUSE C-4 methylsterol oxidase (EC 1.14.13.72) (Methylsterol monooxygenase) with e-value of 2.8e-48 and BLAST sequence identity of 38.1
  misc_feature: SWISSPROT Homolog: ERG25_SCHPO C-4 methylsterol oxidase (EC 1.14.13.72) (Methylsterol monooxygenase) with e-value of 3.4e-43 and BLAST sequence identity of 35.5
  misc_feature: Utility: Metabolic Profiling Useful for making plants with enhanced metabolite accumulation
  misc_feature 96317:<222: Transcription Factor
  misc_feature: Phenotype: WHOLE PLANT - Metabolic Profiling Useful for making plants with enhanced metabolite accumulation
  misc_feature (1)..(261): Functional Homolog of  Ceres CLONE ID no. 23439 at SEQ ID NO. 931 with e-value of 3.10E-119 and BLAST sequence identity of 83.9
MQYLITHFSDFQLACLGSFFLHESVFFLSGLPFIYLERAGWLKKYKIQMKNNTPAAQEKCIVRLLLYHFGVNLPVMLASYPVFRHMGMQSSLPFPSWKVILMQITFYFILEDFIFYWGHRFLHTKWLYKHVHSIHHEYATPFGLTSEYAHPAEILFLGFATIVGPAITGPHLVTLWLWMVLRVLETVEAHCGYHFPWSLSNFLPLYGGADFHDYHHRLLYTKSGNYSSTFTYMDWVFGTDKGYRKLQALKNAGVENGGKQT

SEQ ID NO: 907 - protein, 190 aa, Arabidopsis thaliana
  misc_feature (1)..(190): Ceres CLONE ID no. 23518
  misc_feature (4)..(189): Pfam Name: Ribosomal_S7e Pfam Description: Ribosomal protein S7e
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MFSAQNKINKDKNAEPTECEEQVAQALFDLENTNQELKSELKDLYINQAVHMDISGNRKAVVIYVPFRLRKAFRKIHPRLVRELEKKFSGKDVIFVTTRRIMRPPKKGAAVQRPRNRTLTSVHEAMLEDVAFPAEIVGKRTRYRLDGSKIMKVFLDAKEKNNTEYKLETMVGVYRKLTGKDVVFEYPVEA

SEQ ID NO: 908 - DNA, 576 bp, Populus balsamifera subsp. trichocarpa
  misc_feature (1)..(576): Ceres ANNOT ID no. 1475658
  misc_feature 96507:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgttcaccacaaagaagaagatccagaaagacaaggatgcagaacccactgagtttgaggagactgttgcccaagcattatttgatttggaaaataccagctcggaactgaaaactgatctaaaggatctcttcataaattctgcagttcaaatagatgttgctggaaatcgcaaagctattgtcatttatgttccttatagactaaggaaggcttatcgcaagattcatcttcgtcttgttagagagctggagaaaaagtttagtgggaaggatgttgttctgcttgctacccgaaggattgtgcgtccacccaagaaaggctctgctgttcagcgcccccgctcccgcaccctaactgctgtgcatgaagccatgcttgaggatttagtttatcctgctgagattgttggaaagcgcaccagatacaggattgatggatccaaaattagcaagatcttcttggatcccaaggagcgcaataacaccgagtacaagctggagtcatttgctggagtttacaggaagcttacagggaaagatgtggtttttgatttccccatcacagaggcctga

SEQ ID NO: 909 - protein, 191 aa, Populus balsamifera subsp. trichocarpa
  misc_feature (1)..(191): Ceres ANNOT ID no. 1475658
  misc_feature (4)..(191): Pfam Name: Ribosomal_S7e Pfam Description: Ribosomal protein S7e
  misc_feature: SWISSPROT Homolog: RS7_BRAOL 40S ribosomal protein S7 with e-value of 8.5e-86 and BLAST sequence identity of 88.8
  misc_feature: SWISSPROT Homolog: RS7_AVIMR 40S ribosomal protein S7 with e-value of 1.4e-76 and BLAST sequence identity of 76.6
  misc_feature: SWISSPROT Homolog: RS7_ORYSA 40S ribosomal protein S7 with e-value of 1.5e-72 and BLAST sequence identity of 73.4
  misc_feature: SWISSPROT Homolog: RS7_SECCE 40S ribosomal protein S7 with e-value of 1.9e-72 and BLAST sequence identity of 73.4
  misc_feature: SWISSPROT Homolog: RS7_HORVU 40S ribosomal protein S7 with e-value of 4.0e-72 and BLAST sequence identity of 73.4
  misc_feature 96635:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(191): Functional Homolog of  Ceres CLONE ID no. 23518 at SEQ ID NO. 936 with e-value of 2.80E-77 and BLAST sequence identity of 76.5
MFTTKKKIQKDKDAEPTEFEETVAQALFDLENTSSELKTDLKDLFINSAVQIDVAGNRKAIVIYVPYRLRKAYRKIHLRLVRELEKKFSGKDVVLLATRRIVRPPKKGSAVQRPRSRTLTAVHEAMLEDLVYPAEIVGKRTRYRIDGSKISKIFLDPKERNNTEYKLESFAGVYRKLTGKDVVFDFPITEA

SEQ ID NO: 910 - DNA, 885 bp, Populus balsamifera subsp. trichocarpa
  misc_feature (1)..(885): Ceres ANNOT ID no. 1449267
  misc_feature 96746:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtctaagcgaatcctaaccgtccaaaaaatatgtaaccctaaatctttcttattaaacccacacttcatctcataccgtcgcttctcagcagcaccagcaccagcaccagcacgtcttcttcttctcgttgctgctttgcttaccatctgtttgctgcaaggcgctgaaaagtttggagttaggtctaccttttggtgggatatctatacaactttgtgggattcatcattcattgatgttttgttctccaactcctgtttagttatggaatgtaatctcttgctgttgctaagtagatctgtgaagatgtacactacaaagaagaagatccaaaaggacaaggatgctgaaccaactgagtttgaggagacagttgcccaggcattatttgacttggaaaataccagctcagacctgaaaagtgatctaaaagatctctttataaattctgcggttcaaatagatgttgctggaaaccgcaaagctattgtcatttatgttccctatagactgaggaaagcttatcgcaaggttcatcttcgccttgttagagagctggagaaaaagttcagtgggaaggatgttgttctgcttgctacccgaaggatcgtgcgtccaccaaagaaaggctctgctgttcagcgtccccgctcccgcaccctaactgctgtgcatgaggccatgcttgaggatttagtgtatcctgctgagattgttggaaaacgcaccagatacaggattgatggatccaaaattagcaagatcttcttggatcccaaggagcgcaacaacaccgagtacaagctagaatcatatgcgggagtttaccggaagcttacaggaaaagatgtggtttttgatttcccggtaacagaggcctga

SEQ ID NO: 911 - protein, 191 aa, Populus balsamifera subsp. trichocarpa
  misc_feature (1)..(191): Ceres ANNOT ID no. 1449267
  misc_feature (4)..(191): Pfam Name: Ribosomal_S7e Pfam Description: Ribosomal protein S7e
  misc_feature: SWISSPROT Homolog: RS7_BRAOL 40S ribosomal protein S7 with e-value of 8.5e-86 and BLAST sequence identity of 88.8
  misc_feature: SWISSPROT Homolog: RS7_AVIMR 40S ribosomal protein S7 with e-value of 1.4e-76 and BLAST sequence identity of 76.6
  misc_feature: SWISSPROT Homolog: RS7_ORYSA 40S ribosomal protein S7 with e-value of 1.5e-72 and BLAST sequence identity of 73.4
  misc_feature: SWISSPROT Homolog: RS7_SECCE 40S ribosomal protein S7 with e-value of 1.9e-72 and BLAST sequence identity of 73.4
  misc_feature: SWISSPROT Homolog: RS7_HORVU 40S ribosomal protein S7 with e-value of 4.0e-72 and BLAST sequence identity of 73.4
  misc_feature 96884:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(191): Functional Homolog of  Ceres CLONE ID no. 23518 at SEQ ID NO. 936 with e-value of 7.40E-77 and BLAST sequence identity of 76.0
MYTTKKKIQKDKDAEPTEFEETVAQALFDLENTSSDLKSDLKDLFINSAVQIDVAGNRKAIVIYVPYRLRKAYRKVHLRLVRELEKKFSGKDVVLLATRRIVRPPKKGSAVQRPRSRTLTAVHEAMLEDLVYPAEIVGKRTRYRIDGSKISKIFLDPKERNNTEYKLESYAGVYRKLTGKDVVFDFPVTEA

SEQ ID NO: 912 - DNA, 621 bp, Populus balsamifera subsp. trichocarpa
  misc_feature (1)..(621): Ceres ANNOT ID no. 1507191
  misc_feature 96995:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgttctcgactaagaagaagatccaaaaggacaaggatgctgaacccactgagtttgaggagacggttgcccaggcattatttgatttggaaaataccaactcagacctgaaaagtgatctaaaagatctctttataaattccgcagttcaaatagatgttgccggaaatcgcaaagctattgttatctatgttccctataggctgaggaaagcttaccgcaaggttcatcttcgccttgttcgagagcttgagaaaaagttcagtgggaagtggatggggaataaggacctgagcttgcaacctgaaaggctgcaggatgttgttctgcttgctacccgaaggattgtgcggccacccaaaaaagggtctgctgttcagcgtccccgctcccgtaccctaactgccgtgcatgaagccatgcttgaggatttagtgtatcctgctgagattgttggaaagcgcaccagatacaggattgatggatccaaaattagcaagatcttcttggatcccaaggagcgcaacaacaccgagtataaactggagtcatatgctggagtttacaggaagcttacagggaaagatgtggtttttgatttccctgtaacagaggcctga

SEQ ID NO: 913 - protein, 206 aa, Populus balsamifera subsp. trichocarpa
  misc_feature (1)..(206): Ceres ANNOT ID no. 1507191
  misc_feature (4)..(206): Pfam Name: Ribosomal_S7e Pfam Description: Ribosomal protein S7e
  misc_feature: SWISSPROT Homolog: RS7_BRAOL 40S ribosomal protein S7 with e-value of 8.5e-86 and BLAST sequence identity of 88.8
  misc_feature: SWISSPROT Homolog: RS7_AVIMR 40S ribosomal protein S7 with e-value of 1.4e-76 and BLAST sequence identity of 76.6
  misc_feature: SWISSPROT Homolog: RS7_ORYSA 40S ribosomal protein S7 with e-value of 1.5e-72 and BLAST sequence identity of 73.4
  misc_feature: SWISSPROT Homolog: RS7_SECCE 40S ribosomal protein S7 with e-value of 1.9e-72 and BLAST sequence identity of 73.4
  misc_feature: SWISSPROT Homolog: RS7_HORVU 40S ribosomal protein S7 with e-value of 4.0e-72 and BLAST sequence identity of 73.4
  misc_feature 97125:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(206): Functional Homolog of  Ceres CLONE ID no. 23518 at SEQ ID NO. 936 with e-value of 4.20E-74 and BLAST sequence identity of 77.6
MFSTKKKIQKDKDAEPTEFEETVAQALFDLENTNSDLKSDLKDLFINSAVQIDVAGNRKAIVIYVPYRLRKAYRKVHLRLVRELEKKFSGKWMGNKDLSLQPERLQDVVLLATRRIVRPPKKGSAVQRPRSRTLTAVHEAMLEDLVYPAEIVGKRTRYRIDGSKISKIFLDPKERNNTEYKLESYAGVYRKLTGKDVVFDFPVTEA

SEQ ID NO: 914 - protein, 166 aa, Arabidopsis thaliana
  misc_feature (1)..(166): Ceres CLONE ID no. 23523
  misc_feature (12)..(71): Pfam Name: Ribosomal_L11_N Pfam Description: Ribosomal protein L11, N-terminal domain
  misc_feature (76)..(144): Pfam Name: Ribosomal_L11 Pfam Description: Ribosomal protein L11, RNA binding domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MPPKLDPSQIVDVYVRVTGGEVGAASSLAPKIGPLGLAPKKIGEDIAKETAKEWKGLRVTVKLTVQNRQAKVTVVPSAAALVIKALKEPERDRKKVKNIKHNGNISFDDVTEIARIMRPRSIAKELSGTVREILGTCVSVGCTVDGKDPKDIQQEIQDGEVEIPEN

SEQ ID NO: 915 - DNA, 498 bp, Populus balsamifera subsp. trichocarpa
  misc_feature (1)..(498): Ceres ANNOT ID no. 1453919
  misc_feature 97348:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgccgccaaagtttgacccatctcaggttgtcgacgttttcgtcagggtgacgggcggtgaagttggtgcggccagttcacttgctcccaaaatcggaccgcttggtctttctcccaagaaaatcggtgaagacatcgccaaggagacagccaaggactggaagggcctccgtgtcaccgtcaagctcaccgtccagaaccgtcaagccaaggtcaccgtcgtgccctcagcagcggctttggttatcaaggcgttgaaggagccagagagagacagaaagaagacgaagaacataaagcataatgggaacatcgctcttgatgatgtgattgagattgcaaaggttatgagttcgagatcaatggctaaggatctgagtgggaccgtgaaggagattttggggacttgtgtttcagttgggtgtacggtcgatgggaaagatccaaaggatttgcagcaggagattactgatggtgatgttgtgatttctgaatga

SEQ ID NO: 916 - protein, 165 aa, Populus balsamifera subsp. trichocarpa
  misc_feature (1)..(165): Ceres ANNOT ID no. 1453919
  misc_feature (12)..(71): Pfam Name: Ribosomal_L11_N Pfam Description: Ribosomal protein L11, N-terminal domain
  misc_feature (76)..(144): Pfam Name: Ribosomal_L11 Pfam Description: Ribosomal protein L11, RNA binding domain
  misc_feature: SWISSPROT Homolog: RL12_ARATH 60S ribosomal protein L12 with e-value of 1.1e-83 and BLAST sequence identity of 100.0
  misc_feature: SWISSPROT Homolog: RL12_PRUAR 60S ribosomal protein L12 with e-value of 4.4e-73 and BLAST sequence identity of 87.2
  misc_feature: SWISSPROT Homolog: RL12_SCHPO 60S ribosomal protein L12 with e-value of 8.6e-61 and BLAST sequence identity of 69.7
  misc_feature: SWISSPROT Homolog: RL12_CHLRE 60S ribosomal protein L12 (Fragment) with e-value of 9.9e-60 and BLAST sequence identity of 74.4
  misc_feature: SWISSPROT Homolog: RL12_RAT 60S ribosomal protein L12 with e-value of 3.4e-59 and BLAST sequence identity of 70.1
  misc_feature 97481:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(165): Functional Homolog of  Ceres CLONE ID no. 23523 at SEQ ID NO. 943 with e-value of 6.90E-74 and BLAST sequence identity of 87.2
MPPKFDPSQVVDVFVRVTGGEVGAASSLAPKIGPLGLSPKKIGEDIAKETAKDWKGLRVTVKLTVQNRQAKVTVVPSAAALVIKALKEPERDRKKTKNIKHNGNIALDDVIEIAKVMSSRSMAKDLSGTVKEILGTCVSVGCTVDGKDPKDLQQEITDGDVVISE

SEQ ID NO: 917 - protein, 363 aa, Arabidopsis thaliana
  misc_feature (1)..(363): Ceres CLONE ID no. 23556
  misc_feature (33)..(343): Pfam Name: Lipase_GDSL Pfam Description: GDSL-like Lipase/Acylhydrolase
  misc_feature: Phenotype: INFLORESCENCE - Weak Useful for making stronger plants
MESYLTKWCVVLVLLCFGFSVVKAQAQAQVPCFFVFGDSLVDNGNNNGLISIARSNYFPYGIDFGGPTGRFSNGKTTVDVIAELLGFNGYIPAYNTVSGRQILSGVNYASAAAGIREETGRQLGQRISFSGQVRNYQTTVSQVVQLLGDETRAADYLKRCIYSVGLGSNDYLNNYFMPTFYSSSRQFTPEQYANDLISRYSTQLNALYNYGARKFALSGIGSVGCSPNALAGSPDGRTCVDRINSANQIFNNKLRSLVDQLNNNHPDAKFIYINAYGIFQDMITNPARFGFRVTNAGCCGIGRNAGQITCLPGQRPCRDRNAYVFWDAFHPTEAANVIIARRSYNAQSASDAYPMDISRLAQL

SEQ ID NO: 918 - DNA, 1098 bp, Populus balsamifera subsp. trichocarpa
  misc_feature (1)..(1098): Ceres ANNOT ID no. 1519418
  misc_feature 97686:<222: Transcription Factor
  misc_feature: Phenotype: INFLORESCENCE - Weak Useful for making stronger plants
atggaggcagtgcagaagaaatggtgggtggtgtgtgtggtttttttagtcttgctttcagtaaaatatggggctagagcgcaacaagttccttgctacttcattttcggggattctttggtcgataatggcaataataatcaactttcatctttggctaaagctaattatatgccttatgggattgacttccctcgtggacctaccggaaggttttccaatggtagaacaacagttgacgttattgctgaacaattgggtttccgcaactacattccaccttatgctacagcaaggggccgagatatactcgggggagtgaattatgcatcagcagcagctggaattagagaggaaacaggccgacaactgggagatcgaatcagttttagcggacaagtacgaaactaccaaaatactgtctcacaaattgtgaacatactgggtgataagaacacgacagcaaattatcttagcaagtgcatattatcgattgcactaggcagcaatgactaccttaacaattatttcatgcctcagctttactcatctagccagcaatatacaccagagcaatatgccaacgttcttatccaacaatatactcaacaattaaggattttgtacaacaatggagccaggaagtttgccttgattggactgggtcagattggctgcagcccaagtgaactggcccaaaatagtcctgatgggagaacatgtgttcagagaattaattctgccaaccagattttcaatgacaagctcagatctcttgttgctcaattcaacggaaatactcctgatgcaagatttatctacatcaatgcttatggaatttttcaggatttaataaccagacctgctgcttttggctttacgaacacaaacactggatgctgcggtgttggaaggaataatggacagattacatgtctacctttacaagctccttgccggaacagaaaccaatacgtgttttgggatgcgtttcacccgactgaggctgtaaacgtaattattggaaggagatcttacagtgcacaatcggcatccgatgcttacccttacgatatccgccagctggctcagcaatga

SEQ ID NO: 919 - protein, 365 aa, Populus balsamifera subsp. trichocarpa
  misc_feature (1)..(365): Ceres ANNOT ID no. 1519418
  misc_feature (33)..(345): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.0e-40 and BLAST sequence identity of 32.2
  misc_feature: SWISSPROT Homolog: APG_BRANA Anter-specific proline-rich protein APG (Protein CEX) (Fragment) with e-value of 1.5e-38 and BLAST sequence identity of 30.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 5.5e-27 and BLAST sequence identity of 28.9
  misc_feature: SWISSPROT Homolog: EST_HEVBR Esterase precursor (EC 3.1.1.-) Early nodule-specific protein homolog  (Latex allergen Hev b 13) with e-value of 3.1e-24 and BLAST sequence identity of 28.0
  misc_feature 97786:<222: Transcription Factor
  misc_feature: Phenotype: INFLORESCENCE - Weak Useful for making stronger plants
  misc_feature (1)..(365): Functional Homolog of  Ceres CLONE ID no. 23556 at SEQ ID NO. 946 with e-value of 3.89E-142 and BLAST sequence identity of 74.2
MEAVQKKWWVVCVVFLVLLSVKYGARAQQVPCYFIFGDSLVDNGNNNQLSSLAKANYMPYGIDFPRGPTGRFSNGRTTVDVIAEQLGFRNYIPPYATARGRDILGGVNYASAAAGIREETGRQLGDRISFSGQVRNYQNTVSQIVNILGDKNTTANYLSKCILSIALGSNDYLNNYFMPQLYSSSQQYTPEQYANVLIQQYTQQLRILYNNGARKFALIGLGQIGCSPSELAQNSPDGRTCVQRINSANQIFNDKLRSLVAQFNGNTPDARFIYINAYGIFQDLITRPAAFGFTNTNTGCCGVGRNNGQITCLPLQAPCRNRNQYVFWDAFHPTEAVNVIIGRRSYSAQSASDAYPYDIRQLAQQ

SEQ ID NO: 920 - DNA, 1104 bp, Populus balsamifera subsp. trichocarpa
  misc_feature (1)..(1104): Ceres ANNOT ID no. 1448924
  misc_feature 97888:<222: Transcription Factor
  misc_feature: Phenotype: INFLORESCENCE - Weak Useful for making stronger plants
atggagggggtgctaaagaaatgttgggtggtgggtgtgatttttgcagtagttttgctttcagaaccatatggggctagagcgcagcaagttcctggctactttattttcggggattcgttggtcgataatggcaataataatcagctttcatctttggctagagctgattatttgccttatgggattgacttccggcctccacgaccgaccggaaggttttgcaatggcagaacaacggttgatgtcattgctgagcaactgggcttccgcaactacattccaccttatgctacagcaaggggccgagctattctcggaggagtgaattatgcatctgctgctgccggaattagagatgaaaccggccaacaactcggagatcgaattagttttagtggtcaagtacgaaactaccagaatacggtctcacaaattgtgaacatacttggggacgaggacacagcagcaaattatctaagcaggtgcattttctcaattggactaggcagcaatgattaccttaacaattatttcatgcctcagatttactcatcaagccgccaatatactccggagcaatatgctaatgttcttatccaacaatatactgaccagttaaagattttgtacaactatggagccaggaagtttgtgttgattggagtgggtcagataggatgcagccccagtcaattggcccaaaatagtcctgatgggagaacttgtgttcagaaaattaattctgccaaccagattttcaataataagctcagatctcttgttgctcagttcaacggcaatactcctgatgcgagatttatctacatcaatgcttatgggatctttcaagatataataaacagacctgcaacttttggttttactgttacaaatgctggatgttgcggtgttgggaggaataatggccaaattacatgtctacctttacaaaatccatgccgaaatagggaccaatatgtgttttgggatgcatttcacccgactgaggcagcaaacgtaattattggaaggagatcttacagtgcacaatctgcatcggatgcatacccgttcgatattcgccggctggctcagtcctga

SEQ ID NO: 921 - protein, 367 aa, Populus balsamifera subsp. trichocarpa
  misc_feature (1)..(367): Ceres ANNOT ID no. 1448924
  misc_feature (34)..(347): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.0e-40 and BLAST sequence identity of 32.2
  misc_feature: SWISSPROT Homolog: APG_BRANA Anter-specific proline-rich protein APG (Protein CEX) (Fragment) with e-value of 1.5e-38 and BLAST sequence identity of 30.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 5.5e-27 and BLAST sequence identity of 28.9
  misc_feature: SWISSPROT Homolog: EST_HEVBR Esterase precursor (EC 3.1.1.-) Early nodule-specific protein homolog  (Latex allergen Hev b 13) with e-value of 3.1e-24 and BLAST sequence identity of 28.0
  misc_feature 97988:<222: Transcription Factor
  misc_feature: Phenotype: INFLORESCENCE - Weak Useful for making stronger plants
  misc_feature (1)..(367): Functional Homolog of  Ceres CLONE ID no. 23556 at SEQ ID NO. 946 with e-value of 7.40E-141 and BLAST sequence identity of 74.2
MEGVLKKCWVVGVIFAVVLLSEPYGARAQQVPGYFIFGDSLVDNGNNNQLSSLARADYLPYGIDFRPPRPTGRFCNGRTTVDVIAEQLGFRNYIPPYATARGRAILGGVNYASAAAGIRDETGQQLGDRISFSGQVRNYQNTVSQIVNILGDEDTAANYLSRCIFSIGLGSNDYLNNYFMPQIYSSSRQYTPEQYANVLIQQYTDQLKILYNYGARKFVLIGVGQIGCSPSQLAQNSPDGRTCVQKINSANQIFNNKLRSLVAQFNGNTPDARFIYINAYGIFQDIINRPATFGFTVTNAGCCGVGRNNGQITCLPLQNPCRNRDQYVFWDAFHPTEAANVIIGRRSYSAQSASDAYPFDIRRLAQS

SEQ ID NO: 922 - DNA, 1074 bp, Populus balsamifera subsp. trichocarpa
  misc_feature (1)..(1074): Ceres ANNOT ID no. 1482978
  misc_feature 98090:<222: Transcription Factor
  misc_feature: Phenotype: INFLORESCENCE - Weak Useful for making stronger plants
atggcagacaagatcaaagtatggtgcttcctacttttcctattgaggctggtgtcgaatttgcaaaattgtgctcatgccgctccacaggtgccttgttttttcatatttggagactcgttggcggatagtggcaacaacaacaaccttgtcacagctgctaaggccaattaccgcccatatggaattgacttcccaaatggaaccaccggaaggtttactaatggccgaaccgtagtggatatcattggtgaacttctgggctttaaccaatttattccaccatttgcaactgctagaggcagagacatattggttggtgttaactatgcatctggggcatcagggattcgtgatgagagtggaaggcaactgggtgatagaatcagcctaaatgagcaattgcaaaatcatgctgctacactcagtcgcttgactcaattactagggactaagcaggcagcagaaaattaccttaataagtgcttatattatgtcagcttgggcagtaatgactacttaaacaactacttcatgcctagcaattatacaacaagccgattatacacccctgatcaatatgccaaggttttaattgaccagtatagtcagcaaataaagcttctgtaccacctaggagccaggaaaattgccttgcctggacttcgaccaataggcagcattccatactcattttctactctatgccgcaacaatgtctcttgtgtgaccaatataaacaacgcagtcctcccttttaacgcaggacttgtatcacttgttgatcaactgaatagagagttgaatgacgcacgctttatatacctgaattctactgggatgtcatctggcgatccttctgtgctcgggtttagggttacaaacgttggatgttgtccagcacgtagtgatggccaatgcattcaagacccatgccaaaataggactgaatatgcgttttgggatgcaattcatcctaccgaagctttgaaccaattcactgcaagaagatcgtacaatgccattcttccatctgatgcttatccaaccgatatcagtcatttaatcagttaa

SEQ ID NO: 923 - protein, 357 aa, Populus balsamifera subsp. trichocarpa
  misc_feature (1)..(357): Ceres ANNOT ID no. 1482978
  misc_feature (34)..(338): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.0e-40 and BLAST sequence identity of 32.2
  misc_feature: SWISSPROT Homolog: APG_BRANA Anter-specific proline-rich protein APG (Protein CEX) (Fragment) with e-value of 1.5e-38 and BLAST sequence identity of 30.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 5.5e-27 and BLAST sequence identity of 28.9
  misc_feature: SWISSPROT Homolog: EST_HEVBR Esterase precursor (EC 3.1.1.-) Early nodule-specific protein homolog  (Latex allergen Hev b 13) with e-value of 3.1e-24 and BLAST sequence identity of 28.0
  misc_feature 98188:<222: Transcription Factor
  misc_feature: Phenotype: INFLORESCENCE - Weak Useful for making stronger plants
  misc_feature (1)..(357): Functional Homolog of  Ceres CLONE ID no. 23556 at SEQ ID NO. 946 with e-value of 7.00E-97 and BLAST sequence identity of 55.3
MADKIKVWCFLLFLLRLVSNLQNCAHAAPQVPCFFIFGDSLADSGNNNNLVTAAKANYRPYGIDFPNGTTGRFTNGRTVVDIIGELLGFNQFIPPFATARGRDILVGVNYASGASGIRDESGRQLGDRISLNEQLQNHAATLSRLTQLLGTKQAAENYLNKCLYYVSLGSNDYLNNYFMPSNYTTSRLYTPDQYAKVLIDQYSQQIKLLYHLGARKIALPGLRPIGSIPYSFSTLCRNNVSCVTNINNAVLPFNAGLVSLVDQLNRELNDARFIYLNSTGMSSGDPSVLGFRVTNVGCCPARSDGQCIQDPCQNRTEYAFWDAIHPTEALNQFTARRSYNAILPSDAYPTDISHLIS

SEQ ID NO: 924 - DNA, 1089 bp, Populus balsamifera subsp. trichocarpa
  misc_feature (1)..(1089): Ceres ANNOT ID no. 1448490
  misc_feature 98290:<222: Transcription Factor
  misc_feature: Phenotype: INFLORESCENCE - Weak Useful for making stronger plants
atggaaaatcagcctaagctgctatggtggatcttcttcaccattccattgctgatcatctcaaacttgcagaattgtgcttatggagaacctcaagtgccatgtttctttgtttttggggactcactctttgataatggaaacaacaacaatctttcgacgttggcaaaagccaattatactccttatgggattgactttagcaaagggcctaccgggaggtttagcaatggcaacaacacagccgatgtcattgctaagcttttgggatttgacgactatattccaaccttcaatgaagcaaaagctacaaaaaatatattaagaggtgtaaattacgcatctggatcagctgggattcgcaatgaaagtggacgattagcagtgggtgatgtgatatccctggatgagcagctacaaaatcaccgcatcataatttcactcatcactgaagcactgggaaataaagattcagccatgaagcacctaaacaagtgcatttataccattgacatgggcaacaatgactacacaatgaattacttccttccccagttatataacactagcaggcaattcagtgctcaccaatacgctacagtgctcattcaacaatattctcagcaattagagagcttatacgatcttggagcaaggaaggtggctgttgcgggactaattcaaaatggttgctcgcccaatgcactggcaacatatggtacgaatggctcttcatgtgtagaggtgatcaacaacgcagtacaaatcttcaatagcaagcttataccattagttacaaaccttaacgccaatcttcctggagctaaatttacttacataaatttttaccagattgatgccgaatcaactcgagctttcaggttcaccagagttgcttgttgcaacttgaccagtacaggattatgtgatccttctacaattccatgccctgataggactgagtatgcattctatgattcggcacatcctacagaggctagagctttgatcttgggaaggagagcatacagggctcagtcagtgactgatgcatttcctgttgatatcagtctcctggctcagctttaa

SEQ ID NO: 925 - protein, 362 aa, Populus balsamifera subsp. trichocarpa
  misc_feature (1)..(362): Ceres ANNOT ID no. 1448490
  misc_feature (36)..(342): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.0e-40 and BLAST sequence identity of 32.2
  misc_feature: SWISSPROT Homolog: APG_BRANA Anter-specific proline-rich protein APG (Protein CEX) (Fragment) with e-value of 1.5e-38 and BLAST sequence identity of 30.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 5.5e-27 and BLAST sequence identity of 28.9
  misc_feature: SWISSPROT Homolog: EST_HEVBR Esterase precursor (EC 3.1.1.-) Early nodule-specific protein homolog  (Latex allergen Hev b 13) with e-value of 3.1e-24 and BLAST sequence identity of 28.0
  misc_feature 98390:<222: Transcription Factor
  misc_feature: Phenotype: INFLORESCENCE - Weak Useful for making stronger plants
  misc_feature (1)..(362): Functional Homolog of  Ceres CLONE ID no. 23556 at SEQ ID NO. 946 with e-value of 1.39E-89 and BLAST sequence identity of 54.8
MENQPKLLWWIFFTIPLLIISNLQNCAYGEPQVPCFFVFGDSLFDNGNNNNLSTLAKANYTPYGIDFSKGPTGRFSNGNNTADVIAKLLGFDDYIPTFNEAKATKNILRGVNYASGSAGIRNESGRLAVGDVISLDEQLQNHRIIISLITEALGNKDSAMKHLNKCIYTIDMGNNDYTMNYFLPQLYNTSRQFSAHQYATVLIQQYSQQLESLYDLGARKVAVAGLIQNGCSPNALATYGTNGSSCVEVINNAVQIFNSKLIPLVTNLNANLPGAKFTYINFYQIDAESTRAFRFTRVACCNLTSTGLCDPSTIPCPDRTEYAFYDSAHPTEARALILGRRAYRAQSVTDAFPVDISLLAQL

SEQ ID NO: 926 - DNA, 1074 bp, Populus balsamifera subsp. trichocarpa
  misc_feature (1)..(1074): Ceres ANNOT ID no. 1477878
  misc_feature 98492:<222: Transcription Factor
  misc_feature: Phenotype: INFLORESCENCE - Weak Useful for making stronger plants
atggcgcctgctcttttgctaaaaccatcatgtttgatctttattttactaactgtagcatcaagcatgcaaccttatatcctcgtagctgcatcagttccttgttatttcatatttggcgattccttggttgatagtggcaataataatggactgtctacaagtgcaaaagtcaattatccaccttacgggattgattttcctgctggcccaacaggaaggttcactaatggaaaaaccgtagcagatataatcaccgagcttttgggtttgaaagattatattcaaccatttgccacagctacagcatcagaaataatcaatggtgtgaattatgcatctggctcctcaggaattcgtgatgaggctggacgtaatttgggtactcatgttggcttcaatcagcaattaaacaaccaccagattacaatatcaagcttgactaaaactctaaaagattcaactgcagctcaccttaatcaatgcctatatactgttggaatgggcagcaatgattatataaacgactactttctgcctggctccgcaacgagtactcagtatactcctgatcagtttgcaggtgttcttatcgatcaatattctaagcaaatcaggacgttgcacgatgctggagcaagaaagattgccttgtttggtttaggagcaattagctgcactccaaattcaattgttttatttggcaagaatggtacatgtgcagagagcattactggtgcagttcagctttttaatgtcaggctaaaatctcttgttgatcaactcaataaagaattaaccgattcgaaagttatttatatcaattcaattggaacgttaagaagaaatcctactaagcttggtttcaaggtcttcaaatctagctgctgtcaagttaacaatgctggtctctgtaatccaagctcaactgcatgtcctaatagaaacgagttcatattctgggatggtttccatcctacagaggctatgaataaacttacagcagcaagggcgttccacgctgctgacccttctgatgcttatccgtttggtatcagccagctagttctttag

SEQ ID NO: 927 - protein, 357 aa, Populus balsamifera subsp. trichocarpa
  misc_feature (1)..(357): Ceres ANNOT ID no. 1477878
  misc_feature (36)..(338): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.0e-40 and BLAST sequence identity of 32.2
  misc_feature: SWISSPROT Homolog: APG_BRANA Anter-specific proline-rich protein APG (Protein CEX) (Fragment) with e-value of 1.5e-38 and BLAST sequence identity of 30.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 5.5e-27 and BLAST sequence identity of 28.9
  misc_feature: SWISSPROT Homolog: EST_HEVBR Esterase precursor (EC 3.1.1.-) Early nodule-specific protein homolog  (Latex allergen Hev b 13) with e-value of 3.1e-24 and BLAST sequence identity of 28.0
  misc_feature 98590:<222: Transcription Factor
  misc_feature: Phenotype: INFLORESCENCE - Weak Useful for making stronger plants
  misc_feature (1)..(357): Functional Homolog of  Ceres CLONE ID no. 23556 at SEQ ID NO. 946 with e-value of 1.39E-89 and BLAST sequence identity of 49.5
MAPALLLKPSCLIFILLTVASSMQPYILVAASVPCYFIFGDSLVDSGNNNGLSTSAKVNYPPYGIDFPAGPTGRFTNGKTVADIITELLGLKDYIQPFATATASEIINGVNYASGSSGIRDEAGRNLGTHVGFNQQLNNHQITISSLTKTLKDSTAAHLNQCLYTVGMGSNDYINDYFLPGSATSTQYTPDQFAGVLIDQYSKQIRTLHDAGARKIALFGLGAISCTPNSIVLFGKNGTCAESITGAVQLFNVRLKSLVDQLNKELTDSKVIYINSIGTLRRNPTKLGFKVFKSSCCQVNNAGLCNPSSTACPNRNEFIFWDGFHPTEAMNKLTAARAFHAADPSDAYPFGISQLVL

SEQ ID NO: 928 - protein, 204 aa, Arabidopsis thaliana
  misc_feature (1)..(204): Ceres CLONE ID no. 23771
  misc_feature (2)..(193): Pfam Name: Ribosomal_L15e Pfam Description: Ribosomal L15
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
MGAYKYVSELWRKKQSDVMRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 929 - DNA, 615 bp, Populus balsamifera subsp. trichocarpa
  misc_feature (1)..(615): Ceres ANNOT ID no. 1444030
  misc_feature 98794:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atgggggcttacaagtatgtttcggagctatggaggaagaagcaatcggatgttatgaggttcttgcagagggtgaggtgctgggaataccgtcaacatccttcgattgtgcgtgtcactcatcctactcgtcctgacaaggctcgccgtttgggatacaaggcaaaacaggggtatgttgtctatcgaatccgtgtgaggcgtggtggtaggaagaggcctgttccgaagggtattgtttatggcaagccaacaaaccagggtgttacccagctcaagttccagcgtagcaagaggtcagttgctgaagagcgtgcggggcggaaattaggtgggctcaaagttctcaactcatactggattaatgaggattccacgtacaaatattttgaggttatcctggtcgatgctgctcacaatgccattcgcaatgatccaaggatcaattggatctgcaatcctgtccataaacacagagagctacgtggtctaacatctgctggaaagaagtacaggggtctccgaggaaggggacacttgcatcacaaggcacggccttccaggagggcaacgtggaaaaggaaccaaactctttccctccgtcggtatcggtga

SEQ ID NO: 930 - protein, 204 aa, Populus balsamifera subsp. trichocarpa
  misc_feature (1)..(204): Ceres ANNOT ID no. 1444030
  misc_feature (2)..(193): Pfam Name: Ribosomal_L15e Pfam Description: Ribosomal L15
  misc_feature: SWISSPROT Homolog: RL15_ARATH 60S ribosomal protein L15 with e-value of 4.0e-111 and BLAST sequence identity of 100.0
  misc_feature: SWISSPROT Homolog: RL15_PETHY 60S ribosomal protein L15 with e-value of 5.0e-97 and BLAST sequence identity of 86.8
  misc_feature: SWISSPROT Homolog: RL15B_PICMA 60S ribosomal protein L15-2 with e-value of 8.1e-97 and BLAST sequence identity of 84.8
  misc_feature: SWISSPROT Homolog: RL15A_PICMA 60S ribosomal protein L15-1 with e-value of 1.7e-96 and BLAST sequence identity of 85.3
  misc_feature: SWISSPROT Homolog: RL15B_YEAST 60S ribosomal protein L15-B (YL10) (L13) (RP15R) (YP18) with e-value of 1.5e-79 and BLAST sequence identity of 71.9
  misc_feature 98918:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(204): Functional Homolog of  Ceres CLONE ID no. 23771 at SEQ ID NO. 957 with e-value of 3.19E-101 and BLAST sequence identity of 89.2
MGAYKYVSELWRKKQSDVMRFLQRVRCWEYRQHPSIVRVTHPTRPDKARRLGYKAKQGYVVYRIRVRRGGRKRPVPKGIVYGKPTNQGVTQLKFQRSKRSVAEERAGRKLGGLKVLNSYWINEDSTYKYFEVILVDAAHNAIRNDPRINWICNPVHKHRELRGLTSAGKKYRGLRGRGHLHHKARPSRRATWKRNQTLSLRRYR

SEQ ID NO: 931 - DNA, 681 bp, Populus balsamifera subsp. trichocarpa
  misc_feature (1)..(681): Ceres ANNOT ID no. 1486813
  misc_feature 99025:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atgcgtgtttgcaccaaggccattacaggcagtacgataccatggagaggcctgtccatttttacaaagggggcttacaagtacgtatctgagctatggaggaagaaacaatcggatgtgatgaggtttttgcaaagggttaggtgctgggagtaccgtcagcatccttcaattgttcgtgtcacgcaccccacacgccctgacaaggctcgccggttgggctataaggccaagcagggctacgtggtttatcgtgtccgtgttaggcggggtgggaggaagaggcctgttccgaagggtattgtatatggtaagcccacaaaccagggtgttactcaactgaagtttcaacgaagcaagaggtctgtagcagaggagcgtgctggtcggaaattggggggcctcagggttctcaattcatactggattaatgaggattctacttacaagtactttgaggtaatcttggttgatgttgcccacaatgccatccgcaatgacccaagaatcaactggctctgcaatcctgtccacaagcacagggagctccgtggccttacctctgctgggaagaaatacaggggtctacgtggcaggggacacttgcaccacaaagctcgaccctctcgccgggcaaactggaagagaaacaacaccctctcccttcgtcgttaccgatga

SEQ ID NO: 932 - protein, 226 aa, Populus balsamifera subsp. trichocarpa
  misc_feature (1)..(226): Ceres ANNOT ID no. 1486813
  misc_feature (24)..(215): Pfam Name: Ribosomal_L15e Pfam Description: Ribosomal L15
  misc_feature: SWISSPROT Homolog: RL15_ARATH 60S ribosomal protein L15 with e-value of 4.0e-111 and BLAST sequence identity of 100.0
  misc_feature: SWISSPROT Homolog: RL15_PETHY 60S ribosomal protein L15 with e-value of 5.0e-97 and BLAST sequence identity of 86.8
  misc_feature: SWISSPROT Homolog: RL15B_PICMA 60S ribosomal protein L15-2 with e-value of 8.1e-97 and BLAST sequence identity of 84.8
  misc_feature: SWISSPROT Homolog: RL15A_PICMA 60S ribosomal protein L15-1 with e-value of 1.7e-96 and BLAST sequence identity of 85.3
  misc_feature: SWISSPROT Homolog: RL15B_YEAST 60S ribosomal protein L15-B (YL10) (L13) (RP15R) (YP18) with e-value of 1.5e-79 and BLAST sequence identity of 71.9
  misc_feature 99151:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(226): Functional Homolog of  Ceres CLONE ID no. 23771 at SEQ ID NO. 957 with e-value of 6.60E-101 and BLAST sequence identity of 89.6
MRVCTKAITGSTIPWRGLSIFTKGAYKYVSELWRKKQSDVMRFLQRVRCWEYRQHPSIVRVTHPTRPDKARRLGYKAKQGYVVYRVRVRRGGRKRPVPKGIVYGKPTNQGVTQLKFQRSKRSVAEERAGRKLGGLRVLNSYWINEDSTYKYFEVILVDVAHNAIRNDPRINWLCNPVHKHRELRGLTSAGKKYRGLRGRGHLHHKARPSRRANWKRNNTLSLRRYR

SEQ ID NO: 933 - DNA, 717 bp, Populus balsamifera subsp. trichocarpa
  misc_feature (1)..(717): Ceres ANNOT ID no. 1485303
  misc_feature 99264:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atggcaatgaaaaacaaaaatcttgcaacttttggaggcgcttacaagtacgtgtctgagctatggaggaagaagcaatcagatgtgatgaggttcttgcaaagggttaggtgctgggagtaccgccagcatccttctattgttcgtgtcacgcaccccactcgccctgacaaggctcgccgcttgggctataaggccaagcagttactggcttttgtgttttatgatggatatggaactaagtttagaggtatgtttgttttggatgatgacggctacgtggtttatcgtatccgtgtcaggcggggtggtaggaagaggcccgttcccaagggtattgtatatggtaagccaacaaaccagggtgttactcaactgaagtttcaacgaagcaagaggtctgtggcagaggagcgtgctggccggaaattggggggcctcagggttcttaattcatactggattaacgaggattctacttacaagtactttgaggtaatcttggttgatgttgcccacaatgccatccgcaatgacccaagaatcaactggctctgcaatcctgtacacaagcacagggagcttcgtggccttacctccgctgggaagaaatacaggggtctacgtggcaggggacacctgcaccacaaagctcgaccttcacgcagggcaaactggaagagaaacaacacactctcccttcgtcgttaccgttga

SEQ ID NO: 934 - protein, 238 aa, Populus balsamifera subsp. trichocarpa
  misc_feature (1)..(238): Ceres ANNOT ID no. 1485303
  misc_feature (13)..(68): Pfam Name: Ribosomal_L15e Pfam Description: Ribosomal L15
  misc_feature: SWISSPROT Homolog: RL15_ARATH 60S ribosomal protein L15 with e-value of 4.0e-111 and BLAST sequence identity of 100.0
  misc_feature: SWISSPROT Homolog: RL15_PETHY 60S ribosomal protein L15 with e-value of 5.0e-97 and BLAST sequence identity of 86.8
  misc_feature: SWISSPROT Homolog: RL15B_PICMA 60S ribosomal protein L15-2 with e-value of 8.1e-97 and BLAST sequence identity of 84.8
  misc_feature: SWISSPROT Homolog: RL15A_PICMA 60S ribosomal protein L15-1 with e-value of 1.7e-96 and BLAST sequence identity of 85.3
  misc_feature: SWISSPROT Homolog: RL15B_YEAST 60S ribosomal protein L15-B (YL10) (L13) (RP15R) (YP18) with e-value of 1.5e-79 and BLAST sequence identity of 71.9
  misc_feature 99390:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(238): Functional Homolog of  Ceres CLONE ID no. 23771 at SEQ ID NO. 957 with e-value of 3.49E-95 and BLAST sequence identity of 89.1
MAMKNKNLATFGGAYKYVSELWRKKQSDVMRFLQRVRCWEYRQHPSIVRVTHPTRPDKARRLGYKAKQLLAFVFYDGYGTKFRGMFVLDDDGYVVYRIRVRRGGRKRPVPKGIVYGKPTNQGVTQLKFQRSKRSVAEERAGRKLGGLRVLNSYWINEDSTYKYFEVILVDVAHNAIRNDPRINWLCNPVHKHRELRGLTSAGKKYRGLRGRGHLHHKARPSRRANWKRNNTLSLRRYR

SEQ ID NO: 935 - DNA, 714 bp, Populus balsamifera subsp. trichocarpa
  misc_feature (1)..(714): Ceres ANNOT ID no. 1446796
  misc_feature 99503:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atggggatgaaagcaagattttcgaagggggcttacaagtacgtttctgagctatggaggaagaaacaatcagatgtgatgaggtttttgcaaagggttaggtgttgggagtaccgccaacatccttcaattgttcgtgtcacgcaccccacacgccctgacaaggctcgccgcttgggctataaggccaagcagggatatgttgtttatcgtatacgtgttaggcgaggtggtaggaagaggcctgttcccaagggtatcgtatatggtaagcccacaaaccagggtgttactcaactcaagtttcaacgtagcaagaggtctgtggcagaggagcgtgctggccggaaattggggggcctcagggttctcaattcatactggattaatgagcctggctacctaagaatcgtaccttcttactgttattcatttacttgcattagtaatgcattttcttcaacgcaggactctacttataagtactttgaggtaatcttggttgatgttgcccacaatgcaatccggaatgacccaagaatcaactggctctgcaaccctgtgcacaagcatagggagctccgtggccttacctctgccgggaagaaatacaggggtctacgcggcaggggacacttgcaccacaaagctcgaccttctcggcgggcaaactggaagagaaacaacaccctctcccttcgtcgataccgctga

SEQ ID NO: 936 - protein, 235 aa, Populus balsamifera subsp. trichocarpa
  misc_feature (1)..(235): Ceres ANNOT ID no. 1446796
  misc_feature (8)..(129): Pfam Name: Ribosomal_L15e Pfam Description: Ribosomal L15
  misc_feature: SWISSPROT Homolog: RL15_ARATH 60S ribosomal protein L15 with e-value of 4.0e-111 and BLAST sequence identity of 100.0
  misc_feature: SWISSPROT Homolog: RL15_PETHY 60S ribosomal protein L15 with e-value of 5.0e-97 and BLAST sequence identity of 86.8
  misc_feature: SWISSPROT Homolog: RL15B_PICMA 60S ribosomal protein L15-2 with e-value of 8.1e-97 and BLAST sequence identity of 84.8
  misc_feature: SWISSPROT Homolog: RL15A_PICMA 60S ribosomal protein L15-1 with e-value of 1.7e-96 and BLAST sequence identity of 85.3
  misc_feature: SWISSPROT Homolog: RL15B_YEAST 60S ribosomal protein L15-B (YL10) (L13) (RP15R) (YP18) with e-value of 1.5e-79 and BLAST sequence identity of 71.9
  misc_feature 99629:<222: Transcription Factor
  misc_feature: Phenotype: ROSETTE LEAVES - Disorganized Rosette Useful for making plants with increased biomass
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(235): Functional Homolog of  Ceres CLONE ID no. 23771 at SEQ ID NO. 957 with e-value of 9.20E-95 and BLAST sequence identity of 89.1
MKARFSKGAYKYVSELWRKKQSDVMRFLQRVRCWEYRQHPSIVRVTHPTRPDKARRLGYKAKQGYVVYRIRVRRGGRKRPVPKGIVYGKPTNQGVTQLKFQRSKRSVAEERAGRKLGGLRVLNSYWINEPGYLRIVPSYCYSFTCISNAFSSTQDSTYKYFEVILVDVAHNAIRNDPRINWLCNPVHKHRELRGLTSAGKKYRGLRGRGHLHHKARPSRRANWKRNNTLSLRRYR

SEQ ID NO: 937 - protein, 199 aa, Arabidopsis thaliana
  misc_feature (1)..(199): Ceres CLONE ID no. 24266
  misc_feature (1)..(182): Pfam Name: Proteasome Pfam Description: Proteasome A-type and B-type
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
MECVFGLVGNGFAIVAADTSAVHSILLHKNKEDKIMTLDSHKLVAASGEPGDRVQFTEYVQKNVSLYQFRNGIPLSTAAAANFTRGELATALRKNPYSVNILMAGYDKEAGASLYYIDYIATLHKVDKGAFGYGSYFSLSTMDRHYRSDMSVEEAIELVDKCILEIRSRLVIAPPNFVIKIVDKDGAREYGWRISTADA

SEQ ID NO: 938 - DNA, 630 bp, Populus balsamifera subsp. trichocarpa
  misc_feature (1)..(630): Ceres ANNOT ID no. 1463475
  misc_feature 99825:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
atggagtgcgtatttggactggtaggtgacggttttgtgatcgtagcatcagacacatctgccgttaacagcatcttggttcataaaactaacgaagacaagattatgaaactcgactctcacaagctagttgccgctagcggcgagtcaggcgaccgagttcaattcacggagtatatacagaagaacgtggctttgtatcagtttcgtaatgggattcctttgaccactgcagctgctgctaactttactcgtggagagctcgctactgctttgagaaagaacccttacatggtaaacatcctgctggctggctatgacaaagagacaggtccctctctatactacattgactacatcgctacccttcacaaggttgacaggggagcatttggttacgggtcttatttttgtctctccatgatggacagacactaccacagtggcatgtcagtggaagaagcagttgaactggtcgataaatgtataacggagattcaatccaggttggttgtggcaccgccaaactttgtgatcaagattgttgatagggatggagcaagggagtatgcctggcgtgaatctgtcaaggacaccccaacagcccaacctgaggctttgggagtttaa

SEQ ID NO: 939 - protein, 209 aa, Populus balsamifera subsp. trichocarpa
  misc_feature (1)..(209): Ceres ANNOT ID no. 1463475
  misc_feature (1)..(182): Pfam Name: Proteasome Pfam Description: Proteasome A-type and B-type
  misc_feature: SWISSPROT Homolog: PSB2B_ARATH Proteasome subunit beta type 2-B with e-value of 7.4e-103 and BLAST sequence identity of 100.0
  misc_feature: SWISSPROT Homolog: PSB2B_ARATH EC 3.4.25.1 (Proteasome subunit beta type 4) 20S proteasome beta subunit D-2 Proteasome component GA
  misc_feature: SWISSPROT Homolog: PSB2A_ARATH Proteasome subunit beta type 2-A with e-value of 8.1e-97 and BLAST sequence identity of 93.9
  misc_feature: SWISSPROT Homolog: PSB2A_ARATH EC 3.4.25.1 (Proteasome subunit beta type 4) (20S proteasome beta subunit D-1) (Proteasome component GB)
  misc_feature: SWISSPROT Homolog: PSB2_ORYSA Proteasome subunit beta type 2 (EC 3.4.25.1) (20S proteasome alpha subunit D) (20S proteasome subunit beta-4) with e-value of 4.0e-79 and BLAST sequence identity of 76.5
  misc_feature: SWISSPROT Homolog: PSB2_MOUSE Proteasome subunit beta type 2 with e-value of 1.1e-42 and BLAST sequence identity of 46.0
  misc_feature: SWISSPROT Homolog: PSB2_MOUSE EC 3.4.25.1 (Proteasome component C7-I) Macropain subunit C7-I Multicatalytic endopeptidase complex subunit C7-I
  misc_feature: SWISSPROT Homolog: PSB2_RAT Proteasome subunit beta type 2 with e-value of 1.1e-42 and BLAST sequence identity of 46.0
  misc_feature: SWISSPROT Homolog: PSB2_RAT EC 3.4.25.1 (Proteasome component C7-I) Macropain subunit C7-I Multicatalytic endopeptidase complex subunit C7-I
  misc_feature 99963:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
  misc_feature (1)..(209): Functional Homolog of  Ceres CLONE ID no. 24266 at SEQ ID NO. 973 with e-value of 2.69E-88 and BLAST sequence identity of 84.8
MECVFGLVGDGFVIVASDTSAVNSILVHKTNEDKIMKLDSHKLVAASGESGDRVQFTEYIQKNVALYQFRNGIPLTTAAAANFTRGELATALRKNPYMVNILLAGYDKETGPSLYYIDYIATLHKVDRGAFGYGSYFCLSMMDRHYHSGMSVEEAVELVDKCITEIQSRLVVAPPNFVIKIVDRDGAREYAWRESVKDTPTAQPEALGV

SEQ ID NO: 940 - DNA, 630 bp, Populus balsamifera subsp. trichocarpa
  misc_feature (1)..(630): Ceres ANNOT ID no. 1540920
  misc_feature 100052:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
atggagtgcgtattcggacttgtgggtaatgatttcgtaatcgtagtagcagacacatctgccgttaacagcatcttggtccataaaaccaacgaagacaagattatgaaactcgactctcacaagctcatcgctgctagcggtgagtccggtgaccgagttcaattcacggagtatattcagaagaacgtggctttgtatcatttccgtaatgggattcccttgaccaccgcagctgctgctaattttacccgtggagagctcgctactgctttgagaaagaacccttacatggtaaacatcctactggctggctttgacagagagacaggcccctctctatactacatcgactatattgctacccttcacaaggttgacaagggagcatttggttacgggtcctttttttgtctctccatgatggacagacactaccacagtggcatgtcagtggaagaggcagttgaattggttgataaatgcataatggagattcgatccaggttggttgtggcgccaccgaactttgtgatcaagattgttgacagggatggagcaagagagtatgcctggcgtgaatctgtcaaggataccccaacagcccagtccgagggtttggcagtataa

SEQ ID NO: 941 - protein, 209 aa, Populus balsamifera subsp. trichocarpa
  misc_feature (1)..(209): Ceres ANNOT ID no. 1540920
  misc_feature (1)..(182): Pfam Name: Proteasome Pfam Description: Proteasome A-type and B-type
  misc_feature: SWISSPROT Homolog: PSB2B_ARATH Proteasome subunit beta type 2-B with e-value of 7.4e-103 and BLAST sequence identity of 100.0
  misc_feature: SWISSPROT Homolog: PSB2B_ARATH EC 3.4.25.1 (Proteasome subunit beta type 4) 20S proteasome beta subunit D-2 Proteasome component GA
  misc_feature: SWISSPROT Homolog: PSB2A_ARATH Proteasome subunit beta type 2-A with e-value of 8.1e-97 and BLAST sequence identity of 93.9
  misc_feature: SWISSPROT Homolog: PSB2A_ARATH EC 3.4.25.1 (Proteasome subunit beta type 4) (20S proteasome beta subunit D-1) (Proteasome component GB)
  misc_feature: SWISSPROT Homolog: PSB2_ORYSA Proteasome subunit beta type 2 (EC 3.4.25.1) (20S proteasome alpha subunit D) (20S proteasome subunit beta-4) with e-value of 4.0e-79 and BLAST sequence identity of 76.5
  misc_feature: SWISSPROT Homolog: PSB2_MOUSE Proteasome subunit beta type 2 with e-value of 1.1e-42 and BLAST sequence identity of 46.0
  misc_feature: SWISSPROT Homolog: PSB2_MOUSE EC 3.4.25.1 (Proteasome component C7-I) Macropain subunit C7-I Multicatalytic endopeptidase complex subunit C7-I
  misc_feature: SWISSPROT Homolog: PSB2_RAT Proteasome subunit beta type 2 with e-value of 1.1e-42 and BLAST sequence identity of 46.0
  misc_feature: SWISSPROT Homolog: PSB2_RAT EC 3.4.25.1 (Proteasome component C7-I) Macropain subunit C7-I Multicatalytic endopeptidase complex subunit C7-I
  misc_feature 100190:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
  misc_feature (1)..(209): Functional Homolog of  Ceres CLONE ID no. 24266 at SEQ ID NO. 973 with e-value of 3.09E-87 and BLAST sequence identity of 83.3
MECVFGLVGNDFVIVVADTSAVNSILVHKTNEDKIMKLDSHKLIAASGESGDRVQFTEYIQKNVALYHFRNGIPLTTAAAANFTRGELATALRKNPYMVNILLAGFDRETGPSLYYIDYIATLHKVDKGAFGYGSFFCLSMMDRHYHSGMSVEEAVELVDKCIMEIRSRLVVAPPNFVIKIVDRDGAREYAWRESVKDTPTAQSEGLAV

SEQ ID NO: 942 - DNA, 684 bp, Populus balsamifera subsp. trichocarpa
  misc_feature (1)..(684): Ceres ANNOT ID no. 1487528
  misc_feature 100279:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
atggagtgcgtattcggacttgtgggtaatgatttcgtaatcgtagtagcagacacatctgccgttaacagcatcttggtccataaaaccaacgaagacaagattatgaaactcgactctcacaagctcatcgctgctagcggtgagtccggtgaccgagttcaattcacggagtatattcagaagaacgtggctttgtatcatttccgtaatgggattcccttgaccaccgcagctgctgctaattttacccgtggagagctcgctactgctttgagaaagatggatagagagcacgtgatgtcttttggtttttgtgatttgtggtcatgcaagaacccttacatggtaaacatcctactggctggctttgacagagagacaggcccctctctatactacatcgactatattgctacccttcacaaggttgacaagggagcatttggttacgggtcctttttttgtctctccatgatggacagacactaccacagtggcatgtcagtggaagaggcagttgaattggttgataaatgcataatggagattcgatccaggttggttgtggcgccaccgaactttgtgatcaagattgttgacagggatggagcaagagagtatgcctggcgtgaatctgtcaaggataccccaacagcccagtccgagggtttggcagtataa

SEQ ID NO: 943 - protein, 227 aa, Populus balsamifera subsp. trichocarpa
  misc_feature (1)..(227): Ceres ANNOT ID no. 1487528
  misc_feature (1)..(200): Pfam Name: Proteasome Pfam Description: Proteasome A-type and B-type
  misc_feature: SWISSPROT Homolog: PSB2B_ARATH Proteasome subunit beta type 2-B with e-value of 7.4e-103 and BLAST sequence identity of 100.0
  misc_feature: SWISSPROT Homolog: PSB2B_ARATH EC 3.4.25.1 (Proteasome subunit beta type 4) 20S proteasome beta subunit D-2 Proteasome component GA
  misc_feature: SWISSPROT Homolog: PSB2A_ARATH Proteasome subunit beta type 2-A with e-value of 8.1e-97 and BLAST sequence identity of 93.9
  misc_feature: SWISSPROT Homolog: PSB2A_ARATH EC 3.4.25.1 (Proteasome subunit beta type 4) (20S proteasome beta subunit D-1) (Proteasome component GB)
  misc_feature: SWISSPROT Homolog: PSB2_ORYSA Proteasome subunit beta type 2 (EC 3.4.25.1) (20S proteasome alpha subunit D) (20S proteasome subunit beta-4) with e-value of 4.0e-79 and BLAST sequence identity of 76.5
  misc_feature: SWISSPROT Homolog: PSB2_MOUSE Proteasome subunit beta type 2 with e-value of 1.1e-42 and BLAST sequence identity of 46.0
  misc_feature: SWISSPROT Homolog: PSB2_MOUSE EC 3.4.25.1 (Proteasome component C7-I) Macropain subunit C7-I Multicatalytic endopeptidase complex subunit C7-I
  misc_feature: SWISSPROT Homolog: PSB2_RAT Proteasome subunit beta type 2 with e-value of 1.1e-42 and BLAST sequence identity of 46.0
  misc_feature: SWISSPROT Homolog: PSB2_RAT EC 3.4.25.1 (Proteasome component C7-I) Macropain subunit C7-I Multicatalytic endopeptidase complex subunit C7-I
  misc_feature 100419:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Other Useful for making bigger plants
  misc_feature (1)..(227): Functional Homolog of  Ceres CLONE ID no. 24266 at SEQ ID NO. 973 with e-value of 1.10E-82 and BLAST sequence identity of 83.3
MECVFGLVGNDFVIVVADTSAVNSILVHKTNEDKIMKLDSHKLIAASGESGDRVQFTEYIQKNVALYHFRNGIPLTTAAAANFTRGELATALRKMDREHVMSFGFCDLWSCKNPYMVNILLAGFDRETGPSLYYIDYIATLHKVDKGAFGYGSFFCLSMMDRHYHSGMSVEEAVELVDKCIMEIRSRLVVAPPNFVIKIVDRDGAREYAWRESVKDTPTAQSEGLAV

SEQ ID NO: 944 - protein, 264 aa, Arabidopsis thaliana
  misc_feature (1)..(264): Ceres CLONE ID no. 24644
  misc_feature (143)..(193): Pfam Name: HLH Pfam Description: Helix-loop-helix DNA-binding domain
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: HYPOCOTYL - Long Useful for making taller plants
MDPSGMMNEGGPFNLAEIWQFPLNGVSTAGDSSRRSFVGPNQFGDADLTTSANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEFGQQAFENPEIQFGSQSTREYSRGASPEWLHMQIGSGGFERTS

SEQ ID NO: 945 - DNA, 741 bp, Populus balsamifera subsp. trichocarpa
  misc_feature (1)..(741): Ceres ANNOT ID no. 1463301
  misc_feature 100604:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: HYPOCOTYL - Long Useful for making taller plants
atggatccgcctgcaaggatgaatgaaggagggccttacagtttggaggagatctggcaatttcccattaacgggagcggaagagggcactttgatttacttaatttggagcagagagcagctgcttctgtcaggaaacgtcgcgatgttgatttggatgttgatgatgattcttcttcaaaacccactaccaacggacttctgcattgtgatggtaagcggcttaaaacatcagggagtaaagatgaggatcaccatcgtcatcatgattctaaagatgaagcagaacccagttcaggcaagcatgtggaacacaaaactcaaccaccagagccatcaaaacaagattatatccacgtacgagcaagaaggggtcaagctactgatagccacagtctagctgaaagagctaggagagaaaagataagcgaaaggatgaaaattcttcaggatctagtcccaggctgtaacaaggttattggcaaggccctggtccttgacgagattatcaattacatccaatcattacaacgtcaggttgagtttctatcaatgaagcttgaagcagtgaatacgagaatgaaccctggaattgaagtctttgcttctaaagattttggacaaacttttgacactgctggcatggcatttggttctcaagccacgagggaatacagtcgtggtacatcaccagaatggttgcatatgcaggttggtggtggtttcgaaagaacgtcataa

SEQ ID NO: 946 - protein, 246 aa, Populus balsamifera subsp. trichocarpa
  misc_feature (1)..(246): Ceres ANNOT ID no. 1463301
  misc_feature (127)..(177): Pfam Name: HLH Pfam Description: Helix-loop-helix DNA-binding domain
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 2.2e-18 and BLAST sequence identity of 32.2
  misc_feature: SWISSPROT Homolog: SPT_ARATH Protein SPATULA with e-value of 2.8e-12 and BLAST sequence identity of 30.9
  misc_feature: SWISSPROT Homolog: PIF4_ARATH Phytochrome-interacting factor 4(Basic helix-loop-helix protein 9) (bHLH9) (AtbHLH009) (Short under red-light 2) with e-value of 5.5e-12 and BLAST sequence identity of 29.4
  misc_feature: SWISSPROT Homolog: BIM1_ARATH Transcription factor BIM1 (BES1-interacting Myc-like protein 1) (Transcription factor EN 126) (AtbHLH 46) with e-value of 5.2e-06 and BLAST sequence identity of 24.6
  misc_feature 100706:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: HYPOCOTYL - Long Useful for making taller plants
  misc_feature (1)..(246): Functional Homolog of  Ceres CLONE ID no. 24644 at SEQ ID NO. 980 with e-value of 1.09E-68 and BLAST sequence identity of 65.5
MDPPARMNEGGPYSLEEIWQFPINGSGRGHFDLLNLEQRAAASVRKRRDVDLDVDDDSSSKPTTNGLLHCDGKRLKTSGSKDEDHHRHHDSKDEAEPSSGKHVEHKTQPPEPSKQDYIHVRARRGQATDSHSLAERARREKISERMKILQDLVPGCNKVIGKALVLDEIINYIQSLQRQVEFLSMKLEAVNTRMNPGIEVFASKDFGQTFDTAGMAFGSQATREYSRGTSPEWLHMQVGGGFERTS

SEQ ID NO: 947 - DNA, 786 bp, Populus balsamifera subsp. trichocarpa
  misc_feature (1)..(786): Ceres ANNOT ID no. 1459811
  misc_feature 100801:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: HYPOCOTYL - Long Useful for making taller plants
atggatccgcctgcaatgatgaacgaagggggcccctacactttagaggagatctggcaatttcccatcaatggtagcggaagagggcagtttgaattacttaatttggagcggagagcagcagcttctgccaggaaacgccgcgaggttgatttggatgttgatgattcttcttcttcaaagcctacaactctctctcctaccaatgccaataccaacaccaacggacttctgaatgattgtgatggtaagcggcttaaagcatgggggagtagagatgacaatcatcatcatcaacaacaacaacaacagcagcagcatgattctagaagtgaagcagaacccagttcaggcaagcttgtggaacacaaacctcaaccaccagaaccgcccaaacaagattatatccacgtacgagcaagaaggggtcaagctactgatagccatagtctagctgaaagagctaggagagaaaagataagcgaaaggatgaaaattcttcaggatatcgtcccaggttgtaacaaggttaccggcaaggccctggtccttgacgagattatcaattacatccaatcattacaacgtcaggttgagtttctatcaatgaagcttgaagcagttaatttgaatatgaaccctgaaactgaagtctttccttctaaagattgctcagcatttccgcggttgttttatgctctattgttacacatggtggtttatttcaaaccaccaagaggaagagggcatccagagtccctcagtcatcctttaccatgtagatga

SEQ ID NO: 948 - protein, 261 aa, Populus balsamifera subsp. trichocarpa
  misc_feature (1)..(261): Ceres ANNOT ID no. 1459811
  misc_feature (145)..(195): Pfam Name: HLH Pfam Description: Helix-loop-helix DNA-binding domain
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 2.2e-18 and BLAST sequence identity of 32.2
  misc_feature: SWISSPROT Homolog: SPT_ARATH Protein SPATULA with e-value of 2.8e-12 and BLAST sequence identity of 30.9
  misc_feature: SWISSPROT Homolog: PIF4_ARATH Phytochrome-interacting factor 4(Basic helix-loop-helix protein 9) (bHLH9) (AtbHLH009) (Short under red-light 2) with e-value of 5.5e-12 and BLAST sequence identity of 29.4
  misc_feature: SWISSPROT Homolog: BIM1_ARATH Transcription factor BIM1 (BES1-interacting Myc-like protein 1) (Transcription factor EN 126) (AtbHLH 46) with e-value of 5.2e-06 and BLAST sequence identity of 24.6
  misc_feature 100905:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: HYPOCOTYL - Long Useful for making taller plants
  misc_feature (1)..(261): Functional Homolog of  Ceres CLONE ID no. 24644 at SEQ ID NO. 980 with e-value of 4.70E-52 and BLAST sequence identity of 58.8
MDPPAMMNEGGPYTLEEIWQFPINGSGRGQFELLNLERRAAASARKRREVDLDVDDSSSSKPTTLSPTNANTNTNGLLNDCDGKRLKAWGSRDDNHHHQQQQQQQQHDSRSEAEPSSGKLVEHKPQPPEPPKQDYIHVRARRGQATDSHSLAERARREKISERMKILQDIVPGCNKVTGKALVLDEIINYIQSLQRQVEFLSMKLEAVNLNMNPETEVFPSKDCSAFPRLFYALLLHMVVYFKPPRGRGHPESLSHPLPCR

SEQ ID NO: 949 - protein, 195 aa, Arabidopsis thaliana
  misc_feature (1)..(195): Ceres CLONE ID no. 24885
  misc_feature (30)..(195): Pfam Name: DUF662 Pfam Description: Family of unknown function (DUF662)
  misc_feature: Phenotype: WHOLE PLANT - Small Useful for modulating plant size
  misc_feature: Phenotype: ROSETTE LEAVES - Ovate Shaped Useful for making plants with increased biomass and foliage
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMEMEQLVGESEKLRMIKLEELSKSIETV

SEQ ID NO: 950 - DNA, 498 bp, Populus balsamifera subsp. trichocarpa
  misc_feature (1)..(498): Ceres ANNOT ID no. 1485102
  misc_feature 101077:<222: Transcription Factor
  misc_feature: Phenotype: WHOLE PLANT - Small Useful for modulating plant size
  misc_feature: Phenotype: ROSETTE LEAVES - Ovate Shaped Useful for making plants with increased biomass and foliage
atggagcagcagcctcagcaacagaaccagctaacggtgcaaaactcaggcagccttagctttagcagccaaatgtctaaagaagatgaagagatgtcaaggtctgctctctctacttttagagccaaagaagaagagatcgaaaagaagaaaatggaggtcagagagaaggttcaagctcagttgggccgtgttgaggaggagaccaagcgcttagccatgattcgtgaggagcttgaagcgcttgcagatcccatgaggaaggaagttgctgttgtccgcaagaagattgatacagtgaacaaagaattgaagccattaggacatactgtgcagaagaaggagaaagaatacaaggatgcccttgaggccttcaatgataagaacaaggagaaagtacagctcataaccaaattaatggagctcgtgagtgaaagcgagaggttgaggctgaaaaagctggaggagctgagtaagaacatagactccatgcactga

SEQ ID NO: 951 - protein, 165 aa, Populus balsamifera subsp. trichocarpa
  misc_feature (1)..(165): Ceres ANNOT ID no. 1485102
  misc_feature (2)..(164): Pfam Name: DUF662 Pfam Description: Family of unknown function (DUF662)
  misc_feature 101133:<222: Transcription Factor
  misc_feature: Phenotype: WHOLE PLANT - Small Useful for modulating plant size
  misc_feature: Phenotype: ROSETTE LEAVES - Ovate Shaped Useful for making plants with increased biomass and foliage
  misc_feature (1)..(165): Functional Homolog of  Ceres CLONE ID no. 24885 at SEQ ID NO. 985 with e-value of 4.10E-60 and BLAST sequence identity of 75.4
MEQQPQQQNQLTVQNSGSLSFSSQMSKEDEEMSRSALSTFRAKEEEIEKKKMEVREKVQAQLGRVEEETKRLAMIREELEALADPMRKEVAVVRKKIDTVNKELKPLGHTVQKKEKEYKDALEAFNDKNKEKVQLITKLMELVSESERLRLKKLEELSKNIDSMH

SEQ ID NO: 952 - protein, 207 aa, Arabidopsis thaliana
  misc_feature (1)..(207): Ceres CLONE ID no. 25172
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
MNEGSSEEVTRTVMEEKPEQQQRGSLEKGRSCKGYLYYSSTLKSKSKNPRCVGIPRTLRQVPDYVVGQSEAEASKDGRTLADFYYGCLGYSVYMTDKDSSAIKQHTKTQLPVCVGLEILADRRAASGNTSSVPARVQNRKDSREVPVPQHQNNKPATATNTENGFLTRFTRNANLVAAGVMKNMKRVGNYVKETVDDSLDPYRKRPK

SEQ ID NO: 953 - DNA, 720 bp, Populus balsamifera subsp. trichocarpa
  misc_feature (1)..(720): Ceres ANNOT ID no. 1457346
  misc_feature 101309:<222: Transcription Factor
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgacagaaacaggaaaacacaaagaagagagagaggcggccctaggcggaggcatggagggtaataaagtagaaggagaagagaaaaagcgagaaaacgagaaactaaaacaaatccaaaatcaaggtggtggtggtggtggttctaatttgaaagggaaatcatgcaaagggtatctttattattcttcaactctcaaatctaacgtcactaatcctcgatgtattggcatcccccgtactctccgccaaattcctaattatgttggacaatctgaggtagaagcttcaaaagatggaagggttctttcagatttttattatggttgtgctgggtactctctttattcaaataaagaccactcaactgataagcaagtggcaaaaaaagaacttccagtctgtgtaggtcttgagcttttggttgatagaagagttgctactgcagaaagtgcttctgctccggctcatatccaccataaagaagatggtcgtgaattgcctcagcctcagcctgcacgtgaattgcctcagctccgagcacagaaaccagcgagttccccagcggatgacttcttcagcaggcaagcaagcaaacagtatatgaggaattcaggcctggttgcatcaggggtggccaggaacatgcgaagagtggggatttacataaaagacagtgtggatgatattttgtacccttacagaaggcgaccgaagtag

SEQ ID NO: 954 - protein, 239 aa, Populus balsamifera subsp. trichocarpa
  misc_feature (1)..(239): Ceres ANNOT ID no. 1457346
  misc_feature 101402:<222: Transcription Factor
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(239): Functional Homolog of  Ceres CLONE ID no. 25172 at SEQ ID NO. 988 with e-value of 1.29E-54 and BLAST sequence identity of 57.8
MTETGKHKEEREAALGGGMEGNKVEGEEKKRENEKLKQIQNQGGGGGGSNLKGKSCKGYLYYSSTLKSNVTNPRCIGIPRTLRQIPNYVGQSEVEASKDGRVLSDFYYGCAGYSLYSNKDHSTDKQVAKKELPVCVGLELLVDRRVATAESASAPAHIHHKEDGRELPQPQPARELPQLRAQKPASSPADDFFSRQASKQYMRNSGLVASGVARNMRRVGIYIKDSVDDILYPYRRRPK

SEQ ID NO: 955 - DNA, 672 bp, Populus balsamifera subsp. trichocarpa
  misc_feature (1)..(672): Ceres ANNOT ID no. 1541170
  misc_feature 101522:<222: Transcription Factor
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atggaggagcaaattgaaaagaatcatattattcaggggtatttgtttgagagtttttacaatttggccgaacaaataagagagagaacagacaaaagaacaacacagagaagagagatcggcatcggcatcggcatcggcatcggcatcgttatggaaagtagtaaacgagaagggggagaagaagagaaaaagcaaactgagaaacgaaaacaaatccaaaacgaaggaggaggaggttctaatttgaaagggaaatcatgcaaagggtatctttattactcttcaacactcaaatcaaacggcatcaatcctcgctgtattggaatccctcgttctctccctcaaattcctaattatgttgggcaatctgaggttgaagcttcaaaagatgggcgtactcttatagatttttattatggttgtgctggttactctgtttatgtcaataaagacctctcaactgataagcaagtggcaaaaacagaacttcctgtctgtgtgggtctggagcttttagtggatagaagagttgcttctgaagatagtgcttctgctccagctcatatccaccacaaagaaggggtggccagaaacatgcgaagagtggggaattacgtaaaagatagtgtggatgatattttgtacccttacagaaggcgacccaagtag

SEQ ID NO: 956 - protein, 223 aa, Populus balsamifera subsp. trichocarpa
  misc_feature (1)..(223): Ceres ANNOT ID no. 1541170
  misc_feature 101613:<222: Transcription Factor
  misc_feature: Phenotype: ROSETTE LEAVES - Curled 2 Useful for making ornamental plants with altered leaf shape
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(223): Functional Homolog of  Ceres CLONE ID no. 25172 at SEQ ID NO. 988 with e-value of 1.40E-43 and BLAST sequence identity of 67.2
MEEQIEKNHIIQGYLFESFYNLAEQIRERTDKRTTQRREIGIGIGIGIGIVMESSKREGGEEEKKQTEKRKQIQNEGGGGSNLKGKSCKGYLYYSSTLKSNGINPRCIGIPRSLPQIPNYVGQSEVEASKDGRTLIDFYYGCAGYSVYVNKDLSTDKQVAKTELPVCVGLELLVDRRVASEDSASAPAHIHHKEGVARNMRRVGNYVKDSVDDILYPYRRRPK

SEQ ID NO: 957 - protein, 443 aa, Arabidopsis thaliana
  misc_feature (1)..(443): Ceres CLONE ID no. 25200
  misc_feature (100)..(249): Pfam Name: Ldh_1_N Pfam Description: lactate/malate dehydrogenase, NAD binding domain
  misc_feature (251)..(423): Pfam Name: Ldh_1_C Pfam Description: lactate/malate dehydrogenase alpha/beta C-terminal domain
  misc_feature: Utility: ABA Useful for making plants with enhanced tolerance to drought
  misc_feature: Phenotype: WHOLE PLANT - ABA Useful for making plants with enhanced tolerance to drought
MAMAELSTPKTTSPFLNSSSRLRLSSKLHLSNHFRHLLLPPLHTTTPNSKISCSVSQNSQAPVAVQENGLVKTKKECYGVFCLTYDLKAEEETRSWKKLINIAVSGAAGMISNHLLFKLASGEVFGPDQPIALKLLGSERSIQALEGVAMELEDSLFPLLREVDIGTDPNEVFQDVEWAILIGAKPRGPGMERADLLDINGQIFAEQGKALNKAASPNVKVLVVGNPCNTNALICLKNAPNIPAKNFHALTRLDENRAKCQLALKAGVFYDKVSNMTIWGNHSTTQVPDFLNARINGLPVKEVITDHKWLEEGFTESVQKRGGLLIQKWGRSSAASTAVSIVDAIKSLVTPTPEGDWFSTGVYTDGNPYGIEEGLVFSMLCRSKGDGDYELVKDVEIDDYLRQRIAKSEAELLAEKRCVAHLTGEGIAYCDLGPVDTMLPGEV

SEQ ID NO: 958 - DNA, 1227 bp, Populus balsamifera subsp. trichocarpa
  misc_feature (1)..(1227): Ceres ANNOT ID no. 1511048
  misc_feature: Utility: ABA Useful for making plants with enhanced tolerance to drought
  misc_feature 101861:<222: Transcription Factor
  misc_feature: Phenotype: WHOLE PLANT - ABA Useful for making plants with enhanced tolerance to drought
atgggtactctgcctaaagtctttgattattatcaagaagtagatagatttcttggattacattttgtagccagtcaagttccagccccagttgcagttcagactgaagaagccaaaagcaagtctgaatgctttggtgttttctgccaaacatatgatctcaaagaagaggagacaaaatcatggaagaaattaattaatgtagcggtttcaggtgctgctgggatgatatctaatcacttactttttaaacttgcatctggtgaggtttttggcccagatcagccaattgcgttgaaactacttggatctgaaagatcattccaagctcttgaaggggtagcaatggaacttgaggattccttgtatccattgttgagggaggtgagtatcggaataaatccttatgaggtgttcgaagatgtagaatgggctcttctgataggagcaaagccgcgagggcctgggatggaacgtgctggcttattagatatcaacgggcagatttttgctgagcagggaaaggctctcaatgctgttgcgtctcgtaatgtcaaggtgatagtagttggcaacccttgtaacaccaatgcattaatttgtttgaaaaatgctccaaacatacctgcaaagaattttcatgctttaacaaggttggatgagaatagggcaaaatgccagcttgccttgaaagcaggtgttttctatgacaaagtgtcaaatatgacgatatggggcaatcactcaaccactcaggttccggactttctaaatgctagaatcaatggtatacctgtcaaggaggttatcaaggatcacaagtggttagaggaagagttcaccgagaaggttcagaagagaggtggagtgctgattcagaaatggggacggtcttcagctgcatcaactgctgtgtcgattgctgatgccatgaagtccctagtaactcccacccctgagggtgattggttttcttctggagtttataccagtgggaatccttatggtatagcacaggatatagttttcagcatgccttgtagatcaaaaggagacggtgactatgaactcgtcaaggacgttacatttgatgagtatcttctcaagagaattgctaagtctgaagctgaattgctagctgagaagagatgtgtggcccacctcacaggagagggtgttgcattctgtgatctaccagaagacacgatgcttcctggggaaatgtaa

SEQ ID NO: 959 - protein, 408 aa, Populus balsamifera subsp. trichocarpa
  misc_feature (1)..(408): Ceres ANNOT ID no. 1511048
  misc_feature (217)..(389): Pfam Name: Ldh_1_C Pfam Description: lactate/malate dehydrogenase alpha/beta C-terminal domain
  misc_feature (66)..(215): Pfam Name: Ldh_1_N Pfam Description: lactate/malate dehydrogenase, NAD binding domain
  misc_feature: SWISSPROT Homolog: MDHP_MEDSA Malate dehydrogenase [NADP], chloroplast precursor (EC 1.1.1.82) (NADP-MDH) with e-value of 3.4e-185 and BLAST sequence identity of 80.9
  misc_feature: SWISSPROT Homolog: MDHP_PEA Malate dehydrogenase [NADP], chloroplast precursor (EC 1.1.1.82) (NADP-MDH) with e-value of 1.5e-184 and BLAST sequence identity of 79.4
  misc_feature: SWISSPROT Homolog: MDHP_MESCR Malate dehydrogenase [NADP], chloroplast precursor (EC 1.1.1.82) (NADP-MDH) with e-value of 9.6e-181 and BLAST sequence identity of 78.5
  misc_feature: SWISSPROT Homolog: MDHP_FLABI Malate dehydrogenase [NADP], chloroplast precursor (EC 1.1.1.82) (NADP-MDH) with e-value of 1.3e-174 and BLAST sequence identity of 76.7
  misc_feature: SWISSPROT Homolog: MDHP1_SORBI Malate dehydrogenase [NADP] 1, chloroplast precursor (EC 1.1.1.82) (NADP-MDH-1) with e-value of 1.1e-172 and BLAST sequence identity of 82.4
  misc_feature: Utility: ABA Useful for making plants with enhanced tolerance to drought
  misc_feature 101987:<222: Transcription Factor
  misc_feature: Phenotype: WHOLE PLANT - ABA Useful for making plants with enhanced tolerance to drought
  misc_feature (1)..(408): Functional Homolog of  Ceres CLONE ID no. 25200 at SEQ ID NO. 993 with e-value of 6.70E-179 and BLAST sequence identity of 86.7
MGTLPKVFDYYQEVDRFLGLHFVASQVPAPVAVQTEEAKSKSECFGVFCQTYDLKEEETKSWKKLINVAVSGAAGMISNHLLFKLASGEVFGPDQPIALKLLGSERSFQALEGVAMELEDSLYPLLREVSIGINPYEVFEDVEWALLIGAKPRGPGMERAGLLDINGQIFAEQGKALNAVASRNVKVIVVGNPCNTNALICLKNAPNIPAKNFHALTRLDENRAKCQLALKAGVFYDKVSNMTIWGNHSTTQVPDFLNARINGIPVKEVIKDHKWLEEEFTEKVQKRGGVLIQKWGRSSAASTAVSIADAMKSLVTPTPEGDWFSSGVYTSGNPYGIAQDIVFSMPCRSKGDGDYELVKDVTFDEYLLKRIAKSEAELLAEKRCVAHLTGEGVAFCDLPEDTMLPGEM

SEQ ID NO: 960 - protein, 208 aa, Arabidopsis thaliana
  misc_feature (1)..(208): Ceres CLONE ID no. 25380
  misc_feature (70)..(207): Pfam Name: PsaD Pfam Description: PsaD
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MATQAAGIFNSAITTAATSGVKKLHFFSTTHRPKSLSFTKTAIRSEKTDSSAAAAAAPATKEAPVGFTPPQLDPNTPSPIFAGSTGGLLRKAQVEEFYVITWNSPKEQIFEMPTGGAAIMREGPNLLKLARKEQCLALGTRLRSKYKITYQFYRVFPNGEVQYLHPKDGVYPEKANPGREGVGLNMRSIGKNVSPIEVKFTGKQSYDL

SEQ ID NO: 961 - DNA, 615 bp, Populus balsamifera subsp. trichocarpa
  misc_feature (1)..(615): Ceres ANNOT ID no. 1512618
  misc_feature 102189:<222: Transcription Factor
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggcaatggctactcaagcctctctcttcacccccacgaccctctccaccctaaaatcaagcaaccaaaccattgttcaatggaaacaatcatcctttttaccaatctctaatgtcaaggcacaaagaagctttaaggttgctgctgtagaggaaaaaacagctacaaaagaggctccagtgggatttactccaccggagttggacccaagtaccccatcaccaatttttggtgggagcaccggtggactgttgaggaaagcccaggtagaggagttttatgtgatcacttgggactcccccaaggaacaaatatttgaaatgccaactgggggtgcagccattatgagggaaggccctaacttactcaagttggccaggaaagagcagtgcttggcccttggaactaggctaaggtctaagtacaagatcaagtaccagttttacagggtgttccccaatggagaggttcagtacttgcatcccaaggatggtgtctaccctgagaaggtgaacccggggcgccaaggtgtcggccagaatttcaggtctatcggaaagaatgctagcccaattgaggtcaagttcaccggcaagcaagtttatgacttgtga

SEQ ID NO: 962 - protein, 202 aa, Populus balsamifera subsp. trichocarpa
  misc_feature (1)..(202): Ceres ANNOT ID no. 1512618
  misc_feature (64)..(201): Pfam Name: PsaD Pfam Description: PsaD
  misc_feature: SWISSPROT Homolog: PSAD1_ARATH Photosystem I reaction center subunit II-1, chloroplast precursor (Photosystem I 20 kDa subunit 1) (PSI-D1) with e-value of 1.4e-108 and BLAST sequence identity of 99.5
  misc_feature: SWISSPROT Homolog: PSAD2_ARATH Photosystem I reaction center subunit II-2, chloroplast precursor (Photosystem I 20 kDa subunit 2) (PSI-D2) with e-value of 1.1e-99 and BLAST sequence identity of 92.8
  misc_feature: SWISSPROT Homolog: PSAD_SPIOL Photosystem I reaction center subunit II, chloroplast precursor (Photosystem I 20 kDa subunit) (PSI-D) with e-value of 1.7e-78 and BLAST sequence identity of 75.1
  misc_feature: SWISSPROT Homolog: PSAD_CUCSA Photosystem I reaction center subunit II, chloroplast precursor (Photosystem I 20 kDa subunit) (PSI-D) (PS I subunit 5) with e-value of 2.1e-75 and BLAST sequence identity of 73.0
  misc_feature: SWISSPROT Homolog: PSAD_LYCES Photosystem I reaction center subunit II, chloroplast precursor (Photosystem I 20 kDa subunit) (PSI-D) with e-value of 1.8e-74 and BLAST sequence identity of 73.5
  misc_feature 102303:<222: Transcription Factor
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(202): Functional Homolog of  Ceres CLONE ID no. 25380 at SEQ ID NO. 996 with e-value of 8.50E-76 and BLAST sequence identity of 77.1
MATQASLFTPTTLSTLKSSNQTIVQWKQSSFLPISNVKAQRSFKVAAVEEKTATKEAPVGFTPPELDPSTPSPIFGGSTGGLLRKAQVEEFYVITWDSPKEQIFEMPTGGAAIMREGPNLLKLARKEQCLALGTRLRSKYKIKYQFYRVFPNGEVQYLHPKDGVYPEKVNPGRQGVGQNFRSIGKNASPIEVKFTGKQVYDL

SEQ ID NO: 963 - DNA, 609 bp, Populus balsamifera subsp. trichocarpa
  misc_feature (1)..(609): Ceres ANNOT ID no. 1459357
  misc_feature 102396:<222: Transcription Factor
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggctactcaagcctctctcttcacccccacgaccctctccaccctaaaatcaagcaaccaaaccattgttcaatggaaacaatcatcctttttaccaatctctaatgtcaaggcacaaagaagctttaaggttgctgctgtagaggaaaaaacagctacaaaagaggctccagtgggatttactccaccggagttggacccaagtaccccatcaccaatttttggtgggagcaccggtggactgttgaggaaagcccaggtagaggagttttatgtgatcacttgggactcccccaaggaacaaatatttgaaatgccaactgggggtgcagccattatgagggaaggccctaacttactcaagttggccaggaaagagcagtgcttggcccttggaactaggctaaggtctaagtacaagatcaagtaccagttttacagggtgttccccaatggagaggttcagtacttgcatcccaaggatggtgtctaccctgagaaggtgaacccggggcgccaaggtgtcggccagaatttcaggtctatcggaaagaatgctagcccaattgaggtcaagttcaccggcaagcaagtttatgacttgtga

SEQ ID NO: 964 - protein, 202 aa, Populus balsamifera subsp. trichocarpa; identical to SEQ ID NO: 962
  misc_feature (1)..(202): Ceres ANNOT ID no. 1459357
  misc_feature (64)..(201): Pfam Name: PsaD Pfam Description: PsaD
  misc_feature: SWISSPROT Homolog: PSAD1_ARATH Photosystem I reaction center subunit II-1, chloroplast precursor (Photosystem I 20 kDa subunit 1) (PSI-D1) with e-value of 1.4e-108 and BLAST sequence identity of 99.5
  misc_feature: SWISSPROT Homolog: PSAD2_ARATH Photosystem I reaction center subunit II-2, chloroplast precursor (Photosystem I 20 kDa subunit 2) (PSI-D2) with e-value of 1.1e-99 and BLAST sequence identity of 92.8
  misc_feature: SWISSPROT Homolog: PSAD_SPIOL Photosystem I reaction center subunit II, chloroplast precursor (Photosystem I 20 kDa subunit) (PSI-D) with e-value of 1.7e-78 and BLAST sequence identity of 75.1
  misc_feature: SWISSPROT Homolog: PSAD_CUCSA Photosystem I reaction center subunit II, chloroplast precursor (Photosystem I 20 kDa subunit) (PSI-D) (PS I subunit 5) with e-value of 2.1e-75 and BLAST sequence identity of 73.0
  misc_feature: SWISSPROT Homolog: PSAD_LYCES Photosystem I reaction center subunit II, chloroplast precursor (Photosystem I 20 kDa subunit) (PSI-D) with e-value of 1.8e-74 and BLAST sequence identity of 73.5
  misc_feature 102510:<222: Transcription Factor
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(202): Functional Homolog of  Ceres CLONE ID no. 25380 at SEQ ID NO. 996 with e-value of 8.50E-76 and BLAST sequence identity of 77.1

SEQ ID NO: 965 - DNA, 606 bp, Populus balsamifera subsp. trichocarpa
  misc_feature (1)..(606): Ceres ANNOT ID no. 1463526
  misc_feature 102603:<222: Transcription Factor
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggcagctcaagcctctctctttactcctccaaccctctccaccctaaaatcaagcaaccaggcttttgttccatggaaacaggcatcttttttaccaatatctaatgttaagccacaaagaaccatgaaggttgctgctgcagaggaaacagctgtcaaagaggctccggtgggcttcactccacctgagttggacccgagtaccccatcaccaatttttggtggaagcactggtgggctgttgaggaaagcccaggtggaggagttttatgtgattacatgggactcccccaaggaacagatatttgaaatgccgactgggggtgctgccatcatgagggaaggccctaacttgctcaagctggccaggaaggagcagtgcttggctctcgggactaggctaaggtccaagtacaagatcaagtaccagttttacagggtgttccccaatggagaggtgcagtacttgcatcctaaggatggtgtctaccctgagaaggtgaacccagggcgccaaggcgtgggccaaaatttcaggtcaatcggaaagaacgttagcccaattgaggtcaagttcacaggcaagcaagcgtatgatttgtga

SEQ ID NO: 966 - protein, 201 aa, Populus balsamifera subsp. trichocarpa
  misc_feature (1)..(201): Ceres ANNOT ID no. 1463526
  misc_feature (63)..(200): Pfam Name: PsaD Pfam Description: PsaD
  misc_feature: SWISSPROT Homolog: PSAD1_ARATH Photosystem I reaction center subunit II-1, chloroplast precursor (Photosystem I 20 kDa subunit 1) (PSI-D1) with e-value of 1.4e-108 and BLAST sequence identity of 99.5
  misc_feature: SWISSPROT Homolog: PSAD2_ARATH Photosystem I reaction center subunit II-2, chloroplast precursor (Photosystem I 20 kDa subunit 2) (PSI-D2) with e-value of 1.1e-99 and BLAST sequence identity of 92.8
  misc_feature: SWISSPROT Homolog: PSAD_SPIOL Photosystem I reaction center subunit II, chloroplast precursor (Photosystem I 20 kDa subunit) (PSI-D) with e-value of 1.7e-78 and BLAST sequence identity of 75.1
  misc_feature: SWISSPROT Homolog: PSAD_CUCSA Photosystem I reaction center subunit II, chloroplast precursor (Photosystem I 20 kDa subunit) (PSI-D) (PS I subunit 5) with e-value of 2.1e-75 and BLAST sequence identity of 73.0
  misc_feature: SWISSPROT Homolog: PSAD_LYCES Photosystem I reaction center subunit II, chloroplast precursor (Photosystem I 20 kDa subunit) (PSI-D) with e-value of 1.8e-74 and BLAST sequence identity of 73.5
  misc_feature 102717:<222: Transcription Factor
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(201): Functional Homolog of  Ceres CLONE ID no. 25380 at SEQ ID NO. 996 with e-value of 1.40E-75 and BLAST sequence identity of 83.9
MAAQASLFTPPTLSTLKSSNQAFVPWKQASFLPISNVKPQRTMKVAAAEETAVKEAPVGFTPPELDPSTPSPIFGGSTGGLLRKAQVEEFYVITWDSPKEQIFEMPTGGAAIMREGPNLLKLARKEQCLALGTRLRSKYKIKYQFYRVFPNGEVQYLHPKDGVYPEKVNPGRQGVGQNFRSIGKNVSPIEVKFTGKQAYDL

SEQ ID NO: 967 - protein, 281 aa, Arabidopsis thaliana
  misc_feature (1)..(281): Ceres CLONE ID no. 25538
  misc_feature (176)..(269): Pfam Name: PRA-PH Pfam Description: Phosphoribosyl-ATP pyrophosphohydrolase
  misc_feature (81)..(155): Pfam Name: PRA-CH Pfam Description: Phosphoribosyl-AMP cyclohydrolase
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 968 - DNA, 792 bp, Populus balsamifera subsp. trichocarpa
  misc_feature (1)..(792): Ceres ANNOT ID no. 1480776
  misc_feature 102961:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgccggtctttggggtcctccgtttaccaaatcaatgtgagcatgatttccagccaacggaaattaagttctttttttttccttttctttttccagaggtggtcgagacattgttagacagtgtaaaatgggacgacaaaggtttggcagtgggcatagctcaaaatattgacacaggagcagtattaatgcaaggctttgtgaacagtgatgcactcgctacaacaatttcctctcagaaggcaacattttatagcaggtcacgttcagctctgtggacaaaaggagaaacgtcgaagaattttatcaatgttcatgacatctatcttgattgtgaccgtgactctataatttaccttgggaagccggatggacctacctgccacacagggtcagaaacttgctattacacatcagtccctgacttgttagaaaataaacaggttgatggaaataagttggcgttgacaactttgtactctttggaaacaataatttcccagcgcaaagctgaattagcattgccacaaactggaaaaccctcatggactaaacgattactgcttgatcatgacttactctgcacgaaaatcagggaagaggcagatgaattatgccgaacactagaggacaatgaggaccaagcacgtactgccgatgaaatgggggatgtactttatcatgccatggttctaatggcagttaaaggtgtaaaaatagaagaggtgctagaagttctacggaagagattttttcagtcaggtatcgaggaaaagagaagtcgtgggtag

SEQ ID NO: 969 - protein, 263 aa, Populus balsamifera subsp. trichocarpa
  misc_feature (1)..(263): Ceres ANNOT ID no. 1480776
  misc_feature (159)..(252): Pfam Name: PRA-PH Pfam Description: Phosphoribosyl-ATP pyrophosphohydrolase
  misc_feature (64)..(138): Pfam Name: PRA-CH Pfam Description: Phosphoribosyl-AMP cyclohydrolase
  misc_feature: SWISSPROT Homolog: HIS2_ARATH Histidine biosynthesis bifunctional protein hisIE, chloroplast precursor with e-value of 2.3e-147 and BLAST sequence identity of 100.0
  misc_feature: SWISSPROT Homolog: OGG1_YEAST EC 3.2.2.- DNA-(apurinic or apyrimidinic site) lyase EC 4.2.99.18 (AP lyase)]
  misc_feature: SWISSPROT Homolog: HIS2_ECOLI Histidine biosynthesis bifunctional protein hisIE with e-value of 2.9e-33 and BLAST sequence identity of 47.9
  misc_feature: SWISSPROT Homolog: HIS2_ECOLI Includes: Phosphoribosyl-AMP cyclohydrolase EC 3.5.4.19 (PRA-CH); Phosphoribosyl-ATP pyrophosphatase EC 3.6.1.31 (PRA-PH)]
  misc_feature: SWISSPROT Homolog: HIS2_ECO57 Histidine biosynthesis bifunctional protein hisIE with e-value of 7.5e-33 and BLAST sequence identity of 49.0
  misc_feature: SWISSPROT Homolog: HIS2_ECO57 Includes: Phosphoribosyl-AMP cyclohydrolase EC 3.5.4.19 (PRA-CH); Phosphoribosyl-ATP pyrophosphatase EC 3.6.1.31) (PRA-PH)]
  misc_feature: SWISSPROT Homolog: HIS2_ECOL6 Histidine biosynthesis bifunctional protein hisIE with e-value of 7.5e-33 and BLAST sequence identity of 49.0
  misc_feature: SWISSPROT Homolog: HIS2_ECOL6 Includes: Phosphoribosyl-AMP cyclohydrolase EC 3.5.4.19 (PRA-CH); Phosphoribosyl-ATP pyrophosphatase EC 3.6.1.31 (PRA-PH)]
  misc_feature: SWISSPROT Homolog: HIS2_PHOLL Histidine biosynthesis bifunctional protein hisIE with e-value of 5.2e-32 and BLAST sequence identity of 46.5
  misc_feature: SWISSPROT Homolog: HIS2_PHOLL Includes: Phosphoribosyl-AMP cyclohydrolase EC 3.5.4.19 (PRA-CH); Phosphoribosyl-ATP pyrophosphatase EC 3.6.1.31 (PRA-PH)]
  misc_feature 103169:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(263): Functional Homolog of  Ceres CLONE ID no. 25538 at SEQ ID NO. 1003 with e-value of 1.29E-93 and BLAST sequence identity of 76.7
MPVFGVLRLPNQCEHDFQPTEIKFFFFPFLFPEVVETLLDSVKWDDKGLAVGIAQNIDTGAVLMQGFVNSDALATTISSQKATFYSRSRSALWTKGETSKNFINVHDIYLDCDRDSIIYLGKPDGPTCHTGSETCYYTSVPDLLENKQVDGNKLALTTLYSLETIISQRKAELALPQTGKPSWTKRLLLDHDLLCTKIREEADELCRTLEDNEDQARTADEMGDVLYHAMVLMAVKGVKIEEVLEVLRKRFFQSGIEEKRSRG

SEQ ID NO: 970 - protein, 255 aa, Arabidopsis thaliana
  misc_feature (1)..(255): Ceres CLONE ID no. 25607
  misc_feature (179)..(253): Pfam Name: Biotin_lipoyl Pfam Description: Biotin-requiring enzyme
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Serrate Margins Useful for making plants with increased biomass and foliage
MASLSVPCVKICALNRRVGSLPGISTQRWQPQPNGISFPSDVSQNHSAFWRLRATTNEVVSNSTPMTNGGYMNGKAKTNVPEPAELSEFMAKVSGLLKLVDSKDIVELELKQLDCEIVIRKKEALQQAVPPAPVYHSMPPVMADFSMPPAQPVALPPSPTPTSTPATAKPTSAPSSSHPPLKSPMAGTFYRSPGPGEPPFVKVGDKVQKGQIVCIIEAMKLMNEIEAEKSGTIMELLAEDGKPVSVDTPLFVIAP

SEQ ID NO: 971 - DNA, 864 bp, Populus balsamifera subsp. trichocarpa
  misc_feature (1)..(864): Ceres ANNOT ID no. 1450220
  misc_feature 103420:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Serrate Margins Useful for making plants with increased biomass and foliage
atggcttcaatctctgttccatgccccaagactattttggttgccgccggtgttggatccaatgctcaaaattcacaaccaaagcccatgatctcttttccccgagcaccaatttccaatcagaaccctcctctctctttgggatctacattctctggttttgagtggcctaacaggaagcagcaagctgttatgaaggcacaggcgcagctgaatgaggttatggttgagaaatcttcaaattctgtactggtgggggactctgaatccaaagcggcatcatccgagggaaaggatgagcccacagaaagtaaaatccctgacgtgtcatccatttcagcatttatgacacaagtatcagaacttgtcaaacttgtggattcaagagatatcacagagctgcaattgaagcaatcaggttgtgaactcataataaggaaaaaggaggctttgcagcagtcagaaccagcagctcctgttcttccaatgcaatctccttacccgcatgcaatgtttcctgctccaccagtagctgctcctgccccggctccagcaagtccctcttcagctcctgccttgcccccccctgcaaaggcaagttcatcgtctcatccaccactgaaatgccccatggctggaaccttttatcggagtccagctccaggtgaacccccatttgtgaaggtgggggataaagtgcagaaaggtcaagttgtttgtatcattgaggccatgaagctaatgaatgaaattgaagctgatcaatctggaaccattaccgagatcgtggcagcggatgggaaaccagttagtgtggacacggtaatctctttctccctacccctctcgtccaacttattgtag

SEQ ID NO: 972 - protein, 287 aa, Populus balsamifera subsp. trichocarpa
  misc_feature (1)..(287): Ceres ANNOT ID no. 1450220
  misc_feature (205)..(279): Pfam Name: Biotin_lipoyl Pfam Description: Biotin-requiring enzyme
  misc_feature: SWISSPROT Homolog: BCCP_SOYBN Biotin carboxyl carrier protein of acetyl-CoA carboxylase, chloroplast precursor (BCCP) with e-value of 5.1e-56 and BLAST sequence identity of 52.0
  misc_feature: SWISSPROT Homolog: BCCP_ARATH Biotin carboxyl carrier protein of acetyl-CoA carboxylase, chloroplast precursor (BCCP) with e-value of 3.6e-55 and BLAST sequence identity of 50.6
  misc_feature: SWISSPROT Homolog: BCCP_ANASP Biotin carboxyl carrier protein of acetyl-CoA carboxylase chloroplast precursor (BCCP) with e-value of 4.8e-28 and BLAST sequence identity of 40.1
  misc_feature: SWISSPROT Homolog: BCCP_ECO57 Biotin carboxyl carrier protein of acetyl-CoA carboxylase chloroplast precursor (BCCP) with e-value of 1.0e-25 and BLAST sequence identity of 40.1
  misc_feature: SWISSPROT Homolog: BCCP_ECOL6 Biotin carboxyl carrier protein of acetyl-CoA carboxylase chloroplast precursor (BCCP) with e-value of 1.0e-25 and BLAST sequence identity of 40.1
  misc_feature 103549:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(287): Functional Homolog of  Ceres CLONE ID no. 25607 at SEQ ID NO. 1006 with e-value of 4.69E-59 and BLAST sequence identity of 60.4
MASISVPCPKTILVAAGVGSNAQNSQPKPMISFPRAPISNQNPPLSLGSTFSGFEWPNRKQQAVMKAQAQLNEVMVEKSSNSVLVGDSESKAASSEGKDEPTESKIPDVSSISAFMTQVSELVKLVDSRDITELQLKQSGCELIIRKKEALQQSEPAAPVLPMQSPYPHAMFPAPPVAAPAPAPASPSSAPALPPPAKASSSSHPPLKCPMAGTFYRSPAPGEPPFVKVGDKVQKGQVVCIIEAMKLMNEIEADQSGTITEIVAADGKPVSVDTVISFSLPLSSNLL

SEQ ID NO: 973 - protein, 314 aa, Arabidopsis thaliana
  misc_feature (1)..(314): Ceres CLONE ID no. 25758
  misc_feature (31)..(233): Pfam Name: Brix Pfam Description: Brix domain
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: INFLORESCENCE - Other Useful for making ornamental plants with modified flowers
MMEIRTPKTGKAKRVLESRAPKLVETGKKTLILHGTKTSATLSSVMTELYRLKKGGAIRYSRRNENIRPFESGGETSLEFFSQKTDCSIFVYGSHTKKRPDNLVLGRMYDHQVYDLIEVGIENFKSLRAFSYYKKFAPHEGTKPFICFIGEGFENVSELKHLKEVLTDLFRGEVVDNLNLTGLDRAYVCSAISPTKVFLTHCALKLKKSGSIVPRMELVEVSPSMDLVIRRNRLPNDSLMKEAMRTSKDKPKKKEKNVDQDAVLGKTGKIYMPDQKLKEMKLFDKSKGSKRERKDAKLKHKEETVAKKMKVSSE

SEQ ID NO: 974 - DNA, 945 bp, Populus balsamifera subsp. trichocarpa
  misc_feature (1)..(945): Ceres ANNOT ID no. 1473748
  misc_feature 103773:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: INFLORESCENCE - Other Useful for making ornamental plants with modified flowers
atgttgaaggttaaaaccccaaagtacggaagagtcaagcgagagcttgaaaaacgagaaccaaaacttgttgagttggcgaagaagacactgatactacaaggaacaaaaacaagcaatgttttgaatactgtattgagtgaaatatatcatctcaagagagataacgcaattcgatatacgcgtaagaatgacagtataaggccttttgagtccggtggcgaaacttctttggagttcttttctttgaaaaccgattgcagtatctttgtgtatggttccacctcaaagaaacgtcctgacaatcttgtcatagggcgaacatatgaccaccacatatatgatcttatagaagttggggttgaaaattttaaacgaatggattccttcacttatgataagaaactagctccacaagcaggatcaaaacctttcattgtttttagtggagaagcatttgagagtgtagatgagttgaaacatctgaaggaagttttgcttgagcttttaaggggagaggttgtggataatttgaatcttgctgggctgggccgtgtttatgtatgtacagctatatcttcaaatcgggtgttcctcactcactgtgcaatgcggctaaaaaagtctggcacaatagtcccaaggatagaactggtagaaatcggcccttccatggattttgtagttcgtcgtcatcgtcttcctaatgaaagcttaaggaaagaagccatgaaaactgctaaagataagcttcataagaagattaaaaatgttagtaaagatgctctacaagggaagcttggaaagatttatgtacctgatcaaaaggttggagagatgccgctacctaacaaagctaaaggagtgaagagagagcgccgtgaagctaaagtgaagaactcaaataatgagcgcgcatcaaaaaagcagaaagaagattcttag

SEQ ID NO: 975 - protein, 314 aa, Populus balsamifera subsp. trichocarpa
  misc_feature (1)..(314): Ceres ANNOT ID no. 1473748
  misc_feature (31)..(233): Pfam Name: Brix Pfam Description: Brix domain
  misc_feature: SWISSPROT Homolog: BXDC1_ARATH Brix domain-containing protein 1 homolog with e-value of 1.4e-163 and BLAST sequence identity of 99.4
  misc_feature: SWISSPROT Homolog: BXDC1_ORYSA Brix domain-containing protein 1 homolog with e-value of 1.0e-105 and BLAST sequence identity of 64.0
  misc_feature: SWISSPROT Homolog: BXDC1_HUMAN Brix domain-containing protein 1 with e-value of 3.7e-60 and BLAST sequence identity of 44.8
  misc_feature: SWISSPROT Homolog: BXDC1_MOUSE Brix domain-containing protein 1 with e-value of 2.6e-59 and BLAST sequence identity of 45.2
  misc_feature: SWISSPROT Homolog: BXDC1_SCHPO Brix domain-containing protein 1 homolog with e-value of 5.9e-46 and BLAST sequence identity of 38.1
  misc_feature 103892:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(314): Functional Homolog of  Ceres CLONE ID no. 25758 at SEQ ID NO. 1009 with e-value of 2.40E-112 and BLAST sequence identity of 67.4
MLKVKTPKYGRVKRELEKREPKLVELAKKTLILQGTKTSNVLNTVLSEIYHLKRDNAIRYTRKNDSIRPFESGGETSLEFFSLKTDCSIFVYGSTSKKRPDNLVIGRTYDHHIYDLIEVGVENFKRMDSFTYDKKLAPQAGSKPFIVFSGEAFESVDELKHLKEVLLELLRGEVVDNLNLAGLGRVYVCTAISSNRVFLTHCAMRLKKSGTIVPRIELVEIGPSMDFVVRRHRLPNESLRKEAMKTAKDKLHKKIKNVSKDALQGKLGKIYVPDQKVGEMPLPNKAKGVKRERREAKVKNSNNERASKKQKEDS

SEQ ID NO: 976 - protein, 94 aa, Arabidopsis thaliana
  misc_feature (1)..(94): Ceres CLONE ID no. 25795
  misc_feature (1)..(94): Also Known As Ceres CDNA ID no. 23362339
  misc_feature (1)..(94): Also Known As Ceres GEMINI ID 554G8
  misc_feature (35)..(80): Pfam Name: Myb_DNA-binding Pfam Description: Myb-like DNA-binding domain
  misc_feature 104026:<222: Transcription Factor
  misc_feature: Phenotype: Activates expression of the gene endogenous to the AtATTPS3 (SEQ ID NO 4165) regalutory region Useful for modulating Terpenoid Biosynthesis
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 977 - DNA, 267 bp, Populus balsamifera subsp. trichocarpa
  misc_feature (1)..(267): Ceres ANNOT ID no. 1471291
  misc_feature 104069:<222: Transcription Factor
  misc_feature: Phenotype: Activates expression of the gene endogenous to the AtATTPS3 (SEQ ID NO 4165) regalutory region Useful for modulating Terpenoid Biosynthesis
atggatagacgtcgcaagaagcaagccaagactacatcttgttgttctgaacaagaggtgagcagcattgagtgggagttcattaacatgtcagaacaagaagaagatctcatttacagaatgcataatctggtgggggacaggtgggctttgatcgctggtcgaattccaggacgcaaagctgaagaaatagagagattttggctaatgagacacggtgaagggtttgccagtcgacgaagagagcaaaagagatgtcattcctaa

SEQ ID NO: 978 - protein, 88 aa, Populus balsamifera subsp. trichocarpa
  misc_feature (1)..(88): Ceres ANNOT ID no. 1471291
  misc_feature (27)..(72): Pfam Name: Myb_DNA-binding Pfam Description: Myb-like DNA-binding domain
  misc_feature: SWISSPROT Homolog: MYBC_MAIZE Anthocyanin regulatory C1 protein with e-value of 1.2e-09 and BLAST sequence identity of 61.5
  misc_feature: SWISSPROT Homolog: GL1_ARALY Trichome differentiation protein GL1 (GLABROUS1 protein) with e-value of 1.9e-09 and BLAST sequence identity of 57.9
  misc_feature: SWISSPROT Homolog: GL1_ARATH Trichome differentiation protein GL1 (GLABROUS1 protein) (R2R3-MYB transcription factor GL1) with e-value of 2.2e-09 and BLAST sequence identity of 57.9
  misc_feature: SWISSPROT Homolog: TT2_ARATH TRANSPARENT TESTA 2 protein (Myb-related protein 123) (AtMYB123) (Myb-related transcription factor LBM2-like) with e-value of 1.1e-08 and BLAST sequence identity of 56.4
  misc_feature: SWISSPROT Homolog: MYB4_ARATH Transcription repressor MYB4 (Myb-related protein 4) (AtMYB4) with e-value of 1.4e-08 and BLAST sequence identity of 55.3
  misc_feature 104149:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(88): Functional Homolog of  Ceres CLONE ID no. 25795 at SEQ ID NO. 1012 with e-value of 2.90E-27 and BLAST sequence identity of 70.3
MDRRRKKQAKTTSCCSEQEVSSIEWEFINMSEQEEDLIYRMHNLVGDRWALIAGRIPGRKAEEIERFWLMRHGEGFASRRREQKRCHS

SEQ ID NO: 979 - DNA, 279 bp, Populus balsamifera subsp. trichocarpa
  misc_feature (1)..(279): Ceres ANNOT ID no. 1444391
  misc_feature 104200:<222: Transcription Factor
  misc_feature: Phenotype: Activates expression of the gene endogenous to the AtATTPS3 (SEQ ID NO 4165) regalutory region Useful for modulating Terpenoid Biosynthesis
atggatagacgtcgcaggaagcaagccaagacaacaactcattgctctgatcaagaggtaagcagcattgaatgggaattcatcaacatgtcagaacaagaagaagatctcatttacagaatgtataagctggtcggagacaggtgggctttgatcgcaggtcgaattccaggccgcaaagctgaggaaatagagagatattggattatgagacactgtgaagggtttgccagtcgacgaaaggaacaaaaaagagatgtaattcctaatacctcttaa

SEQ ID NO: 980 - protein, 92 aa, Populus balsamifera subsp. trichocarpa
  misc_feature (1)..(92): Ceres ANNOT ID no. 1444391
  misc_feature (27)..(72): Pfam Name: Myb_DNA-binding Pfam Description: Myb-like DNA-binding domain
  misc_feature: SWISSPROT Homolog: MYBC_MAIZE Anthocyanin regulatory C1 protein with e-value of 1.2e-09 and BLAST sequence identity of 61.5
  misc_feature: SWISSPROT Homolog: GL1_ARALY Trichome differentiation protein GL1 (GLABROUS1 protein) with e-value of 1.9e-09 and BLAST sequence identity of 57.9
  misc_feature: SWISSPROT Homolog: GL1_ARATH Trichome differentiation protein GL1 (GLABROUS1 protein) (R2R3-MYB transcription factor GL1) with e-value of 2.2e-09 and BLAST sequence identity of 57.9
  misc_feature: SWISSPROT Homolog: TT2_ARATH TRANSPARENT TESTA 2 protein (Myb-related protein 123) (AtMYB123) (Myb-related transcription factor LBM2-like) with e-value of 1.1e-08 and BLAST sequence identity of 56.4
  misc_feature: SWISSPROT Homolog: MYB4_ARATH Transcription repressor MYB4 (Myb-related protein 4) (AtMYB4) with e-value of 1.4e-08 and BLAST sequence identity of 55.3
  misc_feature 104280:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(92): Functional Homolog of  Ceres CLONE ID no. 25795 at SEQ ID NO. 1012 with e-value of 3.69E-27 and BLAST sequence identity of 70.3
MDRRRRKQAKTTTHCSDQEVSSIEWEFINMSEQEEDLIYRMYKLVGDRWALIAGRIPGRKAEEIERYWIMRHCEGFASRRKEQKRDVIPNTS

SEQ ID NO: 981 - DNA, 285 bp, Populus balsamifera subsp. trichocarpa
  misc_feature (1)..(285): Ceres ANNOT ID no. 1488042
  misc_feature 104331:<222: Transcription Factor
  misc_feature: Phenotype: Activates expression of the gene endogenous to the AtATTPS3 (SEQ ID NO 4165) regalutory region Useful for modulating Terpenoid Biosynthesis
atggctgacttggatcactcctctagtgatgacaactctgttgattctagagaggaaaccagccaagattcgaagcttgaattctcagaagatgaggaaactcttatcaccaggatgtacaatctggttggtgagaggtggcccttaattgctgggaggattccaggaagaacagcagaagaaattgagaagtactggacttcaagatactctacaaggatggctctggctctggctctggctctggcacaggcacaggcacagggcagagttgtaagccattga

SEQ ID NO: 982 - protein, 94 aa, Populus balsamifera subsp. trichocarpa
  misc_feature (1)..(94): Ceres ANNOT ID no. 1488042
  misc_feature (25)..(70): Pfam Name: Myb_DNA-binding Pfam Description: Myb-like DNA-binding domain
  misc_feature: SWISSPROT Homolog: MYBC_MAIZE Anthocyanin regulatory C1 protein with e-value of 1.2e-09 and BLAST sequence identity of 61.5
  misc_feature: SWISSPROT Homolog: GL1_ARALY Trichome differentiation protein GL1 (GLABROUS1 protein) with e-value of 1.9e-09 and BLAST sequence identity of 57.9
  misc_feature: SWISSPROT Homolog: GL1_ARATH Trichome differentiation protein GL1 (GLABROUS1 protein) (R2R3-MYB transcription factor GL1) with e-value of 2.2e-09 and BLAST sequence identity of 57.9
  misc_feature: SWISSPROT Homolog: TT2_ARATH TRANSPARENT TESTA 2 protein (Myb-related protein 123) (AtMYB123) (Myb-related transcription factor LBM2-like) with e-value of 1.1e-08 and BLAST sequence identity of 56.4
  misc_feature: SWISSPROT Homolog: MYB4_ARATH Transcription repressor MYB4 (Myb-related protein 4) (AtMYB4) with e-value of 1.4e-08 and BLAST sequence identity of 55.3
  misc_feature 104411:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(94): Functional Homolog of  Ceres CLONE ID no. 25795 at SEQ ID NO. 1012 with e-value of 2.80E-13 and BLAST sequence identity of 56.6
MADLDHSSSDDNSVDSREETSQDSKLEFSEDEETLITRMYNLVGERWPLIAGRIPGRTAEEIEKYWTSRYSTRMALALALALAQAQAQGRVVSH

SEQ ID NO: 983 - protein, 156 aa, Arabidopsis thaliana
  misc_feature (1)..(156): Ceres CLONE ID no. 25796
  misc_feature (13)..(82): Pfam Name: DnaJ Pfam Description: DnaJ domain
  misc_feature: Phenotype: WHOLE PLANT - Small Useful for modulating plant size
  misc_feature: Phenotype: ROSETTE LEAVES - Serrate Margins Useful for making plants with increased biomass and foliage
MACEGGGSNVRSSYYTVLGIRKDASVSDIRTAYRKLAMKWHPDRYARNPGVAGEAKRRFQQIQEAYSVLNDENKRSMYDVGLYDPHEDDDDDFCDFMQEMISMMNNVKDEGESLEDLQRMFTDMVGGDGVSYDCNNNPKGSKRPRVNVSRSSAAMR

SEQ ID NO: 984 - DNA, 642 bp, Populus balsamifera subsp. trichocarpa
  misc_feature (1)..(642): Ceres ANNOT ID no. 1522583
  misc_feature 104527:<222: Transcription Factor
  misc_feature: Phenotype: WHOLE PLANT - Small Useful for modulating plant size
  misc_feature: Phenotype: ROSETTE LEAVES - Serrate Margins Useful for making plants with increased biomass and foliage
atggatagagaaggaggatccaaaggcggatcttgctactacacgattcttggtattcgtagggatgcctccttctctgatatccgttctgcttacagaaaacttgccatgaaatggcatcctgataagtgggctcaaaatcaaagtcctggggtcggcggagaagccaaacggcggttccagcgggttcaagaggcttattccgttttatctgatcaatttaagaggtcaatgtacgatgctgggctttacgatcctctggaggaagaagacgaggagttttgtgatttcatgcaagagatgatctctatgatgaacagtgtgaaagatgagggagatagttttgaagatctgcagaagatgtttatggaaatggtgggtgggaatggcatggactttaacctcaatgatgaccagacgagtatgaagagggcacgtgtcaatgcattgaaagtacgtttaaagggtgaactggcccagacgatcagatcagcttcagttttgtcaggccctgaaaagctgcgtcttgaaccatcagagccaactactttcagggtccaatgcacaggaagaggaatagaaaaactgaggccgacttctgccgagacaggtagcgcagagctcgtactcgattgtctttaa

SEQ ID NO: 985 - protein, 213 aa, Populus balsamifera subsp. trichocarpa
  misc_feature (1)..(213): Ceres ANNOT ID no. 1522583
  misc_feature (12)..(83): Pfam Name: DnaJ Pfam Description: DnaJ domain
  misc_feature: SWISSPROT Homolog: DNAJ1_THET8 Chaperone protein dnaJ 1 with e-value of 2.8e-17 and BLAST sequence identity of 41.0
  misc_feature: SWISSPROT Homolog: DNAJ_THET2 Chaperone protein dnaJ with e-value of 2.8e-17 and BLAST sequence identity of 41.0
  misc_feature: SWISSPROT Homolog: DNAJ_CHLPN Chaperone protein dnaJ with e-value of 3.0e-16 and BLAST sequence identity of 54.5
  misc_feature: SWISSPROT Homolog: DNJB3_MACFU DnaJ homolog subfamily B member 3 (Spermatogenic cell-specific DNAJ homolog) with e-value of 4.5e-16 and BLAST sequence identity of 38.0
  misc_feature: SWISSPROT Homolog: DNJB8_MOUSE DnaJ homolog subfamily B member 8 (mDJ6) with e-value of 4.5e-16 and BLAST sequence identity of 52.9
  misc_feature 104624:<222: Transcription Factor
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(213): Functional Homolog of  Ceres CLONE ID no. 25796 at SEQ ID NO. 1019 with e-value of 1.10E-52 and BLAST sequence identity of 70.4
MDREGGSKGGSCYYTILGIRRDASFSDIRSAYRKLAMKWHPDKWAQNQSPGVGGEAKRRFQRVQEAYSVLSDQFKRSMYDAGLYDPLEEEDEEFCDFMQEMISMMNSVKDEGDSFEDLQKMFMEMVGGNGMDFNLNDDQTSMKRARVNALKVRLKGELAQTIRSASVLSGPEKLRLEPSEPTTFRVQCTGRGIEKLRPTSAETGSAELVLDCL

SEQ ID NO: 986 - protein, 109 aa, Arabidopsis thaliana
  misc_feature (1)..(109): Ceres CLONE ID no. 25886
  misc_feature (2)..(108): Pfam Name: Profilin Pfam Description: Profilin
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
  misc_feature (87)..(87): Xaa is any aa, unknown, or other
MSWQSYVDDHLMCEVEGNHLTHAAIFGQDGSVWAQSSAFPQLKPAEIAGINKDFEEAGHLAPTGLFLGGEKYMVVQGEAGAVIRGKXGPGGVTIKKTTQALVFGIYDER

SEQ ID NO: 987 - DNA, 396 bp, Populus balsamifera subsp. trichocarpa
  misc_feature (1)..(396): Ceres ANNOT ID no. 1446650
  misc_feature 104788:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
atgtcgtggcaaacatacgttgatgatcacctgatgtgcgacatcgagggtaaccatctgacggctgccgccatcatcggccaagatggcagtgtgtgggctcagagcgccactttccctcagtataagcctgaggagatttctgccatcatgaaagattttgatgaacctggatctctagccccaactgggttgcacattggtggcacaaagtacatggtgatccagggagagcctggagctgtgattcgtggaaagaagggttctggtggcatcactgtgaagaaaaccgcccaagctcttatttttggtatttatgatgagccattgactccaggacagtgtaacatgatagttgagaggttgggtgattacctccttgatcagggcctgtag

SEQ ID NO: 988 - protein, 131 aa, Populus balsamifera subsp. trichocarpa
  misc_feature (1)..(131): Ceres ANNOT ID no. 1446650
  misc_feature (2)..(126): Pfam Name: Profilin Pfam Description: Profilin
  misc_feature: SWISSPROT Homolog: PROF2_ARATH Profilin-2 with e-value of 4.6e-55 and BLAST sequence identity of 99.1
  misc_feature: SWISSPROT Homolog: PROF1_ARATH Profilin-1 (Allergen Ara t 8) with e-value of 2.5e-47 and BLAST sequence identity of 86.1
  misc_feature: SWISSPROT Homolog: PROF_FRAAN Profilin (Allergen Fra a 4) with e-value of 3.7e-44 and BLAST sequence identity of 77.8
  misc_feature: SWISSPROT Homolog: PROF1_PHAVU Profilin-1 with e-value of 1.3e-43 and BLAST sequence identity of 75.9
  misc_feature: SWISSPROT Homolog: PROF1_RICCO Profilin-1 with e-value of 1.3e-43 and BLAST sequence identity of 77.8
  misc_feature 104898:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
  misc_feature (1)..(131): Functional Homolog of  Ceres CLONE ID no. 25886 at SEQ ID NO. 1022 with e-value of 2.29E-43 and BLAST sequence identity of 75.9
MSWQTYVDDHLMCDIEGNHLTAAAIIGQDGSVWAQSATFPQYKPEEISAIMKDFDEPGSLAPTGLHIGGTKYMVIQGEPGAVIRGKKGSGGITVKKTAQALIFGIYDEPLTPGQCNMIVERLGDYLLDQGL

SEQ ID NO: 989 - DNA, 396 bp, Populus balsamifera subsp. trichocarpa
  misc_feature (1)..(396): Ceres ANNOT ID no. 1439514
  misc_feature 104986:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
atgtcgtggcaaacatacgttgatgaccatctgatgtgcgaaatcgagggcaaccatctgacggctgccgccattatcggccatgatggcagtgtgtgggcccagagcgccaccttcccccagtttaagcctgaggagatatctgccatcatgaaagattttgatgaacctggatctcttgccccaactgggttgcaccttggtggcacaaagtacatggtgatccagggagagcctggagctgtgatccgtggaaagaagggttctggtggcgtcactgtgaagaaaacctcccaagctcttgttattggtctttatgatgagccattgactccaggacagtgtaacatgatagttgagaggttgggtgattacctcattgatcaggacctgtag

SEQ ID NO: 990 - protein, 131 aa, Populus balsamifera subsp. trichocarpa
  misc_feature (1)..(131): Ceres ANNOT ID no. 1439514
  misc_feature (2)..(126): Pfam Name: Profilin Pfam Description: Profilin
  misc_feature: SWISSPROT Homolog: PROF2_ARATH Profilin-2 with e-value of 4.6e-55 and BLAST sequence identity of 99.1
  misc_feature: SWISSPROT Homolog: PROF1_ARATH Profilin-1 (Allergen Ara t 8) with e-value of 2.5e-47 and BLAST sequence identity of 86.1
  misc_feature: SWISSPROT Homolog: PROF_FRAAN Profilin (Allergen Fra a 4) with e-value of 3.7e-44 and BLAST sequence identity of 77.8
  misc_feature: SWISSPROT Homolog: PROF1_PHAVU Profilin-1 with e-value of 1.3e-43 and BLAST sequence identity of 75.9
  misc_feature: SWISSPROT Homolog: PROF1_RICCO Profilin-1 with e-value of 1.3e-43 and BLAST sequence identity of 77.8
  misc_feature 105096:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
  misc_feature (1)..(131): Functional Homolog of  Ceres CLONE ID no. 25886 at SEQ ID NO. 1022 with e-value of 6.00E-43 and BLAST sequence identity of 76.8
MSWQTYVDDHLMCEIEGNHLTAAAIIGHDGSVWAQSATFPQFKPEEISAIMKDFDEPGSLAPTGLHLGGTKYMVIQGEPGAVIRGKKGSGGVTVKKTSQALVIGLYDEPLTPGQCNMIVERLGDYLIDQDL

SEQ ID NO: 991 - DNA, 426 bp, Populus balsamifera subsp. trichocarpa
  misc_feature (1)..(426): Ceres ANNOT ID no. 1477202
  misc_feature 105184:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
atgtcgtggcaggtgtacgttgatgaccacttgatgtgtgacatcgagggtaataccctcacttccgctgccatcatcggccacgacggcagcgtttgggccctaagcgcctccttccctcagttcacccaagaagaagtgagcgcgatcatgaaagattttgaggaacctggatctcttgcaccaactgggttgttccttggtggcaccaagtacatggtgatccaaggcgaacctggagctgttatccgaggaaagaagtcaatgttatatttaacagatttgctccatggttctggtggtgtcactgtcaagaagaccaatcaggcactgataattggcgtgtatgatgagcctctaactcccggtcaatgcaacatgattgtggaaaggcttggtgattatctaattgatcagggcctttag

SEQ ID NO: 992 - protein, 141 aa, Populus balsamifera subsp. trichocarpa
  misc_feature (1)..(141): Ceres ANNOT ID no. 1477202
  misc_feature (2)..(136): Pfam Name: Profilin Pfam Description: Profilin
  misc_feature: SWISSPROT Homolog: PROF2_ARATH Profilin-2 with e-value of 4.6e-55 and BLAST sequence identity of 99.1
  misc_feature: SWISSPROT Homolog: PROF1_ARATH Profilin-1 (Allergen Ara t 8) with e-value of 2.5e-47 and BLAST sequence identity of 86.1
  misc_feature: SWISSPROT Homolog: PROF_FRAAN Profilin (Allergen Fra a 4) with e-value of 3.7e-44 and BLAST sequence identity of 77.8
  misc_feature: SWISSPROT Homolog: PROF1_PHAVU Profilin-1 with e-value of 1.3e-43 and BLAST sequence identity of 75.9
  misc_feature: SWISSPROT Homolog: PROF1_RICCO Profilin-1 with e-value of 1.3e-43 and BLAST sequence identity of 77.8
  misc_feature 105296:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
  misc_feature (1)..(141): Functional Homolog of  Ceres CLONE ID no. 25886 at SEQ ID NO. 1022 with e-value of 3.20E-37 and BLAST sequence identity of 72.2
MSWQVYVDDHLMCDIEGNTLTSAAIIGHDGSVWALSASFPQFTQEEVSAIMKDFEEPGSLAPTGLFLGGTKYMVIQGEPGAVIRGKKSMLYLTDLLHGSGGVTVKKTNQALIIGVYDEPLTPGQCNMIVERLGDYLIDQGL

SEQ ID NO: 993 - DNA, 447 bp, Populus balsamifera subsp. trichocarpa
  misc_feature (1)..(447): Ceres ANNOT ID no. 1455325
  misc_feature 105384:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
atgtcgtggcagcagtacgttgatgagcacttgatgtgcgatattgacggtaataccctcacttccgctgctatcatcggccatgacggtagcgtctgggctcaaagcgctaccttccctcaggttttatttcatccagttcttaatttctccgatctggttcagatcggattgtttactgcagaagaagtggctgcgattatgaaagattttgatgaacctggatctcttgcaccaacggggttgttccttggtggcgctaagtacatggtgatccagggtgaagctggagctgttattcgaggaaagaagggttccggcggtgtcaccatcaagaagaccaatcaggcacttgtcattggtgtgtatgacgagcctctagctcccggtcaatgcaacatgattgtggagaggcttggtgattatctatatgaccagggtctttag

SEQ ID NO: 994 - protein, 148 aa, Populus balsamifera subsp. trichocarpa
  misc_feature (1)..(148): Ceres ANNOT ID no. 1455325
  misc_feature (2)..(143): Pfam Name: Profilin Pfam Description: Profilin
  misc_feature: SWISSPROT Homolog: PROF2_ARATH Profilin-2 with e-value of 4.6e-55 and BLAST sequence identity of 99.1
  misc_feature: SWISSPROT Homolog: PROF1_ARATH Profilin-1 (Allergen Ara t 8) with e-value of 2.5e-47 and BLAST sequence identity of 86.1
  misc_feature: SWISSPROT Homolog: PROF_FRAAN Profilin (Allergen Fra a 4) with e-value of 3.7e-44 and BLAST sequence identity of 77.8
  misc_feature: SWISSPROT Homolog: PROF1_PHAVU Profilin-1 with e-value of 1.3e-43 and BLAST sequence identity of 75.9
  misc_feature: SWISSPROT Homolog: PROF1_RICCO Profilin-1 with e-value of 1.3e-43 and BLAST sequence identity of 77.8
  misc_feature 105496:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Other Useful for making ornamental plants with modified flowers
  misc_feature (1)..(148): Functional Homolog of  Ceres CLONE ID no. 25886 at SEQ ID NO. 1022 with e-value of 6.60E-37 and BLAST sequence identity of 75.0
MSWQQYVDEHLMCDIDGNTLTSAAIIGHDGSVWAQSATFPQVLFHPVLNFSDLVQIGLFTAEEVAAIMKDFDEPGSLAPTGLFLGGAKYMVIQGEAGAVIRGKKGSGGVTIKKTNQALVIGVYDEPLAPGQCNMIVERLGDYLYDQGL

SEQ ID NO: 995 - protein, 263 aa, Arabidopsis thaliana
  misc_feature (1)..(263): Ceres CLONE ID no. 26006
  misc_feature (212)..(257): Pfam Name: Abhydrolase_1 Pfam Description: alpha/beta hydrolase fold
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQVLSDHLLAIADNFS

SEQ ID NO: 996 - DNA, 792 bp, Populus balsamifera subsp. trichocarpa
  misc_feature (1)..(792): Ceres ANNOT ID no. 1457048
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 105754:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atggtagagaccaagaatcagaagcattttgttctagtacatggagcttgccatggggcttggtgctggcaaaagttcaaaacgctgcttgagtcagcaagtaacagggtcacggtgcttgaccttgctgcttcaggcgccaacatgaaggcaatccaagatgtagaaacacttgatgaatatacggagcctttgttagagtttctggcctcattacaaccgaaggagaaggtcattctagtagggcacagcctaggaggtttgagtttggctcttgctatggaaaagttcccagagaagattgctgttgctgttttcttatcagctttcatgccagataccacacacaagccatcatttgtcttggatcagtataacgagaggaccccggcggattcctggttggacactcaatttttaccatacagcagttctcaaagtcatctcacaacaatgtcttttggacccaaattcttatcctccaagctctatcagctaagcccacctgaggatcttgagcaagcaaagactatggtaaggccaggatcactgtttctgtatgatttgtcaaaggcaaacagtttctccacgacgggctatgggtcagtcaaacgagtgtatgttatctgcgatgaagatttagcgataccagaagagtttcaacgctggatgattgaaaacagtgctgttgaagaagttatggaaattgaaggtgcagaccatatggttatgttcagcaagccacaagaactcttccattgtctctcagagatagcaaataaacatgcttaa

SEQ ID NO: 997 - protein, 263 aa, Populus balsamifera subsp. trichocarpa
  misc_feature (1)..(263): Ceres ANNOT ID no. 1457048
  misc_feature (35)..(257): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 105918:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(263): Functional Homolog of  Ceres CLONE ID no. 26006 at SEQ ID NO. 1031 with e-value of 1.70E-70 and BLAST sequence identity of 53.2
MVETKNQKHFVLVHGACHGAWCWQKFKTLLESASNRVTVLDLAASGANMKAIQDVETLDEYTEPLLEFLASLQPKEKVILVGHSLGGLSLALAMEKFPEKIAVAVFLSAFMPDTTHKPSFVLDQYNERTPADSWLDTQFLPYSSSQSHLTTMSFGPKFLSSKLYQLSPPEDLEQAKTMVRPGSLFLYDLSKANSFSTTGYGSVKRVYVICDEDLAIPEEFQRWMIENSAVEEVMEIEGADHMVMFSKPQELFHCLSEIANKHA

SEQ ID NO: 998 - DNA, 792 bp, Populus balsamifera subsp. trichocarpa
  misc_feature (1)..(792): Ceres ANNOT ID no. 1510252
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106060:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atggtagagaccaagaatcaggagcattttgttctagtacatggagcttgccatggggcttggtgctggcaaaagttcaaaacgctgcttgagtcagcaagtaacagggtcacggtgcttgaccttgctgcttcaggcgccaacatgaaggcaatccaagatgtagaaacacttgatgaatatacggagcctttgttagagtttctggcctcattacaaccgaaggagaaggtcattctagtagggcacagcctaggaggtttgagtttggctcttgctatggaaaagttcccagagaagattgctgttgctgttttcttatcagctttcatgccagataccacacacaagccatcatttgtcttggatcagtataacgagaggaccccggcggattcctggttggacactcaatttttaccatacagcagttctcaaagtcatctcacaacaatgtcttttggacccaaattcttatcctccaagctctatcagctaagcccacctgaggatcttgagcaagcaaaaactttggtaaggccaggatcaatgtttctggatgatttgtcaaaggcaaacagtttctccacgacgggctatgggtcagtcaaacgagtatatgttatctttgacaaagatttagcgataccagtagagtttcaacgctggatgattgaaaacagtgctgttgaagaagttatggaaattgaaggtgcagaccatatggttatgttcagcaagccacaagaactcttccattgtctctcagagatagcaaataaacatgcttaa

SEQ ID NO: 999 - protein, 263 aa, Populus balsamifera subsp. trichocarpa
  misc_feature (1)..(263): Ceres ANNOT ID no. 1510252
  misc_feature (35)..(257): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106224:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(263): Functional Homolog of  Ceres CLONE ID no. 26006 at SEQ ID NO. 1031 with e-value of 1.39E-68 and BLAST sequence identity of 52.1
MVETKNQEHFVLVHGACHGAWCWQKFKTLLESASNRVTVLDLAASGANMKAIQDVETLDEYTEPLLEFLASLQPKEKVILVGHSLGGLSLALAMEKFPEKIAVAVFLSAFMPDTTHKPSFVLDQYNERTPADSWLDTQFLPYSSSQSHLTTMSFGPKFLSSKLYQLSPPEDLEQAKTLVRPGSMFLDDLSKANSFSTTGYGSVKRVYVIFDKDLAIPVEFQRWMIENSAVEEVMEIEGADHMVMFSKPQELFHCLSEIANKHA

SEQ ID NO: 1000 - DNA, 795 bp, Populus balsamifera subsp. trichocarpa
  misc_feature (1)..(795): Ceres ANNOT ID no. 1451281
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106366:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atgggagaggtcaacaatcaaaaacagcattttgttttgatccatggttcagttgcaggagcttggatatggtacaaggtcaagccaaggctagaggaagctggccaccgtgtcacagctcttgacatggctgcatcaggggtgaacacacaaaaaattgaagaagttcgcacttttgatcagtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgatacggtgcaccagccatcttatatgttagaaaagtttgctgaaatcggtcccaagggagaagagtggcaagacactctgttttcattccatggaacccctgaagaaccgcatacatgtgttcacatgggatgcgagtttatgaagtgcaagccctttcatctttcctccgctgaggatctagctctgcagatgctcttaaatagaccaggatcgatgtttgtggaaagcctgtccaaggcaaagaagttcactgatgagagatatggatcagtgccgcgagtttatattgtttgtactgaggatttaatgatgcctgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 1001 - protein, 264 aa, Populus balsamifera subsp. trichocarpa
  misc_feature (1)..(264): Ceres ANNOT ID no. 1451281
  misc_feature (201)..(258): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106530:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(264): Functional Homolog of  Ceres CLONE ID no. 26006 at SEQ ID NO. 1031 with e-value of 2.09E-65 and BLAST sequence identity of 51.5
MGEVNNQKQHFVLIHGSVAGAWIWYKVKPRLEEAGHRVTALDMAASGVNTQKIEEVRTFDQYNEPLMEFMAKLPENEKVVLVGHSLGGLNLAFAMEKFPEKVSLAVFLTAILPDTVHQPSYMLEKFAEIGPKGEEWQDTLFSFHGTPEEPHTCVHMGCEFMKCKPFHLSSAEDLALQMLLNRPGSMFVESLSKAKKFTDERYGSVPRVYIVCTEDLMMPASFQRWMIEQNGVKEVMEIPADHMPVFSTPTELCHSILELARKHA

SEQ ID NO: 1002 - DNA, 795 bp, Populus balsamifera subsp. trichocarpa
  misc_feature (1)..(795): Ceres ANNOT ID no. 1451282
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106672:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atgggagaggtcaacaatcaaaaaaagcattttgttttgatccatggttcagttgcaggagcttggatatggtacaaggtcaagccaaggctagaggaagctggccaccgagtcacagctcttgacatggctgcatcaggggtgaacacaaaaacaattgaagaagttcgcactttcgatctgtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgataccgtgcaccagccatcttatatgttagaaaagtttgctgaaatcggtcccagggacgaagaatggcaagacactctgttttcattccatggaacccctgaagaaccgcatacatgtgttcatatgggttgcgagtttatgaagtgcaagccctttcatctttcctccgctgaggatctcgctctgcagatgctcttaaatagaccaggatcgatgtttgtggaaagcctgtccaaggcaaagaagttcactgatgagagatatggatcagtgccgcgagtttatattgtttgtactgaggatttaatgatgcttgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 1003 - protein, 264 aa, Populus balsamifera subsp. trichocarpa
  misc_feature (1)..(264): Ceres ANNOT ID no. 1451282
  misc_feature (201)..(258): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106836:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(264): Functional Homolog of  Ceres CLONE ID no. 26006 at SEQ ID NO. 1031 with e-value of 4.90E-64 and BLAST sequence identity of 50.1
MGEVNNQKKHFVLIHGSVAGAWIWYKVKPRLEEAGHRVTALDMAASGVNTKTIEEVRTFDLYNEPLMEFMAKLPENEKVVLVGHSLGGLNLAFAMEKFPEKVSLAVFLTAILPDTVHQPSYMLEKFAEIGPRDEEWQDTLFSFHGTPEEPHTCVHMGCEFMKCKPFHLSSAEDLALQMLLNRPGSMFVESLSKAKKFTDERYGSVPRVYIVCTEDLMMLASFQRWMIEQNGVKEVMEIPADHMPVFSTPTELCHSILELARKHA

SEQ ID NO: 1004 - DNA, 780 bp, Populus balsamifera subsp. trichocarpa
  misc_feature (1)..(780): Ceres ANNOT ID no. 1504349
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 106978:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atgggagaggtcaacaatcaaaaaaagcattttgttttgatccatggttcagttgcaggagcttggatatggtacaaggtcaagccaaggctagaggaagctggccaccgagtcacagctcttgacatggctgcatcaggggtgaacacaaaaacaattgaagaagttcgcactttcgatctgtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgataccgtgcaccagccatcttatatgttagaaaagtttgctgaaatcggtcccagggacgaagaatggcaagacactctgttttcattccatggaacccctgaagaaccgcatacatgtgttcatatgggttgcgagtttatgaagtgcaagccctttcatctttcctccgctgagatgctcttaaatagaccaggatcgatgtttgtggaaagcctgtccaaggcaaagaagttcactgatgagagatatggatcagtgccgcgagtttatattgtttgtactgaggatttaatgatgcttgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 1005 - protein, 259 aa, Populus balsamifera subsp. trichocarpa
  misc_feature (1)..(259): Ceres ANNOT ID no. 1504349
  misc_feature (196)..(253): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 107142:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(259): Functional Homolog of  Ceres CLONE ID no. 26006 at SEQ ID NO. 1031 with e-value of 4.59E-61 and BLAST sequence identity of 50.0
MGEVNNQKKHFVLIHGSVAGAWIWYKVKPRLEEAGHRVTALDMAASGVNTKTIEEVRTFDLYNEPLMEFMAKLPENEKVVLVGHSLGGLNLAFAMEKFPEKVSLAVFLTAILPDTVHQPSYMLEKFAEIGPRDEEWQDTLFSFHGTPEEPHTCVHMGCEFMKCKPFHLSSAEMLLNRPGSMFVESLSKAKKFTDERYGSVPRVYIVCTEDLMMLASFQRWMIEQNGVKEVMEIPADHMPVFSTPTELCHSILELARKHA

SEQ ID NO: 1006 - DNA, 738 bp, Populus balsamifera subsp. trichocarpa
  misc_feature (1)..(738): Ceres ANNOT ID no. 1465987
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 107284:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atgggagacatcaacaaccaagcagcccatcttgttttaatacacggttcttccgcaggagcttgggtgtggtacaaggtgaagccaatgctagaggcagccggccacagcatcacagctcttgacatgagtgcatcaggggtgaacacaaaaacactcgaagaagttcgaacttttgaccagtataacgagcccttgattgagttcatggccaacttacctgaaaatgaaaaggttgtattggtgggccatagtttgggtggcttgaacctggccttcgccatggagaagttcccagagaagatttctcttgctgtttttgttactgcaatcttgcctgatactcagcaccagccatcgtatatgttagagaagtttattgaaagcatttccggtgcagacgaagagcaagacactgcagtggtttcatccacgccgtttcagctcaccccaattgaggatcttactctccaagcgcttttaaacagaccaggatcaatgttcgttgaaagtctgtccaaagcaaacaagttcactgaagacagatatggatccgttccccgagtttatattgtctgtactgaggatatattgctttctccgtcgttgcaacgctacatgattgaacaaaatgaggttaaggaagtgatggagattcctgcagatcatatggcagtcttttctaagcctaaggaactcagccagtgcatactggagttggcacagaagcacgcttag

SEQ ID NO: 1007 - protein, 245 aa, Populus balsamifera subsp. trichocarpa
  misc_feature (1)..(245): Ceres ANNOT ID no. 1465987
  misc_feature (36)..(239): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 107446:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(245): Functional Homolog of  Ceres CLONE ID no. 26006 at SEQ ID NO. 1031 with e-value of 1.59E-60 and BLAST sequence identity of 54.7
MGDINNQAAHLVLIHGSSAGAWVWYKVKPMLEAAGHSITALDMSASGVNTKTLEEVRTFDQYNEPLIEFMANLPENEKVVLVGHSLGGLNLAFAMEKFPEKISLAVFVTAILPDTQHQPSYMLEKFIESISGADEEQDTAVVSSTPFQLTPIEDLTLQALLNRPGSMFVESLSKANKFTEDRYGSVPRVYIVCTEDILLSPSLQRYMIEQNEVKEVMEIPADHMAVFSKPKELSQCILELAQKHA

SEQ ID NO: 1008 - DNA, 735 bp, Populus balsamifera subsp. trichocarpa
  misc_feature (1)..(735): Ceres ANNOT ID no. 1451283
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 107585:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
atgggagacatcaacaaccaagcaacccgtctcgttttaatacacggttcttccgcaggagcttgggtatggtacaaggtgaagccaatgctagaggcagctgggcacagcatcacagctcttgacatgagtgcgtcaggggtgaacacaaaaacactcgaggaagttcgaacttttgaccagtataacgagcccttgattgagttcatggccaacttgcctgaaaatgaaaaggttgtgttggtgggccatagtttgggtggcttaaacctggccttcgctatggagaagttcccagagaagatttctcttgctatttttgttactgcaatcatgcctgatactcagcaccagccatcgtatatgttagagaagtttactgaaagcatttccggtgcagacgaagagcaagacactgcagtttcatccacgccgtttcagctcaccccaattgaggatcttactctccaagcgcttttaaacagaccaggatcaacgttcgttgaaagtctgtccaaagcaaacaagttcactgaagacagatatggatcagttccccgagtatatattgtctgtactgaggatatattgctttctccgtcgttgcaacgcttcatgattgaacaaaatgaggttaaggaagtgatggagattcctgcagatcatatggcagttttttctaagcctaaggaactcagccagtgcatactggaattggcgcaaaagcacgcttag

SEQ ID NO: 1009 - protein, 244 aa, Populus balsamifera subsp. trichocarpa
  misc_feature (1)..(244): Ceres ANNOT ID no. 1451283
  misc_feature (181)..(238): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 6.4e-65 and BLAST sequence identity of 48.8
  misc_feature: SWISSPROT Homolog: HNL_HEVBR S-acetone-cyanohydrin lyase with e-value of 2.3e-53 and BLAST sequence identity of 43.0
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: PIR7B_ORYSA Putative esterase PIR7B (EC 3.1.-.-) with e-value of 1.1e-51 and BLAST sequence identity of 42.9
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.9e-49 and BLAST sequence identity of 40.5
  misc_feature: SWISSPROT Homolog: PIR7A_ORYSA Putative esterase PIR7A (EC 3.1.-.-) with e-value of 3.2e-47 and BLAST sequence identity of 41.7
  misc_feature: Utility: pH (high) Useful for making plants tolerant to high pH or low phosphate
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Utility: PEG Useful for making plants with increased tolerance to drought
  misc_feature 107747:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature: Phenotype: WHOLE PLANT - Soil Drought Useful for making plants with increased tolerance to drought
  misc_feature: Phenotype: WHOLE PLANT - pH (high) Useful for making plants tolerant to high pH or low phosphate
  misc_feature (1)..(244): Functional Homolog of  Ceres CLONE ID no. 26006 at SEQ ID NO. 1031 with e-value of 2.90E-59 and BLAST sequence identity of 54.1
MGDINNQATRLVLIHGSSAGAWVWYKVKPMLEAAGHSITALDMSASGVNTKTLEEVRTFDQYNEPLIEFMANLPENEKVVLVGHSLGGLNLAFAMEKFPEKISLAIFVTAIMPDTQHQPSYMLEKFTESISGADEEQDTAVSSTPFQLTPIEDLTLQALLNRPGSTFVESLSKANKFTEDRYGSVPRVYIVCTEDILLSPSLQRFMIEQNEVKEVMEIPADHMAVFSKPKELSQCILELAQKHA

SEQ ID NO: 1010 - protein, 407 aa, Arabidopsis thaliana
  misc_feature (1)..(407): Ceres CLONE ID no. 26542
  misc_feature (26)..(270): Pfam Name: Ribosomal_L4 Pfam Description: Ribosomal protein L4/L1 family
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
MVASAAARPLVTVQGLDGDMSTDQSTTVTLPDVMTAPVRPDIVNFVHAQISNNSRQPYAVSKKAGHQTSAESWGTGRAVSRIPRVPGGGTHRAGQAAFGNMCRGGRMFAPTKIWRRWHRRVNVNMKRHAIVSAIAATAVPALVMARGHKIENVPEMPLVVSDSAEAVEKTSAAIKVLKQIGAYDDAEKAKNSIGIRPGKGKMRNRRYISRKGPLVVFGTEGAKIVKAFRNLPGVELCHVERLNLLKLAPGGHLGRFVIWTKSAFEKLESIYGSFEKPSEKKKGYVLPRAKMVNADLARIINSDEVQSVVNPIKDGSKRAVLKKNPLKNLNVMFKLNPYAKTAKRMSLLAEASRVKAKKEKLEKKRKVVTKEEAQAIKAAGKAWYQTMISDSDYTEFDNFTKWLGASQ

SEQ ID NO: 1011 - DNA, 1224 bp, Populus balsamifera subsp. trichocarpa
  misc_feature (1)..(1224): Ceres ANNOT ID no. 1475323
  misc_feature 107983:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggccgccgccgcacgccccctggtctctgttcaaaccctcccctgcctcaacgacatggtcacggattcggctgccaccgtggctctccccgatgtcatgaaggcctcgatccgaccagacatcgtcaactacgtccactcaaacatctccaagaatagccgccagccttatgccgtctccaagaaagccggtcaccagacctcagccgaatcatggggtactggtcgtgccgtttctcgtatcccccgtgttcctggtggtggaactcaccgtgctggtcagggagcttacggaaatatgtgccgtggtggacgcatgtttgctcccaccaagatctggcgccgctggcataggaagattaatgtgaaccaaaagagatacgctgtcgtttcagctattgctgcatctgctataccctctctggtgatggcacgtggtcaccgcgtggagtcagtccccgagatgcctttgattatctccgactcagccgagagcattgaaaagacatctactgctattaaggtgctcaaggagatcggtgcttttccagatgctgagaaagctaaggattctcacgcgatccggcctggaaaggggaaaatgaggaacaggaggtatatttctcgcaagggacccctgattgtttatggaaccgaaggtgctaagatggttaaggccttccgtaatattccaggagtggaggttgctaacgttgagaggttgaacttgttgaagttggctcctggtggtcatcttggaaggtttgtgatctggacgaaatcagctattgagaagcttgattcaatttatggttcatttgagaagtgttcagagaagaagaaggggtatgtgctgcctaggtccaagatggtcaatgctgatttggctaggatcatcaactctgatgaggttcagagtgttgtgaagccaatcaagagggaggttaagagggctactttgaagaagaacccattgaagaacttgaatgtgttgttgaaattgaacccatatgctaagactgctaggaggatggctcttttggccgaggcagagcgtgtgaagtctaagaaggagaagctcgacaggaagaggaagcctgtctcaaaggaggagctagccgctgccaaggctgcaggaaaggcatggtacaagacaatgatctcagacagcgattacacagagtttgagaatttcacaaagtggcttggtgtctctcagtaa

SEQ ID NO: 1012 - protein, 407 aa, Populus balsamifera subsp. trichocarpa
  misc_feature (1)..(407): Ceres ANNOT ID no. 1475323
  misc_feature (26)..(270): Pfam Name: Ribosomal_L4 Pfam Description: Ribosomal protein L4/L1 family
  misc_feature: SWISSPROT Homolog: RL4A_ARATH 60S ribosomal protein L4-1 (L1) with e-value of 4.4e-215 and BLAST sequence identity of 100.0
  misc_feature: SWISSPROT Homolog: RL4B_ARATH 60S ribosomal protein L4-2 (L1) with e-value of 7.3e-206 and BLAST sequence identity of 95.3
  misc_feature: SWISSPROT Homolog: RL4_PRUAR 60S ribosomal protein L4 (L1) with e-value of 7.0e-185 and BLAST sequence identity of 83.7
  misc_feature: SWISSPROT Homolog: RL4_URECA 60S ribosomal protein L4 (L1) with e-value of 8.4e-118 and BLAST sequence identity of 59.2
  misc_feature: SWISSPROT Homolog: RL4_RAT 60S ribosomal protein L4 (L1) with e-value of 9.4e-116 and BLAST sequence identity of 56.3
  misc_feature 108117:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(407): Functional Homolog of  Ceres CLONE ID no. 26542 at SEQ ID NO. 1046 with e-value of 2.50E-179 and BLAST sequence identity of 81.9
MAAAARPLVSVQTLPCLNDMVTDSAATVALPDVMKASIRPDIVNYVHSNISKNSRQPYAVSKKAGHQTSAESWGTGRAVSRIPRVPGGGTHRAGQGAYGNMCRGGRMFAPTKIWRRWHRKINVNQKRYAVVSAIAASAIPSLVMARGHRVESVPEMPLIISDSAESIEKTSTAIKVLKEIGAFPDAEKAKDSHAIRPGKGKMRNRRYISRKGPLIVYGTEGAKMVKAFRNIPGVEVANVERLNLLKLAPGGHLGRFVIWTKSAIEKLDSIYGSFEKCSEKKKGYVLPRSKMVNADLARIINSDEVQSVVKPIKREVKRATLKKNPLKNLNVLLKLNPYAKTARRMALLAEAERVKSKKEKLDRKRKPVSKEELAAAKAAGKAWYKTMISDSDYTEFENFTKWLGVSQ

SEQ ID NO: 1013 - DNA, 1227 bp, Populus balsamifera subsp. trichocarpa
  misc_feature (1)..(1227): Ceres ANNOT ID no. 1538272
  misc_feature 108249:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggccgccgccgcccgcccccttgtctccgttcaacctctacccgcgtccctcaatgacatggccactgattctgtcacgaccgtggctctccccgatgtcatgaaggcctcaatcagaccagacatcgtcaattatgtccactccaacatctccaagaacagccgtcaaccttacgccgtctcgaagaaggccggccaccagacctcagccgaatcttggggtaccggtcgtgccgtttctcgtatcccccgtgtttctggtggtggaactcaccgtgctggtcagggagcttttggaaacatgtgccgtggtggacgcatgtttgctcctaccaagacctggcgccgctggcataggaagattaacgtcaaccaaaagcgatacgccgtcgtttcagctattgctgcctctgctattccttctttggtgatggcacgcggtcaccgggtggagtcagtccctgagatgcctttggttatctctgattcggccgagagcattgaaaaaacatccactgctattaaggtgctgaaggaaattggtgcttatccagatgccgagaaggccaaggattctcaagcgatccgggctggaaagggaaaaatgaggaacaggaggtacatttcccgcaagggacccctgatcgtgtatggaactgaaggtgctaagttggtgaaggccttccgtaacattccaggagtggaggtggctaacgttgagaggctgaacttgttgaggctggctcccggcggtcatcttggaaggtttgtgatctggacaaaatcagctatcgagaagcttgattcaatatatgggacttttgacaagtcttccgagaagaagaagggttatgtgctgcctaggaccaagatggtcaatgctgatttggccaggatcatcaactctgacgaggttcagagcgttgtgaatccaatcaagaaggaggttaagagggcacctttgaagaagaacccactgaagaacttgaacgtgatgctgaaattgaatccatatgctaagactgctaggaggatggcccttctggctgaagcagagcgcgtgaagtccaagaaggagaagctcgacaggaagaggaaacctgtgtcgaaggaggagctagctgctgctaaggctgcaggaaaggcttggtacaagaccatgatttctgacagcgattacaccgagttcgagaatttcaccaagtggcttggtgtctcccagtga

SEQ ID NO: 1014 - protein, 408 aa, Populus balsamifera subsp. trichocarpa
  misc_feature (1)..(408): Ceres ANNOT ID no. 1538272
  misc_feature (27)..(271): Pfam Name: Ribosomal_L4 Pfam Description: Ribosomal protein L4/L1 family
  misc_feature: SWISSPROT Homolog: RL4A_ARATH 60S ribosomal protein L4-1 (L1) with e-value of 4.4e-215 and BLAST sequence identity of 100.0
  misc_feature: SWISSPROT Homolog: RL4B_ARATH 60S ribosomal protein L4-2 (L1) with e-value of 7.3e-206 and BLAST sequence identity of 95.3
  misc_feature: SWISSPROT Homolog: RL4_PRUAR 60S ribosomal protein L4 (L1) with e-value of 7.0e-185 and BLAST sequence identity of 83.7
  misc_feature: SWISSPROT Homolog: RL4_URECA 60S ribosomal protein L4 (L1) with e-value of 8.4e-118 and BLAST sequence identity of 59.2
  misc_feature: SWISSPROT Homolog: RL4_RAT 60S ribosomal protein L4 (L1) with e-value of 9.4e-116 and BLAST sequence identity of 56.3
  misc_feature 108383:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(408): Functional Homolog of  Ceres CLONE ID no. 26542 at SEQ ID NO. 1046 with e-value of 2.30E-178 and BLAST sequence identity of 81.9
MAAAARPLVSVQPLPASLNDMATDSVTTVALPDVMKASIRPDIVNYVHSNISKNSRQPYAVSKKAGHQTSAESWGTGRAVSRIPRVSGGGTHRAGQGAFGNMCRGGRMFAPTKTWRRWHRKINVNQKRYAVVSAIAASAIPSLVMARGHRVESVPEMPLVISDSAESIEKTSTAIKVLKEIGAYPDAEKAKDSQAIRAGKGKMRNRRYISRKGPLIVYGTEGAKLVKAFRNIPGVEVANVERLNLLRLAPGGHLGRFVIWTKSAIEKLDSIYGTFDKSSEKKKGYVLPRTKMVNADLARIINSDEVQSVVNPIKKEVKRAPLKKNPLKNLNVMLKLNPYAKTARRMALLAEAERVKSKKEKLDRKRKPVSKEELAAAKAAGKAWYKTMISDSDYTEFENFTKWLGVSQ

SEQ ID NO: 1015 - protein, 275 aa, Arabidopsis thaliana
  misc_feature (1)..(275): Ceres CLONE ID no. 26560
  misc_feature (1)..(98): Pfam Name: SET Pfam Description: SET domain
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
MAGSLFQQYPFDIPTEAFSFEIFKQAFVAIQSCVMHLQNVGLARRFALVPLGPPLLAYCSNCKAMLTAVDGAVELVVDRPYKAGDPIVVWCGPQPNAKLLLNYGFVDEDNPYDRVIVEAALNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTVDLLNQLPDTAISPCPAPYAPSLK

SEQ ID NO: 1016 - DNA, 1509 bp, Populus balsamifera subsp. trichocarpa
  misc_feature (1)..(1509): Ceres ANNOT ID no. 1536088
  misc_feature 108625:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
atggaattcacttgtttacacaacaaatgcatttcaccttctcttactgttctctctagggtttcaatttcattttccaatcttcctaaacgcgccgtttcatttcaccggcggcggagaaatttgtgctttgcaacattagtcgatgggaaacgtactagtgaagttgtgagcaaaagaggaggagaagaagaagacgaatttggggatttgaagtcttggatgcataaaaatggattgcctccttgcaaagttgtgcttaaagaaagaccttctcatgacaagaaacttcgacctattcattatgttgctgctagcgaggatcttcaggccagtgatgtggcggtttcggtgcccaattcgcttgttgttacactcgagagggttttgggaaatgagactcttgcggaactcttaaccacaaacaaattatcggaattggcatgcttggccttatacctgatgtatgagaagaagcaaggaaagaagtcattctggtatccatatataagggagcttgatcgtcagcgaggtaggggtcagctggctgtggaatctccacttttatggtctgaggctgaattggcttacctgactggtagcccaactaaggctgaagttcttgacagggcagatggaattaaaagagaatatgaggagctagacactgtttggttcatggctggttctctgtttcagcaatatccatatgatatacctactgaagcctttccctttgagatttttaaacaagcttttgtagccattcaatcctgtgtggtgcatttacagaaagtcagtttggctcgaagatttgctttggttcctcttggaccacctttgctagcatacagtagcaactgcaaggcaatgttaactgctgttgatggtgctgttgaattagtggttgatcgaccatacaaggctggggagcccattgttgtatggtgtgggccacagccaaattcaaaattgcttttaaactatggctttgttgatgaagataatccttatgaccgaatagcagttgaggcagcactgaacactgaggaccctcagtatcaggacaagagaatggttgctcaaagaaatgggaaattgtcagtgcaagtttttcaagtatacgctggaaaggaaaaagaagccgtgtcagatattcttccttatttgcgattgggatatgtatcagatccttctgaaatgcaatctgtaatttcttctcaaggtccagtttgtccagtaagcccttgtatggaacaagcagtgttagatcagcttactgtttattttagaacgcgccttgctggctattgtaccagcataagtgaagatgagttgatgttggcagatcctaacttgaaccccaagaagcgagtggctactcagcttgttagattggaaaagaaaatgctgaaggcatgcttgcaggctacagttgatttgataaaccagttacctgatcacaccatgcctccatgcccagctccttatgcccctttattgaaatga

SEQ ID NO: 1017 - protein, 348 aa, Populus balsamifera subsp. trichocarpa
  misc_feature (1)..(348): Ceres ANNOT ID no. 1536088
  misc_feature (3)..(170): Pfam Name: SET Pfam Description: SET domain
  misc_feature: SWISSPROT Homolog: RBCMT_TOBAC Ribulose-1,5 bisphosphate carboxylase/oxygenase large subunit N- methyltransferase, chloroplast precursor with e-value of 1.4e-10 and BLAST sequence identity of 28.2
  misc_feature: SWISSPROT Homolog: RBCMT_TOBAC EC 2.1.1.127 ([Ribulose-bisphosphate carboxylase]-lysine N- methyltransferase) (RuBisCO methyltransferase) ( RuBisco LSMT) (rbcM
  misc_feature: SWISSPROT Homolog: RBCMT_ARATH Probable ribulose-1,5 bisphosphate carboxylase/oxygenase large subunit N-methyltransferase, chloroplast precursor with e-value of 9.6e-08 and BLAST sequence identity of 28.2
  misc_feature: SWISSPROT Homolog: RBCMT_ARATH EC 2.1.1.127 ([Ribulose-bisphosphate carboxylase]-lysine N- methyltransferase) (RuBisCO methyltransferase) (RuBisco LS
  misc_feature 108769:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature (1)..(348): Functional Homolog of  Ceres CLONE ID no. 26560 at SEQ ID NO. 1051 with e-value of 4.69E-123 and BLAST sequence identity of 83.6
MYEKKQGKKSFWYPYIRELDRQRGRGQLAVESPLLWSEAELAYLTGSPTKAEVLDRADGIKREYEELDTVWFMAGSLFQQYPYDIPTEAFPFEIFKQAFVAIQSCVVHLQKVSLARRFALVPLGPPLLAYSSNCKAMLTAVDGAVELVVDRPYKAGEPIVVWCGPQPNSKLLLNYGFVDEDNPYDRIAVEAALNTEDPQYQDKRMVAQRNGKLSVQVFQVYAGKEKEAVSDILPYLRLGYVSDPSEMQSVISSQGPVCPVSPCMEQAVLDQLTVYFRTRLAGYCTSISEDELMLADPNLNPKKRVATQLVRLEKKMLKACLQATVDLINQLPDHTMPPCPAPYAPLLK

SEQ ID NO: 1018 - DNA, 1572 bp, Populus balsamifera subsp. trichocarpa
  misc_feature (1)..(1572): Ceres ANNOT ID no. 1482610
  misc_feature 108896:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
atggaattcacttgtttacacaacaaatgcatttcaccttctcttactgttctctctagggtttcaatttcattttccaatcttcctaaacgcgccgtttcatttcaccggcggcggagaaatttgtgctttgcaacattagtcgatgggaaacgtactagtgaagttgtgagcaaaagaggaggagaagaagaagacgaatttggggatttgaagtcttggatgcataaaaatggattgcctccttgcaaagttgtgcttaaagaaagaccttctcatgacaagaaacttcgacctattcattatgttgctgctagcgaggatcttcaggccagtgatgtggcggtttcggtgcccaattcgcttgttgttacactcgagagggttttgggaaatgagactcttgatagtgaaacccctcagcatgctataagtgaaaccatgataaatgtcagtgtgactaatttagcggaactcttaaccacaaacaaattatcggaattggcatgcttggccttatacctgatgtatgagaagaagcaaggaaagaagtcattctggtatccatatataagggagcttgatcgtcagcgaggtaggggtcagctggctgtggaatctccacttttatggtctgaggctgaattggcttacctgactggtagcccaactaaggctgaagttcttgacagggcagatggaattaaaagagaatatgaggagctagacactgtttggttcatggctggttctctgtttcagcaatatccatatgatatacctactgaagcctttccctttgagatttttaaacaagcttttgtagccattcaatcctgtgtggtgcatttacagaaagtcagtttggctcgaagatttgctttggttcctcttggaccacctttgctagcatacagtagcaactgcaaggcaatgttaactgctgttgatggtgctgttgaattagtggttgatcgaccatacaaggctggggagcccattgttgtatggtgtgggccacagccaaattcaaaattgcttttaaactatggctttgttgatgaagataatccttatgaccgaatagcagttgaggcagcactgaacactgaggaccctcagtatcaggacaagagaatggttgctcaaagaaatgggaaattgtcagtgcaagtttttcaagtatacgctggaaaggaaaaagaagccgtgtcagatattcttccttatttgcgattgggatatgtatcagatccttctgaaatgcaatctgtaatttcttctcaaggtccagtttgtccagtaagcccttgtatggaacaagcagtgttagatcagcttactgtttattttagaacgcgccttgctggctattgtaccagcataagtgaagatgagttgatgttggcagatcctaacttgaaccccaagaagcgagtggctactcagcttgttagattggaaaagaaaatgctgaaggcatgcttgcaggctacagttgatttgataaaccagttacctgatcacaccatgcctccatgcccagctccttatgcccctttattgaaatga

SEQ ID NO: 1019 - protein, 376 aa, Populus balsamifera subsp. trichocarpa
  misc_feature (1)..(376): Ceres ANNOT ID no. 1482610
  misc_feature (23)..(198): Pfam Name: SET Pfam Description: SET domain
  misc_feature: SWISSPROT Homolog: RBCMT_TOBAC Ribulose-1,5 bisphosphate carboxylase/oxygenase large subunit N- methyltransferase, chloroplast precursor with e-value of 1.4e-10 and BLAST sequence identity of 28.2
  misc_feature: SWISSPROT Homolog: RBCMT_TOBAC EC 2.1.1.127 ([Ribulose-bisphosphate carboxylase]-lysine N- methyltransferase) (RuBisCO methyltransferase) ( RuBisco LSMT) (rbcM
  misc_feature: SWISSPROT Homolog: RBCMT_ARATH Probable ribulose-1,5 bisphosphate carboxylase/oxygenase large subunit N-methyltransferase, chloroplast precursor with e-value of 9.6e-08 and BLAST sequence identity of 28.2
  misc_feature: SWISSPROT Homolog: RBCMT_ARATH EC 2.1.1.127 ([Ribulose-bisphosphate carboxylase]-lysine N- methyltransferase) (RuBisCO methyltransferase) (RuBisco LS
  misc_feature 109042:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature (1)..(376): Functional Homolog of  Ceres CLONE ID no. 26560 at SEQ ID NO. 1051 with e-value of 4.69E-123 and BLAST sequence identity of 83.6
MINVSVTNLAELLTTNKLSELACLALYLMYEKKQGKKSFWYPYIRELDRQRGRGQLAVESPLLWSEAELAYLTGSPTKAEVLDRADGIKREYEELDTVWFMAGSLFQQYPYDIPTEAFPFEIFKQAFVAIQSCVVHLQKVSLARRFALVPLGPPLLAYSSNCKAMLTAVDGAVELVVDRPYKAGEPIVVWCGPQPNSKLLLNYGFVDEDNPYDRIAVEAALNTEDPQYQDKRMVAQRNGKLSVQVFQVYAGKEKEAVSDILPYLRLGYVSDPSEMQSVISSQGPVCPVSPCMEQAVLDQLTVYFRTRLAGYCTSISEDELMLADPNLNPKKRVATQLVRLEKKMLKACLQATVDLINQLPDHTMPPCPAPYAPLLK

SEQ ID NO: 1020 - protein, 263 aa, Arabidopsis thaliana
  misc_feature (1)..(263): Ceres CLONE ID no. 26637
  misc_feature (138)..(246): Pfam Name: Sod_Fe_C Pfam Description: Iron/manganese superoxide dismutases C-terminal domain
  misc_feature (49)..(135): Pfam Name: Sod_Fe_N Pfam Description: Iron/manganese superoxide dismutases alpha-hairpin domain
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MSSCVVTTSCFYTISDSSIRLKSPKLLNLSNQQRRRSLRSRGGLKVEAYYGLKTPPYPLDALEPYMSRRTLEVHWGKHHRGYVDNLNKQLGKDDRLYGYTMEELIKATYNNGNPLPEFNNAAQVYNHDFFWESMQPGGGDTPQKGVLEQIDKDFGSFTNFREKFTNAALTQFGSGWVWLVLKREERRLEVVKTSNAINPLVWDDIPIICVDVWEHSYYLDYKNDRANYINTFLNHLVSWNAAMSRMARAEAFVNLGEPNIPIA

SEQ ID NO: 1021 - DNA, 819 bp, Populus balsamifera subsp. trichocarpa
  misc_feature (1)..(819): Ceres ANNOT ID no. 1451045
  misc_feature 109269:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atgggttgttttagttataatcttttctcttcttctccatcttgtcaagttccagtgacaggcagctttgcttgccaattcaagacgactccttacaagcaactccctactttgtttaagcagaaaaagaagcattttaatgggtgccaaagagcttcaagagttgtctcttactatgccttgaagacccctccttataaacttgatgctttagaaccttatatgagtaagaggacagtagaggtgcattggaaagaacatcacggtgcctatgtggaaggattgaataaagcattagcgaaaagtgatatactttatggctatactctggatgaccttgtcaaggtgacatataacaatggcaacccttcgcctgatttcaacaatgctgcccaggtctggaatcatgattttttttgggaatctatgcaaccaggaggaggagacatgccagaacttggcatgcttgagcagattgaaaaggattttggttcctttacaaatttcagaaacaagtttgcagaaacagctcttacactatttggctctggctgggtttggcttgtcttgaagagagaagaaccacgtctggaagtagttaaaacactgaatgcagttacgccaattgtatggggtgacattcctatcatcaacttggatatgtgggagcatgcttactatcttgactacaagaatgacaaagagaattatgtcaatgcatttatggaccaccttgtatcttggaacatggcgatggcacgcatggcccgtgcagaggcattcgtgaatctaggcgaacccaaaattcctattgcttaa

SEQ ID NO: 1022 - protein, 272 aa, Populus balsamifera subsp. trichocarpa
  misc_feature (1)..(272): Ceres ANNOT ID no. 1451045
  misc_feature (147)..(255): Pfam Name: Sod_Fe_C Pfam Description: Iron/manganese superoxide dismutases C-terminal domain
  misc_feature (58)..(144): Pfam Name: Sod_Fe_N Pfam Description: Iron/manganese superoxide dismutases alpha-hairpin domain
  misc_feature: SWISSPROT Homolog: SODF_NICPL Superoxide dismutase [Fe], chloroplast (EC 1.15.1.1) (Fragment) with e-value of 1.5e-63 and BLAST sequence identity of 57.9
  misc_feature: SWISSPROT Homolog: SODF_ARATH Superoxide dismutase [Fe], chloroplast precursor (EC 1.15.1.1) with e-value of 1.4e-62 and BLAST sequence identity of 56.5
  misc_feature: SWISSPROT Homolog: SODF_SOYBN Superoxide dismutase [Fe], chloroplast precursor (EC 1.15.1.1) with e-value of 1.1e-60 and BLAST sequence identity of 51.5
  misc_feature: SWISSPROT Homolog: SODF_PLEBO Superoxide dismutase [Fe] (EC 1.15.1.1) with e-value of 2.8e-46 and BLAST sequence identity of 47.2
  misc_feature: SWISSPROT Homolog: SODF_SYNY3 Superoxide dismutase [Fe] (EC 1.15.1.1) with e-value of 2.8e-46 and BLAST sequence identity of 46.5
  misc_feature 109383:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(272): Functional Homolog of  Ceres CLONE ID no. 26637 at SEQ ID NO. 1056 with e-value of 2.09E-95 and BLAST sequence identity of 70.2
MGCFSYNLFSSSPSCQVPVTGSFACQFKTTPYKQLPTLFKQKKKHFNGCQRASRVVSYYALKTPPYKLDALEPYMSKRTVEVHWKEHHGAYVEGLNKALAKSDILYGYTLDDLVKVTYNNGNPSPDFNNAAQVWNHDFFWESMQPGGGDMPELGMLEQIEKDFGSFTNFRNKFAETALTLFGSGWVWLVLKREEPRLEVVKTLNAVTPIVWGDIPIINLDMWEHAYYLDYKNDKENYVNAFMDHLVSWNMAMARMARAEAFVNLGEPKIPIA

SEQ ID NO: 1023 - protein, 341 aa, Arabidopsis thaliana
  misc_feature (1)..(341): Ceres CLONE ID no. 26655
  misc_feature (274)..(334): Pfam Name: KH_1 Pfam Description: KH domain
  misc_feature (34)..(223): Pfam Name: 3_5_exonuc Pfam Description: 3'-5' exonuclease
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
MASSSPTQLAHVPIPPEPGGRSPTQEANEPPVPIYIVTDPFQLPADFLNPSPEKKLVIGFDCEGVDLCRHGKLCIMQIAFSNAIYLVDVIEGGEVIMKACKPALESNYITKVIHDCKRDSEALYFQFGIRLHNVVDTQIAYSLIEEQEGRRRPLDDYISFVSLLADPRYCGISYEEKEEVRVLMRQDPKFWTYRPMTELMIRAAADDVRFLLYLYHKMMGKLNQRSLWHLAVRGALYCRCLCCMNDADFADWPTVPPIPDNLKSEDQCLEEEILSVLDVPPGKMGRVIGRKGASILAIKEACNAEILIGGAKGPPDKIFVIGPVREVRKAEAILRGRMIDY

SEQ ID NO: 1024 - DNA, 1014 bp, Populus balsamifera subsp. trichocarpa
  misc_feature (1)..(1014): Ceres ANNOT ID no. 1477170
  misc_feature 109584:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
atggcttcctcctcctcttctcaccagactcacactcctctcccttccgaccccggcggtggtaaaccactagatcatgaggttccgatacatgttgtgaccgagccttctcaacttccggccgagttccttaacccttcagccgcgaagcaattgatcattgggtttgactgtgagggtgttgatctttgtcgccatggaactctctgtattatgcagcttgcttttccggatgctatatatttggtcgatgccattaagggtggagagtctctcatcagagcatgtaagcctgcgctcgagtctagtcacatcacaaaagttatccatgactgcaaacgggatagcgaggcattatattttcagtttggcatcaagttgcacaatgttgttgatacccagattgcttattctcagatagaggagcaagaaggacggactagattgcctgatgactatatatcatttgttggcctccttgcagatccacgctattgtggcatatcttatctggagaaggaagaggttcgtgttctcctccgacaggatcctatgttctggacatacaggccattatctgaaatgatgatccatgcagctgcagatgatgttcgctttcttctccgcatctattataagatgatggaaaagctcaaccagagatctttatggtatcttgcagttcgtggggtgttgtattgtcgatgcttctgcatcaatgagaatgattatgctgattggccccatatccctcctattccagataacctcatcatcgaggataatgctcctgaagaggaaatcctttctgttcttgatgttcccccaggaaagatgggacgtgttattggaagacgaggagcatccattttgtcagtaaaggaatcttgcaacgcggagattttcattggaggtgcaaagggtccaactgacaaggtattcatagtaggaccggtgaaacaagtgaggaaagctgaagccatgttgagggggaaaatgctggatatattttag

SEQ ID NO: 1025 - protein, 337 aa, Populus balsamifera subsp. trichocarpa
  misc_feature (1)..(337): Ceres ANNOT ID no. 1477170
  misc_feature (269)..(329): Pfam Name: KH_1 Pfam Description: KH domain
  misc_feature (30)..(219): Pfam Name: 3_5_exonuc Pfam Description: 3'-5' exonuclease
  misc_feature 109662:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature (1)..(337): Functional Homolog of  Ceres CLONE ID no. 26655 at SEQ ID NO. 1059 with e-value of 2.00E-140 and BLAST sequence identity of 75.8
MASSSSSHQTHTPLPSDPGGGKPLDHEVPIHVVTEPSQLPAEFLNPSAAKQLIIGFDCEGVDLCRHGTLCIMQLAFPDAIYLVDAIKGGESLIRACKPALESSHITKVIHDCKRDSEALYFQFGIKLHNVVDTQIAYSQIEEQEGRTRLPDDYISFVGLLADPRYCGISYLEKEEVRVLLRQDPMFWTYRPLSEMMIHAAADDVRFLLRIYYKMMEKLNQRSLWYLAVRGVLYCRCFCINENDYADWPHIPPIPDNLIIEDNAPEEEILSVLDVPPGKMGRVIGRRGASILSVKESCNAEIFIGGAKGPTDKVFIVGPVKQVRKAEAMLRGKMLDIF

SEQ ID NO: 1026 - DNA, 1017 bp, Populus balsamifera subsp. trichocarpa
  misc_feature (1)..(1017): Ceres ANNOT ID no. 1508498
  misc_feature 109768:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
atggcttcctcttcttcttcctcttctcatcagactcgcgttcctttcccttccgacccaggcggtaaaccactagatcatgatgttccgatccatgttgtcaccgaaccttctcagcttccggtcgagttccttaacccttctgccgcaaagcaattgatcattggttttgactgtgagggtgttaatctctgtcgtcatggagctctctgtattatgcagcttgcattcccggatgctatctacttggttgatgccattaacggtggagagtcgcttatcaaagtgtgtaagcctgcactcgagtcgagttacatcacaaaagttattcacgattgcaaacgggatagcgaggcattatattttcaatttggcatcaagttgcacaatgttgttgatacccagattgcttattctcttatagaggagcaagaaggacggactagattgccaggggactatatatcatttgttggcctccttgcagatccacgctattgtggtgtatcttatctggagaaggaagaggttcgtgttctcctccgacaggatcctatgttctggacatacaggccattatccgaaatgatgatccgtgcagctgcagatgatgttcgttttcttctctgcatctattataagatgatggaaaagctgaacgaaagatcgttatggtatcttgcagttcgtggagcattgtattctcgatgtttctgcattaatgagaataattatgctgattggcccgatatccctcctattccagataacctcaacattgaggacaatgcccccgaggaggaaatcctttatgttcttgatgttcccccgggaaagatgggacgtgttattggaagacgaggagcttccattttgtcaataaagcaatcttgcaatgcggaaattttctttggaggtgcgaagggtccacctgacaaggcattcataataggaccagtgaaacaggtgaggaaagcagaagccatgctgaaggggaaaatggtggatatttactag

SEQ ID NO: 1027 - protein, 338 aa, Populus balsamifera subsp. trichocarpa
  misc_feature (1)..(338): Ceres ANNOT ID no. 1508498
  misc_feature (270)..(330): Pfam Name: KH_1 Pfam Description: KH domain
  misc_feature (31)..(220): Pfam Name: 3_5_exonuc Pfam Description: 3'-5' exonuclease
  misc_feature 109846:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature (1)..(338): Functional Homolog of  Ceres CLONE ID no. 26655 at SEQ ID NO. 1059 with e-value of 4.29E-136 and BLAST sequence identity of 74.4
MASSSSSSSHQTRVPFPSDPGGKPLDHDVPIHVVTEPSQLPVEFLNPSAAKQLIIGFDCEGVNLCRHGALCIMQLAFPDAIYLVDAINGGESLIKVCKPALESSYITKVIHDCKRDSEALYFQFGIKLHNVVDTQIAYSLIEEQEGRTRLPGDYISFVGLLADPRYCGVSYLEKEEVRVLLRQDPMFWTYRPLSEMMIRAAADDVRFLLCIYYKMMEKLNERSLWYLAVRGALYSRCFCINENNYADWPDIPPIPDNLNIEDNAPEEEILYVLDVPPGKMGRVIGRRGASILSIKQSCNAEIFFGGAKGPPDKAFIIGPVKQVRKAEAMLKGKMVDIY

SEQ ID NO: 1028 - DNA, 999 bp, Populus balsamifera subsp. trichocarpa
  misc_feature (1)..(999): Ceres ANNOT ID no. 1530647
  misc_feature 109952:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
atggcttcctcctcctcttctcaccagactcacactcctctcccttccgaccccggcggtggtaaaccactagatcatgaggttccgatacatgttgtgaccgagccttctcaacttccggccgagttccttaacccttcagccgcgaagcaattgatcattgggtttgactgtgagggtgttgatctttgtcgccatggaactctctgtattatgcagcttgcttttccggatgctatatatttggtcgatgccattaagggtggagagtctctcatcagagcatgtaagcctgcgctcgagtctagtcacatcacaaaagttatccatgactgcaaacgggatagcgagtttggcatcaagttgcacaatgttgttgatacccagattgcttattctcagatagaggagcaagaaggacggactagattgcctgatgactatatatcatttgttggcctccttgcagatccacgctattgtggcatatcttatctggagaaggaagaggttcgtgttctcctccgacaggatcctatgttctggacatacaggccattatctgaaatgatgatccatgcagctgcagatgatgttcgctttcttctccgcatctattataagatgatggaaaagctcaaccagagatctttatggtatcttgcagttcgtggggtgttgtattgtcgatgcttctgcatcaatgagaatgattatgctgattggccccatatccctcctattccagataacctcatcatcgaggataatgctcctgaagaggaaatcctttctgttcttgatgttcccccaggaaagatgggacgtgttattggaagacgaggagcatccattttgtcagtaaaggaatcttgcaacgcggagattttcattggaggtgcaaagggtccaactgacaaggtattcatagtaggaccggtgaaacaagtgaggaaagctgaagccatgttgagggggaaaatgctggatatattttag

SEQ ID NO: 1029 - protein, 332 aa, Populus balsamifera subsp. trichocarpa
  misc_feature (1)..(332): Ceres ANNOT ID no. 1530647
  misc_feature (264)..(324): Pfam Name: KH_1 Pfam Description: KH domain
  misc_feature (30)..(214): Pfam Name: 3_5_exonuc Pfam Description: 3'-5' exonuclease
  misc_feature 110030:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature (1)..(332): Functional Homolog of  Ceres CLONE ID no. 26655 at SEQ ID NO. 1059 with e-value of 6.99E-136 and BLAST sequence identity of 75.4
MASSSSSHQTHTPLPSDPGGGKPLDHEVPIHVVTEPSQLPAEFLNPSAAKQLIIGFDCEGVDLCRHGTLCIMQLAFPDAIYLVDAIKGGESLIRACKPALESSHITKVIHDCKRDSEFGIKLHNVVDTQIAYSQIEEQEGRTRLPDDYISFVGLLADPRYCGISYLEKEEVRVLLRQDPMFWTYRPLSEMMIHAAADDVRFLLRIYYKMMEKLNQRSLWYLAVRGVLYCRCFCINENDYADWPHIPPIPDNLIIEDNAPEEEILSVLDVPPGKMGRVIGRRGASILSVKESCNAEIFIGGAKGPTDKVFIVGPVKQVRKAEAMLRGKMLDIF

SEQ ID NO: 1030 - protein, 324 aa, Arabidopsis thaliana
  misc_feature (1)..(324): Ceres CLONE ID no. 26825
  misc_feature (161)..(282): Pfam Name: Sm_multidrug_ex Pfam Description: Putative small multi-drug export protein
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Serrate Margins Useful for making plants with increased biomass and foliage
MAISTLLSISSFTLSSSSSTKTHLLTSIPASRVYSYPISPKWKQIRFLQSQSSSLFYPLRRNFTRFCSSPDGFLRNTKDDEEGNEIIQLPSIGVNPVKFAICVVLWASFSLLWFARSGDAKAATDSIKSSSFGLRIASTLRRFGWPDEAVVFALATLPVIELRGAIPVGYWMQLKPVVLTSFSVLGNMVPVPFIVLYLKTFASFVAGKSQTASKLLDILFKRAKEKAGPVEEFKWLGLMLFVAVPFPGTGAWTGAIIASILDMPFWSAVSSNFCGVVLAGLLVNLLVNLGLKQAIVAGIALFFVSTFMWSVLRNIRKSIKPSLP

SEQ ID NO: 1031 - DNA, 933 bp, Populus balsamifera subsp. trichocarpa
  misc_feature (1)..(933): Ceres ANNOT ID no. 1513438
  misc_feature 110245:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Serrate Margins Useful for making plants with increased biomass and foliage
atggcagcttctgcgtcactattatcactgtcttcaatatcttttggagaaaatcgtttcaaaatcatatctggccaagtgacgacaaagctctccattgttgctcacaagaaacaacctgttctcaagtcaaagccatcattcttagcatttcatcgtttggacggtcttcgttttctttcatcatctacttcaactagagcttcttcaaatgggtttttcgatacaacccaagacaaggagattttgccgtcctttgagccaaagcctgccaaatttctcttttgggtcgcattttgggcgtctctttctcttgtttggtttgcagcttctggcgatgctaatgcagctgtcgattccatcaaagcctccggctttggtctaaagattgctactgcgtttcgtagacttggctggcctgatgaagctgtggtcttcgctcttgctacacttcccgtgcttgagctccgtggggctattcctgttggttattggatgcaactcaagcctataatgctcactatcttatctgttgttgggaacatggttcctgtgcctttcatcatactttacttgaagccatttgcttctttccttgctggaaggaaccagccagcatctcggttccttgacatgctatttgagaatgccaaagagaaatctggtcctgtgaaagagtttcaatggcttggcctaatgcttttcgtggctgttcctttccctggaacaggagcatggactggagccatcatagcttcgattcttgatatgcctttctggtcagctgtatcggcaaatttctgcggtgttgtgttggctggcctcctggtaaacttgttggtgaacctaggtctcaagtatgcaactattactggtatcatcctcttctttatatcaacttttatgtggagtatcctccgacatattagctag

SEQ ID NO: 1032 - protein, 310 aa, Populus balsamifera subsp. trichocarpa
  misc_feature (1)..(310): Ceres ANNOT ID no. 1513438
  misc_feature (155)..(276): Pfam Name: Sm_multidrug_ex Pfam Description: Putative small multi-drug export protein
  misc_feature 110329:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Serrate Margins Useful for making plants with increased biomass and foliage
  misc_feature (1)..(310): Functional Homolog of  Ceres CLONE ID no. 26825 at SEQ ID NO. 1066 with e-value of 1.29E-95 and BLAST sequence identity of 75.6
MAASASLLSLSSISFGENRFKIISGQVTTKLSIVAHKKQPVLKSKPSFLAFHRLDGLRFLSSSTSTRASSNGFFDTTQDKEILPSFEPKPAKFLFWVAFWASLSLVWFAASGDANAAVDSIKASGFGLKIATAFRRLGWPDEAVVFALATLPVLELRGAIPVGYWMQLKPIMLTILSVVGNMVPVPFIILYLKPFASFLAGRNQPASRFLDMLFENAKEKSGPVKEFQWLGLMLFVAVPFPGTGAWTGAIIASILDMPFWSAVSANFCGVVLAGLLVNLLVNLGLKYATITGIILFFISTFMWSILRHIS

SEQ ID NO: 1033 - DNA, 882 bp, Populus balsamifera subsp. trichocarpa
  misc_feature (1)..(882): Ceres ANNOT ID no. 1460167
  misc_feature 110443:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Serrate Margins Useful for making plants with increased biomass and foliage
atggcagcttctgcgtcactattatcactgtcttcaatatcttttggagaaaatcgtttcaaaatcatatctggccaagtgacgacaaagctctccattgttgctcacaagaaacaacctgttctcaagtcaaagccatcattcttagcatttcatcgtttggacggtcttcgttttctttcatcatctacttcaactagagcttcttcaaatgggtttttcgatacaacccaagacaaggagattttgccgtcctttgagccaaagcctgccaaatttctcttttgggtcgcattttgggcgtctctttctcttgtttggtttgcagcttctggcgatgctaatgcagctgtcgattccatcaaagcctccggctttggtctaaagattgctactgcgtttcgtagacttggctggcctgatgaagctgtggtcttcgctcttgctacacttcccgtgcttgagctccgtggggctattcctgttggttattggatgcaactcaagcctataatgctcactatcttatctgttgttgggaacatggttcctgtgcctttcatcatactttacttgaagccatttgcttctttccttgctggaaggaaccagccagcatctcggttccttgacatgctatttgagaatgccaaagagaaatctggtcctgtgaaagagtttcaatggcttggcctaatgcttttcgtggctgttcctttccctggaacaggagcatggactggagccatcatagcttcgattcttgatatgcctttctggtcagctgtatcggcaaatttctgcggtgttgtgttggctggcctcctgggcactgaggaatacactaagtatgagcacttgacgatttttcctagtaactag

SEQ ID NO: 1034 - protein, 293 aa, Populus balsamifera subsp. trichocarpa
  misc_feature (1)..(293): Ceres ANNOT ID no. 1460167
  misc_feature (155)..(276): Pfam Name: Sm_multidrug_ex Pfam Description: Putative small multi-drug export protein
  misc_feature 110525:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Serrate Margins Useful for making plants with increased biomass and foliage
  misc_feature (1)..(293): Functional Homolog of  Ceres CLONE ID no. 26825 at SEQ ID NO. 1066 with e-value of 1.30E-81 and BLAST sequence identity of 75.5
MAASASLLSLSSISFGENRFKIISGQVTTKLSIVAHKKQPVLKSKPSFLAFHRLDGLRFLSSSTSTRASSNGFFDTTQDKEILPSFEPKPAKFLFWVAFWASLSLVWFAASGDANAAVDSIKASGFGLKIATAFRRLGWPDEAVVFALATLPVLELRGAIPVGYWMQLKPIMLTILSVVGNMVPVPFIILYLKPFASFLAGRNQPASRFLDMLFENAKEKSGPVKEFQWLGLMLFVAVPFPGTGAWTGAIIASILDMPFWSAVSANFCGVVLAGLLGTEEYTKYEHLTIFPSN

SEQ ID NO: 1035 - protein, 167 aa, Arabidopsis thaliana
  misc_feature (1)..(167): Ceres CLONE ID no. 26838
  misc_feature (69)..(167): Pfam Name: Copper-bind Pfam Description: Copper binding proteins plastocyanin/azurin family
  misc_feature: Utility: MSX Useful for making plants tolerant to low nitrogen
  misc_feature: Phenotype: WHOLE PLANT - MSX Useful for making plants tolerant to low nitrogen
MASVTSATVAIPSFTGLKASTIKSSATVRIQTAAVASPKLTVKSSLKNFGVAAVAAAASIALAGNAMAIEVLLGGGDGSLAFIPNDFSIAKGEKIVFKNNAGYPHNVVFDEDEIPSGVDVAKISMDEQDLLNGAGETYEVALTEPGTYSFYCAPHQGAGMVGKVTVN

SEQ ID NO: 1036 - DNA, 507 bp, Populus balsamifera subsp. trichocarpa
  misc_feature (1)..(507): Ceres ANNOT ID no. 1452938
  misc_feature: Utility: MSX Useful for making plants tolerant to low nitrogen
  misc_feature 110710:<222: Transcription Factor
  misc_feature: Phenotype: WHOLE PLANT - MSX Useful for making plants tolerant to low nitrogen
atggccactgtcacctctgctgctgtttcaatcccttctttcaccggtcttaaggcaggcagtgcctccaatgctaaagtcagtgccagtgccaaggtctcagcctctccactcccaaggctcagcatcaaggcctcaatgaaagacgttggtgctgccgttgtcgccaccgctgctagcgcaatgattgctagcaatgctatggccatcgacgtcttgcttggagctgacgatggatcattggcttttgttcccagcgagttctccatatcccctggtgaaaagatcgtcttcaagaacaatgccggattcccacacaacattgtcttcgacgaggattctattccaagtggggttgatgcgtcaaaaatctccatgagtgaggaggatctcctcaatgccaaaggagagactttcgaagttgccttgagtaacaaaggcgaatacagcttctactgttctcctcaccagggagctggcatggtgggaaaagttaccgttaattaa

SEQ ID NO: 1037 - protein, 168 aa, Populus balsamifera subsp. trichocarpa
  misc_feature (1)..(168): Ceres ANNOT ID no. 1452938
  misc_feature (70)..(168): Pfam Name: Copper-bind Pfam Description: Copper binding proteins plastocyanin/azurin family
  misc_feature: SWISSPROT Homolog: PLAS2_ARATH Plastocyanin major isoform, chloroplast precursor (DNA-damage-repair/toleration protein DRT112) with e-value of 1.0e-82 and BLAST sequence identity of 100.0
  misc_feature: SWISSPROT Homolog: PLAS1_ARATH Plastocyanin minor isoform, chloroplast precursor with e-value of 1.7e-62 and BLAST sequence identity of 74.7
  misc_feature: SWISSPROT Homolog: PLAS_SPIOL Plastocyanin, chloroplast precursor with e-value of 1.8e-60 and BLAST sequence identity of 72.6
  misc_feature: SWISSPROT Homolog: PLAS_LYCES Plastocyanin, chloroplast precursor with e-value of 2.1e-57 and BLAST sequence identity of 68.6
  misc_feature: SWISSPROT Homolog: PLAS_SILPR Plastocyanin, chloroplast precursor with e-value of 7.2e-57 and BLAST sequence identity of 69.0
  misc_feature: Utility: MSX Useful for making plants tolerant to low nitrogen
  misc_feature 110802:<222: Transcription Factor
  misc_feature: Phenotype: WHOLE PLANT - MSX Useful for making plants tolerant to low nitrogen
  misc_feature (1)..(168): Functional Homolog of  Ceres CLONE ID no. 26838 at SEQ ID NO. 1071 with e-value of 2.10E-56 and BLAST sequence identity of 68.4
MATVTSAAVSIPSFTGLKAGSASNAKVSASAKVSASPLPRLSIKASMKDVGAAVVATAASAMIASNAMAIDVLLGADDGSLAFVPSEFSISPGEKIVFKNNAGFPHNIVFDEDSIPSGVDASKISMSEEDLLNAKGETFEVALSNKGEYSFYCSPHQGAGMVGKVTVN

SEQ ID NO: 1038 - DNA, 507 bp, Populus balsamifera subsp. trichocarpa
  misc_feature (1)..(507): Ceres ANNOT ID no. 1442477
  misc_feature: Utility: MSX Useful for making plants tolerant to low nitrogen
  misc_feature 110874:<222: Transcription Factor
  misc_feature: Phenotype: WHOLE PLANT - MSX Useful for making plants tolerant to low nitrogen
atggccactgtcacctctgctgctgtttctatcccatctttcaccggtcttaaggcagccagtgcctccaatgccaaagtcagtgccagtgccaaggtttcagcctctccacttccaaggctcagcatcaaggcttcattgaaagaagtcggtgctgctgttgtcgccaccgctgctagcgcaatgattgctagcaatgctatggccgttgacgtcttgcttggaagtgatgatggatcattggcttttgttcccagcgaattctctgtacccgctggtgaaaagattgtcttcaagaacaatgccgggttcccacataacgttctcttcgacgaggacgctgttccaagtggggttgatgtgtcaaaaatctccatgagcgaggaggatctcctcaacgccaaaggagagactttcgaagttgccttgagcgacaaaggtgaatacactttctactgttctcctcaccagggagctggcatggtgggaaaagtgatcgttaattaa

SEQ ID NO: 1039 - protein, 168 aa, Populus balsamifera subsp. trichocarpa
  misc_feature (1)..(168): Ceres ANNOT ID no. 1442477
  misc_feature (70)..(168): Pfam Name: Copper-bind Pfam Description: Copper binding proteins plastocyanin/azurin family
  misc_feature: SWISSPROT Homolog: PLAS2_ARATH Plastocyanin major isoform, chloroplast precursor (DNA-damage-repair/toleration protein DRT112) with e-value of 1.0e-82 and BLAST sequence identity of 100.0
  misc_feature: SWISSPROT Homolog: PLAS1_ARATH Plastocyanin minor isoform, chloroplast precursor with e-value of 1.7e-62 and BLAST sequence identity of 74.7
  misc_feature: SWISSPROT Homolog: PLAS_SPIOL Plastocyanin, chloroplast precursor with e-value of 1.8e-60 and BLAST sequence identity of 72.6
  misc_feature: SWISSPROT Homolog: PLAS_LYCES Plastocyanin, chloroplast precursor with e-value of 2.1e-57 and BLAST sequence identity of 68.6
  misc_feature: SWISSPROT Homolog: PLAS_SILPR Plastocyanin, chloroplast precursor with e-value of 7.2e-57 and BLAST sequence identity of 69.0
  misc_feature: Utility: MSX Useful for making plants tolerant to low nitrogen
  misc_feature 110966:<222: Transcription Factor
  misc_feature: Phenotype: WHOLE PLANT - MSX Useful for making plants tolerant to low nitrogen
  misc_feature (1)..(168): Functional Homolog of  Ceres CLONE ID no. 26838 at SEQ ID NO. 1071 with e-value of 2.39E-55 and BLAST sequence identity of 66.6
MATVTSAAVSIPSFTGLKAASASNAKVSASAKVSASPLPRLSIKASLKEVGAAVVATAASAMIASNAMAVDVLLGSDDGSLAFVPSEFSVPAGEKIVFKNNAGFPHNVLFDEDAVPSGVDVSKISMSEEDLLNAKGETFEVALSDKGEYTFYCSPHQGAGMVGKVIVN

SEQ ID NO: 1040 - protein, 144 aa, Arabidopsis thaliana
  misc_feature (1)..(144): Ceres CLONE ID no. 26867
  misc_feature (1)..(144): Also Known As Ceres CDNA ID no. 23390265
  misc_feature (1)..(144): Also Known As Ceres GEMINI ID 535B8
  misc_feature (12)..(77): Pfam Name: AP2 Pfam Description: AP2 domain
  misc_feature 111052:<222: Transcription Factor
  misc_feature: Phenotype: Activates expression of the gene endogenous to the AtHMGS (SEQ ID NO 4144) regalutory region Useful for modulating Terpenoid Biosynthesis
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 1041 - DNA, 507 bp, Populus balsamifera subsp. trichocarpa
  misc_feature (1)..(507): Ceres ANNOT ID no. 1486918
  misc_feature 111107:<222: Transcription Factor
  misc_feature: Phenotype: Activates expression of the gene endogenous to the AtHMGS (SEQ ID NO 4144) regalutory region Useful for modulating Terpenoid Biosynthesis
atgagcggtagtagcagcagcagaacagatcaagaaagtggagcaagtgcagctcggaagaaattcaagggagtgaggaggcggaaatggggcaagtgggtgtctgaaataaggattcctggcaagcaagatcgactttggttaggttcttattcaacacccgaggcagctgcggtggctcatgacatagcctcttattgtttacgcggaccttcttcgatagagagtctcaatttccctctaatgttgcctgcaagtgtaagggaagacatgtcacctaagtccatacagaaagctgcttcagatgctggcatggcaattgatgctcaaatgatactgaacagggtaccagaaaatgaggtcaagttctggactgcaagtggtggggttaatcatgggctggagatagagttatgcgaacctgcaggtggcgatcatggtggtaattggcatggaaacaatactggaatgagagaaggggacatctccattgaagattatctctag

SEQ ID NO: 1042 - protein, 168 aa, Populus balsamifera subsp. trichocarpa
  misc_feature (1)..(168): Ceres ANNOT ID no. 1486918
  misc_feature (20)..(85): Pfam Name: AP2 Pfam Description: AP2 domain
  misc_feature: SWISSPROT Homolog: TINY_ARATH Transcriptional factor TINY with e-value of 2.5e-15 and BLAST sequence identity of 40.5
  misc_feature: SWISSPROT Homolog: DRE2D_ARATH Putative dehydration-responsive element-binding protein 2D (DREB2D protein) with e-value of 6.6e-15 and BLAST sequence identity of 41.5
  misc_feature: SWISSPROT Homolog: DRE2F_ARATH Dehydration-responsive element-binding protein 2F (DREB2F protein) with e-value of 1.4e-14 and BLAST sequence identity of 55.7
  misc_feature: SWISSPROT Homolog: DRE1B_ARATH Dehydration-responsive element-binding protein 1B with e-value of 2.9e-14 and BLAST sequence identity of 39.4
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1D_ARATH Dehydration-responsive element-binding protein 1D with e-value of 1.6e-13 and BLAST sequence identity of 45.3
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature 111211:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(168): Functional Homolog of  Ceres CLONE ID no. 26867 at SEQ ID NO. 1076 with e-value of 1.69E-31 and BLAST sequence identity of 61.1
MSGSSSSRTDQESGASAARKKFKGVRRRKWGKWVSEIRIPGKQDRLWLGSYSTPEAAAVAHDIASYCLRGPSSIESLNFPLMLPASVREDMSPKSIQKAASDAGMAIDAQMILNRVPENEVKFWTASGGVNHGLEIELCEPAGGDHGGNWHGNNTGMREGDISIEDYL

SEQ ID NO: 1043 - protein, 243 aa, Arabidopsis thaliana
  misc_feature (1)..(243): Ceres CLONE ID no. 26907
  misc_feature (90)..(160): Pfam Name: RRM_1 Pfam Description: RNA recognition motif. (a.k.a. RRM RBD, or RNP domain)
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQRGGGRGGGGRGGGGRGRRPGKGPAEKISAEDLDADLDKYHSGDMETN

SEQ ID NO: 1044 - DNA, 738 bp, Populus balsamifera subsp. trichocarpa
  misc_feature (1)..(738): Ceres ANNOT ID no. 1484074
  misc_feature 111396:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgacgacaacggccctggacatgtctctagacgacataatagaaaacaacaggaagtcgtcgaattctcgaggcagacctcgttcttctggcggccctggtccttcccgtcggttctccaatcgcgcgggaaacataacaacgccctattccaagccccaggtccaagctccagagacgtcatggcagcacgacatgttcacggataatcctgtttctgcttctgcatatcctgctcgtgcttcttccattgagactgggactaaactctatatttccaacttagatttcggtgtttctactgaagacatcaaggagcttttctcggagattggtgaccttaaacgatattcagtccattatgataggagtggaagatcagagggaacggcggagatagtctttgcacggcgggaagatgctgtctctgctgtcaagagatacaataatgttcaactggatggaaagccaatgaagattgagattgtgggaacaaatattgccactcggcctgctgtccctccatccactaatggcatgtataggaatcaaaatattgctgctcctagaagtagtagccaaggaaggggtggtaccacgggacggcctcggggtggtgggcatggagttagaaggggtggtcgtggaaggggtagaggtcgtggtgaaaagatatctgcagaagatctagatgctgatttagaaaagtaccattcagaagctatgcaagaaaactga

SEQ ID NO: 1045 - protein, 245 aa, Populus balsamifera subsp. trichocarpa
  misc_feature (1)..(245): Ceres ANNOT ID no. 1484074
  misc_feature (90)..(160): Pfam Name: RRM_1 Pfam Description: RNA recognition motif. (a.k.a. RRM RBD, or RNP domain)
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.5e-48 and BLAST sequence identity of 44.5
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 1.7e-46 and BLAST sequence identity of 43.6
  misc_feature: SWISSPROT Homolog: REFP2_MOUSE RNA and export factor-binding protein 2 with e-value of 7.2e-41 and BLAST sequence identity of 45.2
  misc_feature: SWISSPROT Homolog: MLO3_SCHPO Protein mlo3 with e-value of 2.2e-17 and BLAST sequence identity of 33.8
  misc_feature: SWISSPROT Homolog: TRA2A_MOUSE Transformer-2 protein homolog (TRA-2 alpha) with e-value of 6.4e-17 and BLAST sequence identity of 33.7
  misc_feature 111534:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(245): Functional Homolog of  Ceres CLONE ID no. 26907 at SEQ ID NO. 1079 with e-value of 3.29E-67 and BLAST sequence identity of 62.9
MTTTALDMSLDDIIENNRKSSNSRGRPRSSGGPGPSRRFSNRAGNITTPYSKPQVQAPETSWQHDMFTDNPVSASAYPARASSIETGTKLYISNLDFGVSTEDIKELFSEIGDLKRYSVHYDRSGRSEGTAEIVFARREDAVSAVKRYNNVQLDGKPMKIEIVGTNIATRPAVPPSTNGMYRNQNIAAPRSSSQGRGGTTGRPRGGGHGVRRGGRGRGRGRGEKISAEDLDADLEKYHSEAMQEN

SEQ ID NO: 1046 - DNA, 546 bp, Populus balsamifera subsp. trichocarpa
  misc_feature (1)..(546): Ceres ANNOT ID no. 1440016
  misc_feature 111657:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcaagcgctttggatatgtccctcgacgatatcatcaaaaatagcaaaaaacccggatccgctaacttccggggccgtggtcgaggccacccttccggagccggtcctgctcgccgcttccctaaccgcgccgccaatcgttcagctccttataccgccgctaaggctccggaaagcacgtggcaacacgacatgttcagggatcaatcaggtcggacctcctctttagaaggagcaaagctctatgtttccaatttagattatggagtctctaacgaggacatcaaggaattgtttttggaagtgggtgaactgaaaaggtattcgatccattacgatcggagtggcagatcgaagggaacggcagaagttgtcttcgcacgacaagctgaagctgtggctgctgttaagagatacaacaatgttcagcttgatgggaaaccgatgaagatagagattgtgggaacaaattttgttgctcctcctgcgcctccggctgctaatgctgcttttggaaattctaatggagtttctggacggtaa

SEQ ID NO: 1047 - protein, 181 aa, Populus balsamifera subsp. trichocarpa
  misc_feature (1)..(181): Ceres ANNOT ID no. 1440016
  misc_feature (82)..(152): Pfam Name: RRM_1 Pfam Description: RNA recognition motif. (a.k.a. RRM RBD, or RNP domain)
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.5e-48 and BLAST sequence identity of 44.5
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 1.7e-46 and BLAST sequence identity of 43.6
  misc_feature: SWISSPROT Homolog: REFP2_MOUSE RNA and export factor-binding protein 2 with e-value of 7.2e-41 and BLAST sequence identity of 45.2
  misc_feature: SWISSPROT Homolog: MLO3_SCHPO Protein mlo3 with e-value of 2.2e-17 and BLAST sequence identity of 33.8
  misc_feature: SWISSPROT Homolog: TRA2A_MOUSE Transformer-2 protein homolog (TRA-2 alpha) with e-value of 6.4e-17 and BLAST sequence identity of 33.7
  misc_feature 111789:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(181): Functional Homolog of  Ceres CLONE ID no. 26907 at SEQ ID NO. 1079 with e-value of 1.70E-56 and BLAST sequence identity of 69.2
MSSALDMSLDDIIKNSKKPGSANFRGRGRGHPSGAGPARRFPNRAANRSAPYTAAKAPESTWQHDMFRDQSGRTSSLEGAKLYVSNLDYGVSNEDIKELFLEVGELKRYSIHYDRSGRSKGTAEVVFARQAEAVAAVKRYNNVQLDGKPMKIEIVGTNFVAPPAPPAANAAFGNSNGVSGR

SEQ ID NO: 1048 - DNA, 753 bp, Populus balsamifera subsp. trichocarpa
  misc_feature (1)..(753): Ceres ANNOT ID no. 1518242
  misc_feature 111900:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtccagcttactggatatgtcacttgacgacctcatccgcaagggcaaagaaaatggagggcgtgacagtgatttcagaggcagtggcagaggagcaggctccggttcggttttgggtccgggccccgatcgtttggtcttccgtcgtgacccgacccgacccaaaccctactcagtaagaccagtgcaggtaatgcaagtgcagcaggagccattaatgttagcagcaagtgaagggtctaatggagaggctaagttatatatatcaaacttggattatggtgtttctaatgaggatatcaaggtgcttttctccgaggttggtgaattgttgaggtactcacttcattatgatatgagtgggagatcaaagggaacagctgaagttgtattttcacgccaaacagatgctctagcagctatcaggagatataataatgttcagcttgatgggaagccactgaaaattgagcttgtaggagttaatgtgataacccctgtccctgttaccgtgcctgtaactgcaattaccaatgtggcaaacccaaatggtgctgttagaagtgttcatgaaagaattggtgcaaggggaagaggccatggtggtggtgctggcggcaggggcggtggcagtgttcaagaatttgccaggggccaggggcaggtgagacgccgtgtcgagaagctaactgcagaagcacttgattctgacttggacaaataccactttgaagccatgaaattaaagtga

SEQ ID NO: 1049 - protein, 250 aa, Populus balsamifera subsp. trichocarpa
  misc_feature (1)..(250): Ceres ANNOT ID no. 1518242
  misc_feature (87)..(157): Pfam Name: RRM_1 Pfam Description: RNA recognition motif. (a.k.a. RRM RBD, or RNP domain)
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.5e-48 and BLAST sequence identity of 44.5
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 1.7e-46 and BLAST sequence identity of 43.6
  misc_feature: SWISSPROT Homolog: REFP2_MOUSE RNA and export factor-binding protein 2 with e-value of 7.2e-41 and BLAST sequence identity of 45.2
  misc_feature: SWISSPROT Homolog: MLO3_SCHPO Protein mlo3 with e-value of 2.2e-17 and BLAST sequence identity of 33.8
  misc_feature: SWISSPROT Homolog: TRA2A_MOUSE Transformer-2 protein homolog (TRA-2 alpha) with e-value of 6.4e-17 and BLAST sequence identity of 33.7
  misc_feature 112038:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(250): Functional Homolog of  Ceres CLONE ID no. 26907 at SEQ ID NO. 1079 with e-value of 1.89E-48 and BLAST sequence identity of 52.5
MSSLLDMSLDDLIRKGKENGGRDSDFRGSGRGAGSGSVLGPGPDRLVFRRDPTRPKPYSVRPVQVMQVQQEPLMLAASEGSNGEAKLYISNLDYGVSNEDIKVLFSEVGELLRYSLHYDMSGRSKGTAEVVFSRQTDALAAIRRYNNVQLDGKPLKIELVGVNVITPVPVTVPVTAITNVANPNGAVRSVHERIGARGRGHGGGAGGRGGGSVQEFARGQGQVRRRVEKLTAEALDSDLDKYHFEAMKLK

SEQ ID NO: 1050 - protein, 289 aa, Arabidopsis thaliana
  misc_feature (1)..(289): Ceres CLONE ID no. 27197
  misc_feature (97)..(271): Pfam Name: SCAMP Pfam Description: SCAMP family
  misc_feature: Phenotype: FLOWER - Reduced fertility Useful for sterility, genetic confinement systems
  misc_feature: Phenotype: WHOLE PLANT - Small Useful for modulating plant size
MANRYDPNPFAEEEEVNPFANARGVPPASNSRLSPLPPEPVGFDYGRTVDIPLDRAGTQDLKKKEKELQAKEAELKRREQDLKRKEDAAARAGIVIEVKNWPPFFPLIHHDIANEIPVHLQRLQYVTFATYLGLVLCLFWNIIAVTTAWIKGEGVTIWLLALIYFIAGVPGGYVLWYRPLYRAFRTDSALSFGWFFLFYMLHIAFCVFAAVAPPVVFKGKSLAGILPAIDVLSGQAIVGIFYFIGFAFFCLESVVSIWVIQQVYMYFRGSGKQDQMRREAARGALRAAV

SEQ ID NO: 1051 - DNA, 939 bp, Populus balsamifera subsp. trichocarpa
  misc_feature (1)..(939): Ceres ANNOT ID no. 1448819
  misc_feature 112253:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
atggctggtcgttatgatccaaacccttttgatgaagaggaagttaaccctttcattgacccggctgagaggtcgaaagcatcagggcagtcgaagtatagtgggagtgcattcaacacaacaggtgttcctcctgcttcaaactcgaggctttcaccacttcctcctgaacctgctggtttttacaattatggtacaacggtcgacattcctattgatgcagctgcggtagggatgggattcttgttggatttaagaaagaaagagaaggaacttcaggctagggaggctgagctgagaagacgggagaaggtaaagaggttagaagatgcagctgcaagagctggagttgtcctggaagagaaaaactggccaccatttttcccaattatccatcatgatgtcgcaaacgaaataccagttcatctacaaaaaattcagtatgttgcattaacaacatttttaggattgactttttgtcttttctggaatgtcatcgctgttacaacagcatggattcatggggaaggggtgaacatctggtttctttctgttaactacttcatatcaggagttcctggagcttattttttgtggtatcgtccactctatcgtgcatttaggactgcgagtgctatgaggttcggatggtttttcttgttttatgtgcttcacattggcttctgcatctttgctgctgtggctcctcctataattttcaaaggaaaatctctcactggtattatggctgccgtagatgttgtgggtaactatactatagccgggatcttctacttcatcggatttggttgtttctgtcttgagtcactgctaagcatctgggttgttcagcaagtatacatgtacttccgtggaagtggcaaagctgcccagatgaagcgtgaagctgctagaggagcattgagggcagcagtttga

SEQ ID NO: 1052 - protein, 312 aa, Populus balsamifera subsp. trichocarpa
  misc_feature (1)..(312): Ceres ANNOT ID no. 1448819
  misc_feature (120)..(294): Pfam Name: SCAMP Pfam Description: SCAMP family
  misc_feature: SWISSPROT Homolog: SCAM2_MOUSE Secretory carrier-associated membrane protein 2 (Secretory carrier membrane protein 2) with e-value of 6.3e-28 and BLAST sequence identity of 27.5
  misc_feature: SWISSPROT Homolog: SCAM2_HUMAN Secretory carrier-associated membrane protein 2 (Secretory carrier membrane protein 2) with e-value of 1.0e-27 and BLAST sequence identity of 27.2
  misc_feature: SWISSPROT Homolog: SCAM3_HUMAN Secretory carrier-associated membrane protein 3 (Secretory carrier membrane protein 3) with e-value of 6.1e-26 and BLAST sequence identity of 29.5
  misc_feature: SWISSPROT Homolog: SCAM3_BOVIN Secretory carrier-associated membrane protein 3 (Secretory carrier membrane protein 3) with e-value of 2.4e-24 and BLAST sequence identity of 28.6
  misc_feature: SWISSPROT Homolog: SCAM1_PIG Secretory carrier-associated membrane protein 1 (Secretory carrier membrane protein 1) with e-value of 4.0e-24 and BLAST sequence identity of 29.4
  misc_feature 112363:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(312): Functional Homolog of  Ceres CLONE ID no. 27197 at SEQ ID NO. 1086 with e-value of 3.60E-116 and BLAST sequence identity of 76.3
MAGRYDPNPFDEEEVNPFIDPAERSKASGQSKYSGSAFNTTGVPPASNSRLSPLPPEPAGFYNYGTTVDIPIDAAAVGMGFLLDLRKKEKELQAREAELRRREKVKRLEDAAARAGVVLEEKNWPPFFPIIHHDVANEIPVHLQKIQYVALTTFLGLTFCLFWNVIAVTTAWIHGEGVNIWFLSVNYFISGVPGAYFLWYRPLYRAFRTASAMRFGWFFLFYVLHIGFCIFAAVAPPIIFKGKSLTGIMAAVDVVGNYTIAGIFYFIGFGCFCLESLLSIWVVQQVYMYFRGSGKAAQMKREAARGALRAAV

SEQ ID NO: 1053 - DNA, 1014 bp, Populus balsamifera subsp. trichocarpa
  misc_feature (1)..(1014): Ceres ANNOT ID no. 1465787
  misc_feature 112463:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
atggctggtcggtacgatcctaacccttttgatgaagaagaagttaaccctttctctgttttagaagtgattaaagggagaattctcagaatcacagggtttagtgaggacccagctgtgagatcgaaagcatcagggcaatcgaagtatggtgggcgtgcatttaacacagcaagtgcccctcctgcatcaaactcgaggctttcaccacttcctcctgaacctgctgacttttacaattacggcaatacagttgacattcctattgatgcacctgcggacttaaggaagaaagagaaggaacttcaagctaaggaggctgaactgagaaggcgggagcaggaggtgaagaggagagaagatgcagctgctagagctggaattgtcctggaagagaaaaattggccaccatttttcccaattatccatcatgatattgcaaatgaaataccagttcatctacagaaaattcaatatgttgcgtttacaacatttctaggtatgtatccgctatctagtttattggatggggtccagggcatgcgccttggccctcttaagtatcccaaccaggaagatctatgtgtattgtattgctgtggctgggtaaacatctggtttctttctgttatctacttcatagcaggagttcctggagcttatgttctgtggtatcgtccactctatcgtgcatttaggactgagagtgctatgaggttcggatggtttttcatgttttatgcgcttcacattggcttctgcatctttgctgctgttgctccacctatagttttcaagggaaagtctctcactggtatcctggctgcagtcgatgttgtcggtaaacatgctttagctgggatcttctacttcatcggattcggttgtttctgtcttgaatcactgctgagcatctgggttattcagcaagtaggcatgtacttccgtggaagtggtaaagctgccgagatgaagcgggaagctgcaagaggagcattgagggcagcaatttga

SEQ ID NO: 1054 - protein, 337 aa, Populus balsamifera subsp. trichocarpa
  misc_feature (1)..(337): Ceres ANNOT ID no. 1465787
  misc_feature (131)..(319): Pfam Name: SCAMP Pfam Description: SCAMP family
  misc_feature: SWISSPROT Homolog: SCAM2_MOUSE Secretory carrier-associated membrane protein 2 (Secretory carrier membrane protein 2) with e-value of 6.3e-28 and BLAST sequence identity of 27.5
  misc_feature: SWISSPROT Homolog: SCAM2_HUMAN Secretory carrier-associated membrane protein 2 (Secretory carrier membrane protein 2) with e-value of 1.0e-27 and BLAST sequence identity of 27.2
  misc_feature: SWISSPROT Homolog: SCAM3_HUMAN Secretory carrier-associated membrane protein 3 (Secretory carrier membrane protein 3) with e-value of 6.1e-26 and BLAST sequence identity of 29.5
  misc_feature: SWISSPROT Homolog: SCAM3_BOVIN Secretory carrier-associated membrane protein 3 (Secretory carrier membrane protein 3) with e-value of 2.4e-24 and BLAST sequence identity of 28.6
  misc_feature: SWISSPROT Homolog: SCAM1_PIG Secretory carrier-associated membrane protein 1 (Secretory carrier membrane protein 1) with e-value of 4.0e-24 and BLAST sequence identity of 29.4
  misc_feature 112575:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(337): Functional Homolog of  Ceres CLONE ID no. 27197 at SEQ ID NO. 1086 with e-value of 5.89E-100 and BLAST sequence identity of 72.3
MAGRYDPNPFDEEEVNPFSVLEVIKGRILRITGFSEDPAVRSKASGQSKYGGRAFNTASAPPASNSRLSPLPPEPADFYNYGNTVDIPIDAPADLRKKEKELQAKEAELRRREQEVKRREDAAARAGIVLEEKNWPPFFPIIHHDIANEIPVHLQKIQYVAFTTFLGMYPLSSLLDGVQGMRLGPLKYPNQEDLCVLYCCGWVNIWFLSVIYFIAGVPGAYVLWYRPLYRAFRTESAMRFGWFFMFYALHIGFCIFAAVAPPIVFKGKSLTGILAAVDVVGKHALAGIFYFIGFGCFCLESLLSIWVIQQVGMYFRGSGKAAEMKREAARGALRAAI

SEQ ID NO: 1055 - protein, 240 aa, Arabidopsis thaliana
  misc_feature (1)..(240): Ceres CLONE ID no. 27460
  misc_feature (115)..(177): Pfam Name: KH_1 Pfam Description: KH domain
  misc_feature (37)..(63): Pfam Name: zf-CCCH Pfam Description: Zinc finger C-x8-C-x5-C-x3-H type (and similar)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Other Useful for making ornamental plants with modified flowers
MDARKRGRPEAAASHNSNGGFKRSKQEMESISTGLGSKSKPCTKFFSTSGCPFGDNCHFLHYVPGGYNAAAQMKNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 1056 - DNA, 897 bp, Populus balsamifera subsp. trichocarpa; identical to SEQ ID NO: 696
  misc_feature (1)..(897): Ceres ANNOT ID no. 1474847
  misc_feature 112791:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Other Useful for making ornamental plants with modified flowers

SEQ ID NO: 1057 - protein, 298 aa, Populus balsamifera subsp. trichocarpa; identical to SEQ ID NO: 697
  misc_feature (1)..(298): Ceres ANNOT ID no. 1474847
  misc_feature (177)..(239): Pfam Name: KH_1 Pfam Description: KH domain
  misc_feature (63)..(75): Pfam Name: zf-CCCH Pfam Description: Zinc finger C-x8-C-x5-C-x3-H type (and similar)
  misc_feature: SWISSPROT Homolog: FUBP1_HUMAN Far upstream element-binding protein 1 (FUSE-binding protein 1) FBP (DNA helicase V) (HDH V) with e-value of 5.6e-10 and BLAST sequence identity of 36.0
  misc_feature: SWISSPROT Homolog: FUBP1_MOUSE Far upstream element-binding protein 1 (FUSE-binding protein 1) FBP with e-value of 1.0e-09 and BLAST sequence identity of 36.0
  misc_feature: SWISSPROT Homolog: FUBP2_RAT Far upstream element-binding protein 2 (FUSE-binding protein 2) with e-value of 1.6e-08 and BLAST sequence identity of 38.1
  misc_feature: SWISSPROT Homolog: FUBP2_RAT KH type splicing regulatory protein (KSRP) MAP2 RNA trans-acting protein 1 (MARTA1)
  misc_feature: SWISSPROT Homolog: ZBP2_CHICK Zipcode-binding protein 2 with e-value of 6.4e-06 and BLAST sequence identity of 36.0
  misc_feature 112924:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Other Useful for making ornamental plants with modified flowers
  misc_feature (1)..(298): Functional Homolog of  Ceres CLONE ID no. 27460 at SEQ ID NO. 1091 with e-value of 1.49E-62 and BLAST sequence identity of 66.2

SEQ ID NO: 1058 - DNA, 813 bp, Populus balsamifera subsp. trichocarpa; identical to SEQ ID NO: 698
  misc_feature (1)..(813): Ceres ANNOT ID no. 1507835
  misc_feature 113042:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Other Useful for making ornamental plants with modified flowers

SEQ ID NO: 1059 - protein, 270 aa, Populus balsamifera subsp. trichocarpa; identical to SEQ ID NO: 699
  misc_feature (1)..(270): Ceres ANNOT ID no. 1507835
  misc_feature (146)..(208): Pfam Name: KH_1 Pfam Description: KH domain
  misc_feature (75)..(101): Pfam Name: zf-CCCH Pfam Description: Zinc finger C-x8-C-x5-C-x3-H type (and similar)
  misc_feature: SWISSPROT Homolog: FUBP1_HUMAN Far upstream element-binding protein 1 (FUSE-binding protein 1) FBP (DNA helicase V) (HDH V) with e-value of 5.6e-10 and BLAST sequence identity of 36.0
  misc_feature: SWISSPROT Homolog: FUBP1_MOUSE Far upstream element-binding protein 1 (FUSE-binding protein 1) FBP with e-value of 1.0e-09 and BLAST sequence identity of 36.0
  misc_feature: SWISSPROT Homolog: FUBP2_RAT Far upstream element-binding protein 2 (FUSE-binding protein 2) with e-value of 1.6e-08 and BLAST sequence identity of 38.1
  misc_feature: SWISSPROT Homolog: FUBP2_RAT KH type splicing regulatory protein (KSRP) MAP2 RNA trans-acting protein 1 (MARTA1)
  misc_feature: SWISSPROT Homolog: ZBP2_CHICK Zipcode-binding protein 2 with e-value of 6.4e-06 and BLAST sequence identity of 36.0
  misc_feature 113173:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Other Useful for making ornamental plants with modified flowers
  misc_feature (1)..(270): Functional Homolog of  Ceres CLONE ID no. 27460 at SEQ ID NO. 1091 with e-value of 5.60E-56 and BLAST sequence identity of 63.6

SEQ ID NO: 1060 - protein, 186 aa, Arabidopsis thaliana
  misc_feature (1)..(186): Ceres CLONE ID no. 27464
  misc_feature (104)..(145): Pfam Name: zf-C3HC4 Pfam Description: Zinc finger, C3HC4 type (RING finger)
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Interveinal Chlorosis Useful for making ornamental plants with modified color
  misc_feature: Phenotype: WHOLE PLANT - Other Useful for making bigger plants
MARLLFRLLQEANSTSPAEASPPFNSDLVLILAVLLCALTCIIGLIAVSRCAWLRRIASRNRSDQTHPPPVAAANKGLKKKVLRSLPKLTYSPDSPPAEKLVECAICLTEFAAGDELRVLPQCGHGFHVSCIDTWLGSHSSCPSCRQILVVTRCHKCGGLPGSSSSGPEPDTRIKQREDGPDNFLP

SEQ ID NO: 1061 - DNA, 585 bp, Populus balsamifera subsp. trichocarpa
  misc_feature (1)..(585): Ceres ANNOT ID no. 1453044
  misc_feature 113370:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Interveinal Chlorosis Useful for making ornamental plants with modified color
  misc_feature: Phenotype: WHOLE PLANT - Other Useful for making bigger plants
atgactcggcctttcaggctcctaaacgctgacatgaactcttcggcgactaccactgggtcgcccccacaaccaccagccacggtggacccagacttcatggtcatactagcagcacttctctgcgctctaatttgtgttcttggcctaatcgctgtagctcgctgcgcttggctccgccgcttatcatcccatactccagcaccaccagttcctctccctcctccttccgtcgccaacaaggggttgaaaaagaaaaccctccgctccctccccaaacaaaccttctctgaagattccgccggaaaattctccgactgtgcaatctgcttaacggaattctcagttggagatgaaatccgtgtgttgcctcagtgtggacatgggtttcacgtggcttgtattgacacgtggttggggtctcactcttcgtgcccttcttgccgtcagattttgatggttgacaggtgtcagaagtgcgggggtttgccttcaggttcgagttctattagtggcggtggtggggctgaaactgaggctggactaaaggagtgtgaagatgatgcaaataggttcttgccgtag

SEQ ID NO: 1062 - protein, 194 aa, Populus balsamifera subsp. trichocarpa
  misc_feature (1)..(194): Ceres ANNOT ID no. 1453044
  misc_feature (107)..(148): Pfam Name: zf-C3HC4 Pfam Description: Zinc finger, C3HC4 type (RING finger)
  misc_feature: SWISSPROT Homolog: ATL1R_ARATH RING-H2 finger protein ATL1R (RING-H2 finger protein ATL8) with e-value of 3.4e-98 and BLAST sequence identity of 99.5
  misc_feature: SWISSPROT Homolog: ATL1B_ARATH RING-H2 finger protein ATL1B with e-value of 2.1e-73 and BLAST sequence identity of 74.1
  misc_feature: SWISSPROT Homolog: ATL2A_ARATH RING-H2 finger protein ATL2A (RING-H2 zinc finger protein RHA3a) with e-value of 3.7e-37 and BLAST sequence identity of 54.1
  misc_feature: SWISSPROT Homolog: ATL4L_ARATH RING-H2 finger protein ATL4L (RING-H2 zinc finger protein RHA3b) with e-value of 1.6e-36 and BLAST sequence identity of 48.8
  misc_feature: SWISSPROT Homolog: ATL1L_ARATH RING-H2 finger protein ATL1L with e-value of 2.0e-29 and BLAST sequence identity of 40.3
  misc_feature 113480:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Interveinal Chlorosis Useful for making ornamental plants with modified color
  misc_feature: Phenotype: WHOLE PLANT - Other Useful for making bigger plants
  misc_feature (1)..(194): Functional Homolog of  Ceres CLONE ID no. 27464 at SEQ ID NO. 1096 with e-value of 4.90E-57 and BLAST sequence identity of 64.8
MTRPFRLLNADMNSSATTTGSPPQPPATVDPDFMVILAALLCALICVLGLIAVARCAWLRRLSSHTPAPPVPLPPPSVANKGLKKKTLRSLPKQTFSEDSAGKFSDCAICLTEFSVGDEIRVLPQCGHGFHVACIDTWLGSHSSCPSCRQILMVDRCQKCGGLPSGSSSISGGGGAETEAGLKECEDDANRFLP

SEQ ID NO: 1063 - DNA, 603 bp, Populus balsamifera subsp. trichocarpa
  misc_feature (1)..(603): Ceres ANNOT ID no. 1451171
  misc_feature 113573:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Interveinal Chlorosis Useful for making ornamental plants with modified color
  misc_feature: Phenotype: WHOLE PLANT - Other Useful for making bigger plants
atgcctcgctttaccagaatactcaacaccaaggcggctgagccaccagctgcggtgaacctggagtccgactttgtcgttatattagcagctcttttatgtgcattgatatgtgtggtgggcctcatagcggcggctcgctgtgcctggctccgccgtgtcaccggtggcgcctccagtggaccacctcctcaggccaaagctaacaagggtgtgaagaagaagaacctccagcttctccccaggttcacttactctgctggaggtgggggcgccaccaccagttttggaacaacagagtgtgcaatttgcttaggtgagtttgttgaaggagatgaagtgagggttttgcctcagtgtggacatggattccatgttggatgcattgacaaatggctcggctctcattcctcttgtccctcttgccgtcagattttggtggtggctaggtgtcagaaatgtggtcagtttcctgcttccacctcctcctcctcttgtggtggtggaaatgccactgaggttgagttgagcactagagaagatggcaatgccaatgatggtaatataaatcgtgccaatgatgcaggcgctttcttgccttga

SEQ ID NO: 1064 - protein, 200 aa, Populus balsamifera subsp. trichocarpa
  misc_feature (1)..(200): Ceres ANNOT ID no. 1451171
  misc_feature (101)..(142): Pfam Name: zf-C3HC4 Pfam Description: Zinc finger, C3HC4 type (RING finger)
  misc_feature: SWISSPROT Homolog: ATL1R_ARATH RING-H2 finger protein ATL1R (RING-H2 finger protein ATL8) with e-value of 3.4e-98 and BLAST sequence identity of 99.5
  misc_feature: SWISSPROT Homolog: ATL1B_ARATH RING-H2 finger protein ATL1B with e-value of 2.1e-73 and BLAST sequence identity of 74.1
  misc_feature: SWISSPROT Homolog: ATL2A_ARATH RING-H2 finger protein ATL2A (RING-H2 zinc finger protein RHA3a) with e-value of 3.7e-37 and BLAST sequence identity of 54.1
  misc_feature: SWISSPROT Homolog: ATL4L_ARATH RING-H2 finger protein ATL4L (RING-H2 zinc finger protein RHA3b) with e-value of 1.6e-36 and BLAST sequence identity of 48.8
  misc_feature: SWISSPROT Homolog: ATL1L_ARATH RING-H2 finger protein ATL1L with e-value of 2.0e-29 and BLAST sequence identity of 40.3
  misc_feature 113685:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Interveinal Chlorosis Useful for making ornamental plants with modified color
  misc_feature: Phenotype: WHOLE PLANT - Other Useful for making bigger plants
  misc_feature (1)..(200): Functional Homolog of  Ceres CLONE ID no. 27464 at SEQ ID NO. 1096 with e-value of 1.89E-48 and BLAST sequence identity of 60.4
MPRFTRILNTKAAEPPAAVNLESDFVVILAALLCALICVVGLIAAARCAWLRRVTGGASSGPPPQAKANKGVKKKNLQLLPRFTYSAGGGGATTSFGTTECAICLGEFVEGDEVRVLPQCGHGFHVGCIDKWLGSHSSCPSCRQILVVARCQKCGQFPASTSSSSCGGGNATEVELSTREDGNANDGNINRANDAGAFLP

SEQ ID NO: 1065 - protein, 389 aa, Arabidopsis thaliana
  misc_feature (1)..(389): Ceres CLONE ID no. 27477
  misc_feature (330)..(350): Pfam Name: Pkinase_Tyr Pfam Description: Protein tyrosine kinase
  misc_feature: Phenotype: WHOLE PLANT - Misc. Dwarf Useful for modulating plant size
MGGCFSNRIKTDIASSTWLSSKFLSRDGSKGSSTASFSYMPRTEGEILQNANLKNFSLSELKSATRNFRPDSVVGEGGFGCVFKGWIDESSLAPSKPGTGIVIAVKRLNQEGFQGHREWLAEINYLGQLDHPNLVKLIGYCLEEEHRLLVYEFMTRGSLENHLFRRGTFYQPLSWNTRVRMALGAARGLAFLHNAQPQVIYRDFKASNILLDSNYNAKLSDFGLARDGPMGDNSHVSTRVMGTQGYAAPEYLATGHLSVKSDVYSFGVVLLELLSGRRAIDKNQPVGEHNLVDWARPYLTNKRRLLRVMDPRLQGQYSLTRALKIAVLALDCISIDAKSRPTMNEIVKTMEELHIQKEASKEQQNPQISIDNIINKSPQAVNYPRPSIM

SEQ ID NO: 1066 - DNA, 1200 bp, Populus balsamifera subsp. trichocarpa
  misc_feature (1)..(1200): Ceres ANNOT ID no. 1535293
  misc_feature 113881:<222: Transcription Factor
  misc_feature: Phenotype: WHOLE PLANT - Misc. Dwarf Useful for modulating plant size
atgggactttgttggagcaatcgaatcaagtcttatacttgttctaatacgggtttgagttcaaaatgcggaagcagaaatgggaaaactttgagtagttctagtagcaaagtgtcgatagtttctgtaccccaaacacctcggagtgagggtgaaatcttgcagtcttcgaatttaaagatctttaccttcggtgagctgaagactgccactagaaatttccgaccagacagtgtattaggagaaggtggttttgggtcagtttttaaagggtgggttgatgaacactcacttgcagctaccagaccaggcaccggtatggtgattgctgtgaagaggctaaaccaagaagggttccagggtcacagggaatggctggcagaaatcaactatcttgggcaattccaacaccctaatcttgttaagttgattggttactgcttagaggatgaccatcgtcttctggtttatgaattcatgccccgtggcagcatggaaaaccatttattcaggagagggtctcacttccagccactttcctggaacattcgaatgaaagttgcacttggtgctgcaagggggcttgcctttcttcacagtgctgacgcaaaagtcatatatcgtgacttcaagacgtctaacatcctacttgattcgaactacaatgcaaagctttctgatttcggtttagccagggatggaccaactggcgataatagtcatgtatctactagggtgatgggaacccatggatatgcagcaccagagtatttagccacaggtcatttgactccaaagagcgatgtatacagctttggagttgtacttctggaaatgttatctggtcgacgggctatagacaagaaccggccatctggtcagcacaacctggtggaatgggccaaaccttacctgacaaacaagcgtagagttttccgtgttctggatacacgtcttgaaggccagtatgtacccagtcgggctcaaaagctttctaaccttgcacttcaatgcttagctgtggaaccgaagttcaggccaaatatggatgaggtggtaatggtgttagagcagcttcaagaacaagtaaaggacataccaaaaatttcccataaagagcacaatttaaaagttcgtgggggtgccaatggtggacagattgcttatcccaggccttcggcatccccactttatgcataa

SEQ ID NO: 1067 - protein, 399 aa, Populus balsamifera subsp. trichocarpa
  misc_feature (1)..(399): Ceres ANNOT ID no. 1535293
  misc_feature (329)..(356): Pfam Name: Pkinase_Tyr Pfam Description: Protein tyrosine kinase
  misc_feature: SWISSPROT Homolog: NAK_ARATH Probable serine/threonine-protein kinase NAK (EC 2.7.11.1) with e-value of 7.9e-209 and BLAST sequence identity of 100.0
  misc_feature: SWISSPROT Homolog: APK1A_ARATH Protein kinase APK1A, chloroplast precursor (EC 2.7.11.1) with e-value of 5.0e-136 and BLAST sequence identity of 70.5
  misc_feature: SWISSPROT Homolog: APK1B_ARATH Protein kinase APK1B, chloroplast precursor (EC 2.7.11.1) with e-value of 1.0e-135 and BLAST sequence identity of 66.5
  misc_feature: SWISSPROT Homolog: CX32_ARATH Probable serine/threonine-protein kinase Cx32, chloroplast precursor (EC 2.7.11.1) with e-value of 1.4e-99 and BLAST sequence identity of 53.8
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 54.5
  misc_feature 113994:<222: Transcription Factor
  misc_feature: Phenotype: WHOLE PLANT - Misc. Dwarf Useful for modulating plant size
  misc_feature (1)..(399): Functional Homolog of  Ceres CLONE ID no. 27477 at SEQ ID NO. 1101 with e-value of 5.60E-143 and BLAST sequence identity of 71.1
MGLCWSNRIKSYTCSNTGLSSKCGSRNGKTLSSSSSKVSIVSVPQTPRSEGEILQSSNLKIFTFGELKTATRNFRPDSVLGEGGFGSVFKGWVDEHSLAATRPGTGMVIAVKRLNQEGFQGHREWLAEINYLGQFQHPNLVKLIGYCLEDDHRLLVYEFMPRGSMENHLFRRGSHFQPLSWNIRMKVALGAARGLAFLHSADAKVIYRDFKTSNILLDSNYNAKLSDFGLARDGPTGDNSHVSTRVMGTHGYAAPEYLATGHLTPKSDVYSFGVVLLEMLSGRRAIDKNRPSGQHNLVEWAKPYLTNKRRVFRVLDTRLEGQYVPSRAQKLSNLALQCLAVEPKFRPNMDEVVMVLEQLQEQVKDIPKISHKEHNLKVRGGANGGQIAYPRPSASPLYA

SEQ ID NO: 1068 - DNA, 1137 bp, Populus balsamifera subsp. trichocarpa
  misc_feature (1)..(1137): Ceres ANNOT ID no. 1481806
  misc_feature 114102:<222: Transcription Factor
  misc_feature: Phenotype: WHOLE PLANT - Misc. Dwarf Useful for modulating plant size
atgggtttgagttcaaaatgcggaagcagaaatgggaaaactttgagtagttctagtagcaaagtgtcgatagtttctgtaccccaaacacctcggagtgagggtgaaatcttgcagtcttcgaatttaaagatctttaccttcggtgagctgaagactgccactagaaatttccgaccagacagtgtattaggagaaggtggttttgggtcagtttttaaagggtgggttgatgaacactcacttgcagctaccagaccaggcaccggtatggtgattgctgtgaagaggctaaaccaagaagggttccagggtcacagggaatggctggcagaaatcaactatcttgggcaattccaacaccctaatcttgttaagttgattggttactgcttagaggatgaccatcgtcttctggtttatgaattcatgccccgtggcagcatggaaaaccatttattcaggagagggtctcacttccagccactttcctggaacattcgaatgaaagttgcacttggtgctgcaagggggcttgcctttcttcacagtgctgacgcaaaagtcatatatcgtgacttcaagacgtctaacatcctacttgattcgaactacaatgcaaagctttctgatttcggtttagccagggatggaccaactggcgataatagtcatgtatctactagggtgatgggaacccatggatatgcagcaccagagtatttagccacaggtcatttgactccaaagagcgatgtatacagctttggagttgtacttctggaaatgttatctggtcgacgggctatagacaagaaccggccatctggtcagcacaacctggtggaatgggccaaaccttacctgacaaacaagcgtagagttttccgtgttctggatacacgtcttgaaggccagtatgtacccagtcgggctcaaaagctttctaaccttgcacttcaatgcttagctgtggaaccgaagttcaggccaaatatggatgaggtggtaatggtgttagagcagcttcaagaacaaagtgtgaacagaagtcagaatcatggaatccacatagatttggatgatgctgcgatattgttatacctgcaagcagctgcagaaatgccgagttcatga

SEQ ID NO: 1069 - protein, 378 aa, Populus balsamifera subsp. trichocarpa
  misc_feature (1)..(378): Ceres ANNOT ID no. 1481806
  misc_feature (313)..(340): Pfam Name: Pkinase_Tyr Pfam Description: Protein tyrosine kinase
  misc_feature: SWISSPROT Homolog: NAK_ARATH Probable serine/threonine-protein kinase NAK chloroplast precursor (EC 2.7.11.1) with e-value of 7.9e-209 and BLAST sequence identity of 100.0
  misc_feature: SWISSPROT Homolog: APK1A_ARATH Protein kinase APK1A, chloroplast precursor (EC 2.7.11.1) with e-value of 5.0e-136 and BLAST sequence identity of 70.5
  misc_feature: SWISSPROT Homolog: APK1B_ARATH Protein kinase APK1B, chloroplast precursor (EC 2.7.11.1) with e-value of 1.0e-135 and BLAST sequence identity of 66.5
  misc_feature: SWISSPROT Homolog: CX32_ARATH Probable serine/threonine-protein kinase Cx32, chloroplast precursor (EC 2.7.11.1) with e-value of 1.4e-99 and BLAST sequence identity of 53.8
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 54.5
  misc_feature 114211:<222: Transcription Factor
  misc_feature: Phenotype: WHOLE PLANT - Misc. Dwarf Useful for modulating plant size
  misc_feature (1)..(378): Functional Homolog of  Ceres CLONE ID no. 27477 at SEQ ID NO. 1101 with e-value of 2.59E-138 and BLAST sequence identity of 74.0
MGLSSKCGSRNGKTLSSSSSKVSIVSVPQTPRSEGEILQSSNLKIFTFGELKTATRNFRPDSVLGEGGFGSVFKGWVDEHSLAATRPGTGMVIAVKRLNQEGFQGHREWLAEINYLGQFQHPNLVKLIGYCLEDDHRLLVYEFMPRGSMENHLFRRGSHFQPLSWNIRMKVALGAARGLAFLHSADAKVIYRDFKTSNILLDSNYNAKLSDFGLARDGPTGDNSHVSTRVMGTHGYAAPEYLATGHLTPKSDVYSFGVVLLEMLSGRRAIDKNRPSGQHNLVEWAKPYLTNKRRVFRVLDTRLEGQYVPSRAQKLSNLALQCLAVEPKFRPNMDEVVMVLEQLQEQSVNRSQNHGIHIDLDDAAILLYLQAAAEMPSS

SEQ ID NO: 1070 - protein, 311 aa, Arabidopsis thaliana
  misc_feature (1)..(311): Ceres CLONE ID no. 27793
  misc_feature (1)..(311): Also Known As Ceres CDNA ID no. 23373749
  misc_feature (1)..(311): Also Known As Ceres GEMINI ID 535D2
  misc_feature (46)..(96): Pfam Name: HLH Pfam Description: Helix-loop-helix DNA-binding domain
  misc_feature 114336:<222: Transcription Factor
  misc_feature: Phenotype: Activates expression of the gene endogenous to the AtDXPR (SEQ ID NO 4143) regalutory region Useful for modulating Terpenoid Biosynthesis
MRTGKRNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKRLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 1071 - DNA, 969 bp, Populus balsamifera subsp. trichocarpa
  misc_feature (1)..(969): Ceres ANNOT ID no. 1517449
  misc_feature 114421:<222: Transcription Factor
  misc_feature: Phenotype: Activates expression of the gene endogenous to the AtDXPR (SEQ ID NO 4143) regalutory region Useful for modulating Terpenoid Biosynthesis
atgagaggaaaagggaatcaaaatcaagaggaggaagagtacgaggaagatgaatttggttccagaaaagatgggccatcttcaaattttacaatagacaacactaattcttgtaaagatgggaagcatagtgacaaggctaatgcaataagatcgaaacattctgtcactgagcagaaaaggaggagcaagataaacgagagatttcagatattgagagatctcattcctcatagtgatcaaaagagagatacagcatcatttttattagaggtaattgaatatgtccagtatttacaggagaaggtgcaaaagtatgagggtccatatcccggatggagtcctgagccagcaaagttgatgccatggagaaacagccactggcgcctgcaaagttttgttggtcaccctcaagctactaaaaatggttctggtctaggggcagcatttccagggaaacttgatgagaataacattactctcaccccagccatgcttccaagcactccaaatctaatagaatctgaccatgtcacctgcaaagtgttggagcatcaacctgagctagcaaatgctcttcccatgcccgctcctgctcgaagtgatggacttgttgcacctccccttgagcaaccagtctctgatgctcaatcagctgagtgccccatcaccagtgaaatgttgaaccagcaggagctggcaattgaagcagggactatcagtatctccagtgtttactctcaagagttgctgaatacccttacgcaagcattgcagagtgccagtgtagatctgtcacaggccaacatctcagttcagattgatcttggaaaacgggcaaataaagggctggcctctggaacatcaacatctaaggatccccaggattgcaatcaagtgatgacccaccttagggatgcaagtgaaggagaggactcggatcaagctcaaaaacggctaaagacataa

SEQ ID NO: 1072 - protein, 322 aa, Populus balsamifera subsp. trichocarpa
  misc_feature (1)..(322): Ceres ANNOT ID no. 1517449
  misc_feature (50)..(100): Pfam Name: HLH Pfam Description: Helix-loop-helix DNA-binding domain
  misc_feature: SWISSPROT Homolog: BIM2_ARATH Putative transcription factor BIM2 with e-value of 5.3e-164 and BLAST sequence identity of 99.4
  misc_feature: SWISSPROT Homolog: BIM2_ARATH BES1-interacting Myc-like protein 2 Transcription factor EN 125 AtbHLH 102
  misc_feature: SWISSPROT Homolog: BIM1_ARATH Transcription factor BIM1 (BES1-interacting Myc-like protein 1) (Transcription factor EN 126) (AtbHLH 46) with e-value of 1.7e-41 and BLAST sequence identity of 35.9
  misc_feature: SWISSPROT Homolog: BIM3_ARATH Putative transcription factor BIM3 with e-value of 4.9e-35 and BLAST sequence identity of 36.0
  misc_feature: SWISSPROT Homolog: BIM3_ARATH BES1-interacting Myc-like protein 3 Transcription factor EN 127 AtbHLH 141
  misc_feature: SWISSPROT Homolog: SPT_ARATH Protein SPATULA with e-value of 5.1e-08 and BLAST sequence identity of 40.8
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 1.7e-06 and BLAST sequence identity of 32.1
  misc_feature 114541:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(322): Functional Homolog of  Ceres CLONE ID no. 27793 at SEQ ID NO. 1106 with e-value of 1.00E-88 and BLAST sequence identity of 61.7
MRGKGNQNQEEEEYEEDEFGSRKDGPSSNFTIDNTNSCKDGKHSDKANAIRSKHSVTEQKRRSKINERFQILRDLIPHSDQKRDTASFLLEVIEYVQYLQEKVQKYEGPYPGWSPEPAKLMPWRNSHWRLQSFVGHPQATKNGSGLGAAFPGKLDENNITLTPAMLPSTPNLIESDHVTCKVLEHQPELANALPMPAPARSDGLVAPPLEQPVSDAQSAECPITSEMLNQQELAIEAGTISISSVYSQELLNTLTQALQSASVDLSQANISVQIDLGKRANKGLASGTSTSKDPQDCNQVMTHLRDASEGEDSDQAQKRLKT

SEQ ID NO: 1073 - DNA, 990 bp, Populus balsamifera subsp. trichocarpa
  misc_feature (1)..(990): Ceres ANNOT ID no. 1512061
  misc_feature 114637:<222: Transcription Factor
  misc_feature: Phenotype: Activates expression of the gene endogenous to the AtDXPR (SEQ ID NO 4143) regalutory region Useful for modulating Terpenoid Biosynthesis
atgagaggaaaagggaatcaaaatcaagtcgaggaagagtacgaggaagatgagtttggttctagaaaagatgggccgtcttcaagttttacagtgaacaacaataattccagtaaagatgggaagaatagtgacagggctaatgcaataagatcgaaacattccgtcactgagcagcgaagaaggagcaagatcaatgagagatttcagatattgagagatcttattcctcatagtgatcaaaagagagacacggcatcgtttttattagaggtcattgaatatgtccagcatttacaggaaaaggtgcaaaagtatgagggtccataccagggatggagccctgagccagcaaagttgatgccatggagaaacagccactggcgccttcaaagttctgtcggtcaccctcaagctattaaaaatggttatgttccaggagaaacatttccaggtaaacttgatgagaataacattgctctcacaccagccatgcttccaagcacaccgaatctagtagaatccgaccatgttgcttgcaaagtgttggaacaccaacctgagctaggaaacaaggctatgcctcttcccacgcctgctcccattcgaagtgttggacttgttgctcacccctgtcaactaccagtctctgatgctcaatcagctgagtgtcccatcaccagtgaaatgttgaaccagcaggagctggcaattgaagcagggacaatcaatatctccagtgtttactctcaagagttgctgaatactcttacgcaatcgctgcagagtgctggtgtagatctatcgcaagctaacatctcagttcagattgatctcggaaaacgggcaaatagagggctgacctctggtacattgacatctaaggatccccagaatccccatcctaccaatgaaatgataacccaccttagggatgcaagtggaggagaggattcagatcaagctcaaaagcggctaaagacatcgtaa

SEQ ID NO: 1074 - protein, 329 aa, Populus balsamifera subsp. trichocarpa
  misc_feature (1)..(329): Ceres ANNOT ID no. 1512061
  misc_feature (50)..(100): Pfam Name: HLH Pfam Description: Helix-loop-helix DNA-binding domain
  misc_feature: SWISSPROT Homolog: BIM2_ARATH Putative transcription factor BIM2 with e-value of 5.3e-164 and BLAST sequence identity of 99.4
  misc_feature: SWISSPROT Homolog: BIM2_ARATH BES1-interacting Myc-like protein 2 Transcription factor EN 125 AtbHLH 102
  misc_feature: SWISSPROT Homolog: BIM1_ARATH Transcription factor BIM1 (BES1-interacting Myc-like protein 1) (Transcription factor EN 126) (AtbHLH 46) with e-value of 1.7e-41 and BLAST sequence identity of 35.9
  misc_feature: SWISSPROT Homolog: BIM3_ARATH Putative transcription factor BIM3 with e-value of 4.9e-35 and BLAST sequence identity of 36.0
  misc_feature: SWISSPROT Homolog: BIM3_ARATH BES1-interacting Myc-like protein 3 Transcription factor EN 127 AtbHLH 141
  misc_feature: SWISSPROT Homolog: SPT_ARATH Protein SPATULA with e-value of 5.1e-08 and BLAST sequence identity of 40.8
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 1.7e-06 and BLAST sequence identity of 32.1
  misc_feature 114757:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(329): Functional Homolog of  Ceres CLONE ID no. 27793 at SEQ ID NO. 1106 with e-value of 7.29E-86 and BLAST sequence identity of 60.5
MRGKGNQNQVEEEYEEDEFGSRKDGPSSSFTVNNNNSSKDGKNSDRANAIRSKHSVTEQRRRSKINERFQILRDLIPHSDQKRDTASFLLEVIEYVQHLQEKVQKYEGPYQGWSPEPAKLMPWRNSHWRLQSSVGHPQAIKNGYVPGETFPGKLDENNIALTPAMLPSTPNLVESDHVACKVLEHQPELGNKAMPLPTPAPIRSVGLVAHPCQLPVSDAQSAECPITSEMLNQQELAIEAGTINISSVYSQELLNTLTQSLQSAGVDLSQANISVQIDLGKRANRGLTSGTLTSKDPQNPHPTNEMITHLRDASGGEDSDQAQKRLKTS

SEQ ID NO: 1075 - protein, 225 aa, Arabidopsis thaliana
  misc_feature (1)..(225): Ceres CLONE ID no. 27810
  misc_feature (42)..(209): Pfam Name: CDP-OH_P_transf Pfam Description: CDP-alcohol phosphatidyltransferase
  misc_feature: Phenotype: INFLORESCENCE - Short Useful for modulating plant height
MAKQRPATLSVYLYIPNIVGYMRVLLNCIAFSVCFSNKTLFSLLYFFSFCCDAVDGWCARKFNQVSTFGAVLDMVTDRVSTACLLVILSQIYRPSLVFLSLLALDIASHWLQMYSTFLSGKTSHKDVKDSTSWLFRLYYGNRMFMGYCCVSCEVLYIILLLIATNQTENLMNVVVKSLMQISPLSLLLALSIFGWSIKQIINVIQMKTAADVCVLYDIEKQHKKP

SEQ ID NO: 1076 - DNA, 693 bp, Populus balsamifera subsp. trichocarpa
  misc_feature (1)..(693): Ceres ANNOT ID no. 1503622
  misc_feature 114926:<222: Transcription Factor
  misc_feature: Phenotype: INFLORESCENCE - Short Useful for modulating plant height
atggccaagaacaataagtcaggaccaagaaaaccaggaaaattaagtgtttatctttatattcccaatattattgggtatacaagagtgttcatgaattgctatgcatttgctatatgtttttctaacaaatggctattttgcgctctttattttatcagctttgtttgtgatggtgttgatggttggtgtgctcgcaaattcaatcaagtttcaacttttggagctgttttggacatggtaacagacaggattagcacagcttgcctactagtaattctttcccaagtatacaggcctggcatggtttttctgtcattgcttgccctcgacattgctagccactggctgcagatgtacagcactttcttgctaggcaaagttagccataaagatgtgaaagacagcactaattggctcttcaaggcttactatggaaatcgtatgtttatggcttattgttgcgtagcatgtgaggttctttatattactctgtttcttcttgctaaaaatgacgccgaaaagttgatggacgttttaaaggcttctataacagagggttcacccatctctgtcctagttggtttaagtttgttcggatgggcaatcaaacaacttgtgaatgtgattcagatgaaaactgctgctgatatttgcgtgcttcatgatatcaacaaaaaggtgaggccgtga

SEQ ID NO: 1077 - protein, 230 aa, Populus balsamifera subsp. trichocarpa
  misc_feature (1)..(230): Ceres ANNOT ID no. 1503622
  misc_feature (48)..(169): Pfam Name: CDP-OH_P_transf Pfam Description: CDP-alcohol phosphatidyltransferase
  misc_feature: SWISSPROT Homolog: PIS2_ARATH Probable CDP-diacylglycerol--inositol 3- phosphatidyltransferase 2 with e-value of 1.5e-118 and BLAST sequence identity of 100.0
  misc_feature: SWISSPROT Homolog: PIS2_ARATH EC 2.7.8.11 (Phosphatidylinositol synthase 2) (PtdIns synthase 2) (PI synthase 2) (AtPIS2)
  misc_feature: SWISSPROT Homolog: PIS1_ARATH CDP-diacylglycerol--inositol 3-phosphatidyltransferase 1 with e-value of 8.2e-104 and BLAST sequence identity of 87.6
  misc_feature: SWISSPROT Homolog: PIS1_ARATH EC 2.7.8.11 (Phosphatidylinositol synthase 1) PtdIns synthase 1 (PI synthase 1) (AtPIS1)
  misc_feature: SWISSPROT Homolog: YAT8_SCHPO Hypothetical protein C1D4.08 in chromosome I with e-value of 1.7e-32 and BLAST sequence identity of 37.7
  misc_feature: SWISSPROT Homolog: PIS_YEAST CDP-diacylglycerol-inositol 3-phosphatidyltransferase(EC 2.7.8.11) (Phosphatidylinositol synthase) (PTDINS synthase) (PI synthase) with e-value of 1.2e-29 and BLAST sequence identity of 39.2
  misc_feature: SWISSPROT Homolog: CDIPT_RAT CDP-diacylglycerol-inositol 3-phosphatidyltransferase(EC 2.7.8.11) (Phosphatidylinositol synthase) (PtdIns synthase) (PI synthase) with e-value of 4.3e-27 and BLAST sequence identity of 35.2
  misc_feature 115035:<222: Transcription Factor
  misc_feature: Phenotype: INFLORESCENCE - Short Useful for modulating plant height
  misc_feature (1)..(230): Functional Homolog of  Ceres CLONE ID no. 27810 at SEQ ID NO. 1111 with e-value of 6.00E-91 and BLAST sequence identity of 74.7
MAKNNKSGPRKPGKLSVYLYIPNIIGYTRVFMNCYAFAICFSNKWLFCALYFISFVCDGVDGWCARKFNQVSTFGAVLDMVTDRISTACLLVILSQVYRPGMVFLSLLALDIASHWLQMYSTFLLGKVSHKDVKDSTNWLFKAYYGNRMFMAYCCVACEVLYITLFLLAKNDAEKLMDVLKASITEGSPISVLVGLSLFGWAIKQLVNVIQMKTAADICVLHDINKKVRP

SEQ ID NO: 1078 - DNA, 702 bp, Populus balsamifera subsp. trichocarpa
  misc_feature (1)..(702): Ceres ANNOT ID no. 1450565
  misc_feature 115113:<222: Transcription Factor
  misc_feature: Phenotype: INFLORESCENCE - Short Useful for modulating plant height
atggccaagaacaataagtcaggaccaagaaaaccaggaaaattaagtgtttatctttatattcccaatattattgggtatacaagagtgttcatgaattgctatgcatttgctatatgtttttctaacaaatggctattttgcgctctttattttatcagctttgtttgtgatggtgttgatggttggtgtgctcgcaaattcaatcaagtttcaacttttggagctgttttggacatggtaacagacaggcctggcatggtttttctgtcattgcttgccctcgacattgctagccactggctgcagatgtacagcactttcttgctaggcaaagttagccataaagatgtgaaagacagcactaattggctcttcaaggcttactatggaaatcgtatgtttatggcttattgttgcgtagcatgtgaggttctttatattactctgtttcttcttgctaaaaatgacgccgaaaagttgatggacgttttaaaggcttctataacagagggttcacccatctctgtcctagttggtttaagtttgttcggatgggcaatcaaacaacttgtgaatgtgattcagatgaaaactgctgctgatatttgcgtgcttcatgatatcaacaaaaaggccgtgaatttgaaacagcttgatatcgatgacatgacaatgagatttttctaccatgctgcgtag

SEQ ID NO: 1079 - protein, 233 aa, Populus balsamifera subsp. trichocarpa
  misc_feature (1)..(233): Ceres ANNOT ID no. 1450565
  misc_feature (48)..(197): Pfam Name: CDP-OH_P_transf Pfam Description: CDP-alcohol phosphatidyltransferase
  misc_feature: SWISSPROT Homolog: PIS2_ARATH Probable CDP-diacylglycerol--inositol 3- phosphatidyltransferase 2 with e-value of 1.5e-118 and BLAST sequence identity of 100.0
  misc_feature: SWISSPROT Homolog: PIS2_ARATH EC 2.7.8.11 (Phosphatidylinositol synthase 2) (PtdIns synthase 2) (PI synthase 2) (AtPIS2)
  misc_feature: SWISSPROT Homolog: PIS1_ARATH CDP-diacylglycerol--inositol 3-phosphatidyltransferase 1 with e-value of 8.2e-104 and BLAST sequence identity of 87.6
  misc_feature: SWISSPROT Homolog: PIS1_ARATH EC 2.7.8.11 (Phosphatidylinositol synthase 1) PtdIns synthase 1 (PI synthase 1) (AtPIS1)
  misc_feature: SWISSPROT Homolog: YAT8_SCHPO Hypothetical protein C1D4.08 in chromosome I with e-value of 1.7e-32 and BLAST sequence identity of 37.7
  misc_feature: SWISSPROT Homolog: PIS_YEAST CDP-diacylglycerol-inositol 3-phosphatidyltransferase(EC 2.7.8.11) (Phosphatidylinositol synthase) (PTDINS synthase) (PI synthase) with e-value of 1.2e-29 and BLAST sequence identity of 39.2
  misc_feature: SWISSPROT Homolog: CDIPT_RAT CDP-diacylglycerol-inositol 3-phosphatidyltransferase(EC 2.7.8.11) (Phosphatidylinositol synthase) (PtdIns synthase) (PI synthase) with e-value of 4.3e-27 and BLAST sequence identity of 35.2
  misc_feature 115222:<222: Transcription Factor
  misc_feature: Phenotype: INFLORESCENCE - Short Useful for modulating plant height
  misc_feature (1)..(233): Functional Homolog of  Ceres CLONE ID no. 27810 at SEQ ID NO. 1111 with e-value of 9.99E-80 and BLAST sequence identity of 73.8
MAKNNKSGPRKPGKLSVYLYIPNIIGYTRVFMNCYAFAICFSNKWLFCALYFISFVCDGVDGWCARKFNQVSTFGAVLDMVTDRPGMVFLSLLALDIASHWLQMYSTFLLGKVSHKDVKDSTNWLFKAYYGNRMFMAYCCVACEVLYITLFLLAKNDAEKLMDVLKASITEGSPISVLVGLSLFGWAIKQLVNVIQMKTAADICVLHDINKKAVNLKQLDIDDMTMRFFYHAA

SEQ ID NO: 1080 - protein, 220 aa, Arabidopsis thaliana
  misc_feature (1)..(220): Ceres CLONE ID no. 28003
  misc_feature (74)..(171): Pfam Name: Cyt-b5 Pfam Description: Cytochrome b5-like Heme/Steroid binding domain
  misc_feature: Phenotype: WHOLE PLANT - Misc. Dwarf Useful for modulating plant size
  misc_feature: Phenotype: FLOWER - Sterile Useful for sterility, genetic confinement systems
MALELWQTLKEAIHAYTGLSPVVFFTALALAFAIYQVISGWFASPFDDVNRHQRARSLAQEEEPPIPQPVQVGEITEEELKQYDGSDPQKPLLMAIKHQIYDVTQSRMFYGPGGPYALFAGKDASRALAKMSFEEKDLTWDISGLGPFELDALQDWEYKFMSKYAKVGTVKVAGSEPETASVSEPTENVEQDAHVTTTPEKTVVDKSDDAPAETVLKKEE

SEQ ID NO: 1081 - DNA, 648 bp, Populus balsamifera subsp. trichocarpa
  misc_feature (1)..(648): Ceres ANNOT ID no. 1527756
  misc_feature 115377:<222: Transcription Factor
  misc_feature: Phenotype: WHOLE PLANT - Misc. Dwarf Useful for modulating plant size
  misc_feature: Phenotype: FLOWER - Sterile Useful for sterility, genetic confinement systems
atggctttggaactatgggaaacactgaaagaagccataacagcatacacaggactatcaccagcaactttctttacagttttagctttagggttagccgcttattatgtgatatcaggtttttttggtgggtctgataatcatcaacatgttccaagacaatatgaagagcagatgcaacctttacctccacctgttcaacttggtgaagtcaccgaagaagaactaaaacagtatgatggtactgactctacaaagcctttgcttatggctattaagggtcagatctatgatgtttctcaaagcaggatgttttatggacctggcggaccttatgcattgtttgctggcaaggatgctagcagggctctagcaaagatgtcttttgaagataaagatttaaccggtgatgtctctggtcttggtccatttgaattggaagccttgcaggactgggaatacaagttcatgagcaaatatgaaaaggttgggacaatcaagaatacagttccagtaactgatggaacctccaccagtgaacctgctgcagaggctacagaaagtgatgcttctaagccagctgaagatggtccagcagctactgcacatgtcgaaacccccgctgttgctgaatccaaggaggaatag

SEQ ID NO: 1082 - protein, 215 aa, Populus balsamifera subsp. trichocarpa
  misc_feature (1)..(215): Ceres ANNOT ID no. 1527756
  misc_feature (70)..(167): Pfam Name: Cyt-b5 Pfam Description: Cytochrome b5-like Heme/Steroid binding domain
  misc_feature: SWISSPROT Homolog: MSBP1_ARATH Membrane steroid-binding protein 1 (AtMP1) with e-value of 2.9e-115 and BLAST sequence identity of 99.1
  misc_feature: SWISSPROT Homolog: SBP2_ARATH Putative steroid binding protein 2 (AtMP2) with e-value of 1.2e-65 and BLAST sequence identity of 63.3
  misc_feature: SWISSPROT Homolog: SBP3_ARATH Putative steroid-binding protein 3 (AtMP3) with e-value of 1.1e-23 and BLAST sequence identity of 52.6
  misc_feature: SWISSPROT Homolog: PGRC1_RAT Membrane-associated progesterone receptor component 1 (Acidic 25 kDa protein) (25-DX) with e-value of 6.7e-22 and BLAST sequence identity of 43.0
  misc_feature: SWISSPROT Homolog: PGRC1_PIG Membrane-associated progesterone receptor component 1 with e-value of 8.6e-22 and BLAST sequence identity of 41.8
  misc_feature 115476:<222: Transcription Factor
  misc_feature: Phenotype: WHOLE PLANT - Misc. Dwarf Useful for modulating plant size
  misc_feature: Phenotype: FLOWER - Sterile Useful for sterility, genetic confinement systems
  misc_feature (1)..(215): Functional Homolog of  Ceres CLONE ID no. 28003 at SEQ ID NO. 1116 with e-value of 1.79E-66 and BLAST sequence identity of 71.4
MALELWETLKEAITAYTGLSPATFFTVLALGLAAYYVISGFFGGSDNHQHVPRQYEEQMQPLPPPVQLGEVTEEELKQYDGTDSTKPLLMAIKGQIYDVSQSRMFYGPGGPYALFAGKDASRALAKMSFEDKDLTGDVSGLGPFELEALQDWEYKFMSKYEKVGTIKNTVPVTDGTSTSEPAAEATESDASKPAEDGPAATAHVETPAVAESKEE

SEQ ID NO: 1083 - DNA, 648 bp, Populus balsamifera subsp. trichocarpa
  misc_feature (1)..(648): Ceres ANNOT ID no. 1468882
  misc_feature 115558:<222: Transcription Factor
  misc_feature: Phenotype: WHOLE PLANT - Misc. Dwarf Useful for modulating plant size
  misc_feature: Phenotype: FLOWER - Sterile Useful for sterility, genetic confinement systems
atggctttggaactatgggaaacactcaaagaagccataacagcatacacaggactatcaccagcaactttctttacagttgcagctttagggttagctgtctactatgtggtatcaggcttgtttggtgggtctgatcatcatcaacatgttccaagacaatctgaagagcagatgcaacctttacctccacctgttcaacttggtgaaatcactgaagaagaactaaaacagtatgatggtactgactctaaaaatcccttgcttatggctattaagggtcagatctatgatgtttctcaaagcaggatgttctatggacctggtggaccttatgcattgtttgctggaaaggatgctagcagagctctagcaaagatgtctttcgaagataaagatttaactggtgatgtctctggtcttggtccatttgaattggaggccttgcaggattgggaatacaagttcatgagtaaatatattaaggttggaacaatcaagaagacggttccagtaactgatggaacctccaccagtgaacctgctgcagaggctacagaaagcgatgttgctaagccagctgaagatgttccatcagttgctgcacctgttgaaactcctgctggtggtgaatccaaggaagagtaa

SEQ ID NO: 1084 - protein, 215 aa, Populus balsamifera subsp. trichocarpa
  misc_feature (1)..(215): Ceres ANNOT ID no. 1468882
  misc_feature (70)..(167): Pfam Name: Cyt-b5 Pfam Description: Cytochrome b5-like Heme/Steroid binding domain
  misc_feature: SWISSPROT Homolog: MSBP1_ARATH Membrane steroid-binding protein 1 (AtMP1) with e-value of 2.9e-115 and BLAST sequence identity of 99.1
  misc_feature: SWISSPROT Homolog: SBP2_ARATH Putative steroid binding protein 2 (AtMP2) with e-value of 1.2e-65 and BLAST sequence identity of 63.3
  misc_feature: SWISSPROT Homolog: SBP3_ARATH Putative steroid-binding protein 3 (AtMP3) with e-value of 1.1e-23 and BLAST sequence identity of 52.6
  misc_feature: SWISSPROT Homolog: PGRC1_RAT Membrane-associated progesterone receptor component 1 (Acidic 25 kDa protein) (25-DX) with e-value of 6.7e-22 and BLAST sequence identity of 43.0
  misc_feature: SWISSPROT Homolog: PGRC1_PIG Membrane-associated progesterone receptor component 1 with e-value of 8.6e-22 and BLAST sequence identity of 41.8
  misc_feature 115657:<222: Transcription Factor
  misc_feature: Phenotype: WHOLE PLANT - Misc. Dwarf Useful for modulating plant size
  misc_feature: Phenotype: FLOWER - Sterile Useful for sterility, genetic confinement systems
  misc_feature (1)..(215): Functional Homolog of  Ceres CLONE ID no. 28003 at SEQ ID NO. 1116 with e-value of 3.79E-66 and BLAST sequence identity of 67.8
MALELWETLKEAITAYTGLSPATFFTVAALGLAVYYVVSGLFGGSDHHQHVPRQSEEQMQPLPPPVQLGEITEEELKQYDGTDSKNPLLMAIKGQIYDVSQSRMFYGPGGPYALFAGKDASRALAKMSFEDKDLTGDVSGLGPFELEALQDWEYKFMSKYIKVGTIKKTVPVTDGTSTSEPAAEATESDVAKPAEDVPSVAAPVETPAGGESKEE

SEQ ID NO: 1085 - protein, 205 aa, Arabidopsis thaliana
  misc_feature (1)..(205): Ceres CLONE ID no. 28033
  misc_feature (28)..(195): Pfam Name: PMEI Pfam Description: Plant invertase/pectin methylesterase inhibitor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MKPSLHQPLFFFFLATVLPLILTVHSQSDDSDFIRTSCNTTLYPDLCFSSLSSFSSSVHNDPALLARAAISITLTKTLDLASYLANITTLQPESQDDGAHHPTAAAVFHDCFDNLKDAVEEMKGSMKQMRELVSTGSLESFRFQMSNVQTWLSAALTDEETCTDGFKDIHDEPRKDDICARVDDVKKMTSNALALVNRCVDKAIH

SEQ ID NO: 1086 - DNA, 639 bp, Populus balsamifera subsp. trichocarpa
  misc_feature (1)..(639): Ceres ANNOT ID no. 1459086
  misc_feature 115813:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atgccatcagaaacgccaggccctctgctactcttcaccttcttcctaacaaccttccttctatattcccaaccaatctcaaccgtcgcttcaccggaccccggcttttctcgatccagcggcacagattacattcgctcaagctgcggcgtaacattgtaccccgaaatctgctacacctccctctctcgctacgccagtgctgtaaaacaaagccccagtcgcctagctcgcgtggccatcggcgtcagcctctcaagagcacgccgcctggcagcctacgtatccaacctaacccgccatgaagacttcggaggcgatcaccgtgccacggccgccattcacgactgcttatccaacatgggagacgccgttgatgagatgagtgggtcgttgaagcagatgcggaaagttggagcagctgggctgtcggcagagtcgtttcagtttcagatgagtaacgtgcagacgtggatgagtgcggctttgacagatgaggagacgtgtacggatggatttgaggatgtagcggacggggctgtgaaaacggaggtgtgtaaccgtgttgcggatgccaagaaatttactagcaatgctcttgctctggttaacacttttgctgccgcaggaacgccatga

SEQ ID NO: 1087 - protein, 212 aa, Populus balsamifera subsp. trichocarpa
  misc_feature (1)..(212): Ceres ANNOT ID no. 1459086
  misc_feature (39)..(202): Pfam Name: PMEI Pfam Description: Plant invertase/pectin methylesterase inhibitor
  misc_feature: SWISSPROT Homolog: 21KD_DAUCA 21 kDa protein precursor (1.2 protein) with e-value of 7.8e-28 and BLAST sequence identity of 37.5
  misc_feature: SWISSPROT Homolog: PME3_PHAVU Pectinesterase-3 precursor (EC 3.1.1.11) (Pectin methylesterase 3) (PE 3) with e-value of 2.2e-13 and BLAST sequence identity of 28.6
  misc_feature: SWISSPROT Homolog: PME1_CITSI Pectinesterase-1 precursor (EC 3.1.1.11) (Pectin methylesterase) (PE) with e-value of 4.8e-13 and BLAST sequence identity of 26.8
  misc_feature: SWISSPROT Homolog: PME3_CITSI Pectinesterase-3 precursor (EC 3.1.1.11) (Pectin methylesterase 3) (PE 3) with e-value of 4.8e-13 and BLAST sequence identity of 26.8
  misc_feature: SWISSPROT Homolog: PMEU1_LYCES Pectinesterase U1 precursor (EC 3.1.1.11) (Pectin methylesterase) (PE) with e-value of 4.4e-12 and BLAST sequence identity of 27.1
  misc_feature 115913:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(212): Functional Homolog of  Ceres CLONE ID no. 28033 at SEQ ID NO. 1121 with e-value of 1.29E-47 and BLAST sequence identity of 57.0
MPSETPGPLLLFTFFLTTFLLYSQPISTVASPDPGFSRSSGTDYIRSSCGVTLYPEICYTSLSRYASAVKQSPSRLARVAIGVSLSRARRLAAYVSNLTRHEDFGGDHRATAAIHDCLSNMGDAVDEMSGSLKQMRKVGAAGLSAESFQFQMSNVQTWMSAALTDEETCTDGFEDVADGAVKTEVCNRVADAKKFTSNALALVNTFAAAGTP

SEQ ID NO: 1088 - protein, 99 aa, Arabidopsis thaliana
  misc_feature (1)..(99): Ceres CLONE ID no. 28326
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: INFLORESCENCE - Short Useful for modulating plant height
MLQFPTLMTQFPSSTKTIPASYLLPLQWPQPQNEEILLAMEEAEFEEKCNEIRKMSPALPVIGKPVVNNEQEEDDNEAEDDDADNAEESDGEEFEQETG

SEQ ID NO: 1089 - DNA, 300 bp, Populus balsamifera subsp. trichocarpa
  misc_feature (1)..(300): Ceres ANNOT ID no. 1468461
  misc_feature 116052:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: INFLORESCENCE - Short Useful for modulating plant height
atgttacagttcccagctttcatgacacagtacccagtttcaacaaggacaattccaacatcgtatttgctaccttcacagtggcctcagcctcaaagcgaagagcttctcctcgccatggaagaatccgatttcgaagacaagtgcaatgaaattagaaagggtgatagcaaccttgctgtgattggaaaaacaactgttgataacgataaagaagagtatgacaatgatgcagatgatgatgatgctgataatgttgaggaatctgaaggtgaagaatttgagcaagaaactagctga

SEQ ID NO: 1090 - protein, 99 aa, Populus balsamifera subsp. trichocarpa
  misc_feature (1)..(99): Ceres ANNOT ID no. 1468461
  misc_feature 116103:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature (1)..(99): Functional Homolog of  Ceres CLONE ID no. 28326 at SEQ ID NO. 1124 with e-value of 7.59E-36 and BLAST sequence identity of 72.4
MLQFPAFMTQYPVSTRTIPTSYLLPSQWPQPQSEELLLAMEESDFEDKCNEIRKGDSNLAVIGKTTVDNDKEEYDNDADDDDADNVEESEGEEFEQETS

SEQ ID NO: 1091 - protein, 153 aa, Arabidopsis thaliana
  misc_feature (1)..(153): Ceres CLONE ID no. 28451
  misc_feature (1)..(153): Also Known As Ceres CDNA ID no. 23416775
  misc_feature (1)..(153): Also Known As Ceres GEMINI ID 531E3
  misc_feature (29)..(92): Pfam Name: AP2 Pfam Description: AP2 domain
  misc_feature 116191:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 1092 - DNA, 468 bp, Populus balsamifera subsp. trichocarpa
  misc_feature (1)..(468): Ceres ANNOT ID no. 1486525
  misc_feature 116247:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaaggagggtgctgtacatcgtcaacaagtactccaagttcaacttcaacagcaaccacagagaaacggaagcatagcaggcaacaaaaccaagagaagccatacagagggataaggatgaggaagtggggtaagtgggtagcagaaattagagaaccaaacaagaggtctaggatttggcttgggtcctactcaacaccaatagctgcagctcgtgcatacgacacggctgttttctatctgcgaggcccttctgctaggcttaatttccctgatttgatataccaagaagatgagctgcgagatgtgtctgctgcttctatacgcaagaaagccactgaagttggggctaaagtggatgccttacaaaccgctgtccatgcatcaccagaagataactcacgagtgttactttcagagaaacctgatttgaacaagttcccagaaaattctgatgaagagtga

SEQ ID NO: 1093 - protein, 155 aa, Populus balsamifera subsp. trichocarpa
  misc_feature (1)..(155): Ceres ANNOT ID no. 1486525
  misc_feature (34)..(97): Pfam Name: AP2 Pfam Description: AP2 domain
  misc_feature: SWISSPROT Homolog: TINY_ARATH Transcriptional factor TINY with e-value of 2.1e-18 and BLAST sequence identity of 47.6
  misc_feature: SWISSPROT Homolog: ERF5_ARATH Ethylene-responsive transcription factor 5 EREBP-5 (AtERF5) with e-value of 2.4e-17 and BLAST sequence identity of 58.3
  misc_feature: SWISSPROT Homolog: DRE2C_ARATH Dehydration-responsive element-binding protein 2C (DREB2C protein) with e-value of 7.0e-17 and BLAST sequence identity of 45.4
  misc_feature: SWISSPROT Homolog: DRE1A_ARATH Dehydration-responsive element-binding protein 1A with e-value of 8.2e-17 and BLAST sequence identity of 63.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: AP23_ARATH AP2 domain transcription factor RAP2.3 (Related to AP2 protein 3) (Cadmium-induced protein AS30) with e-value of 1.0e-16 and BLAST sequence identity of 56.2
  misc_feature 116342:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(155): Functional Homolog of  Ceres CLONE ID no. 28451 at SEQ ID NO. 1127 with e-value of 4.49E-38 and BLAST sequence identity of 64.6
MEGGCCTSSTSTPSSTSTATTEKRKHSRQQNQEKPYRGIRMRKWGKWVAEIREPNKRSRIWLGSYSTPIAAARAYDTAVFYLRGPSARLNFPDLIYQEDELRDVSAASIRKKATEVGAKVDALQTAVHASPEDNSRVLLSEKPDLNKFPENSDEE

SEQ ID NO: 1094 - DNA, 477 bp, Populus balsamifera subsp. trichocarpa
  misc_feature (1)..(477): Ceres ANNOT ID no. 1443820
  misc_feature 116406:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaaggagagtgttatacatcaccaagtgcttcaagttcaactccaacaatatcaagcatagggaagcgtaagcatggtaggcaacaaaaccaggagaagccatatagagggataaggatgaggaagtggggtaagtgggtagctgaaattagagaaccaaacaagaggtctaggatttggcttgggtcctactcaacaccaattgctgcagctcgtgcatacgacacagccgttttctatctccgagggccttctgttaggcttaatttccctgatttgattcaccaagaagatgagttgtgtgatgtgtctgctgcttctatacgcaagaaagccactgaagtcggggctaaagttgatgccttgcaaacagctctccatgcatcaccaggagacaactcgccagcaaatcgactgttactttcagagaaacctgatttgaacgagtacccagagaattgtgatgaagagtga

SEQ ID NO: 1095 - protein, 158 aa, Populus balsamifera subsp. trichocarpa
  misc_feature (1)..(158): Ceres ANNOT ID no. 1443820
  misc_feature (34)..(97): Pfam Name: AP2 Pfam Description: AP2 domain
  misc_feature: SWISSPROT Homolog: TINY_ARATH Transcriptional factor TINY with e-value of 2.1e-18 and BLAST sequence identity of 47.6
  misc_feature: SWISSPROT Homolog: ERF5_ARATH Ethylene-responsive transcription factor 5 EREBP-5 (AtERF5) with e-value of 2.4e-17 and BLAST sequence identity of 58.3
  misc_feature: SWISSPROT Homolog: DRE2C_ARATH Dehydration-responsive element-binding protein 2C (DREB2C protein) with e-value of 7.0e-17 and BLAST sequence identity of 45.4
  misc_feature: SWISSPROT Homolog: DRE1A_ARATH Dehydration-responsive element-binding protein 1A with e-value of 8.2e-17 and BLAST sequence identity of 63.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: AP23_ARATH AP2 domain transcription factor RAP2.3 (Related to AP2 protein 3) (Cadmium-induced protein AS30) with e-value of 1.0e-16 and BLAST sequence identity of 56.2
  misc_feature 116501:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(158): Functional Homolog of  Ceres CLONE ID no. 28451 at SEQ ID NO. 1127 with e-value of 8.50E-37 and BLAST sequence identity of 69.4
MEGECYTSPSASSSTPTISSIGKRKHGRQQNQEKPYRGIRMRKWGKWVAEIREPNKRSRIWLGSYSTPIAAARAYDTAVFYLRGPSVRLNFPDLIHQEDELCDVSAASIRKKATEVGAKVDALQTALHASPGDNSPANRLLLSEKPDLNEYPENCDEE

SEQ ID NO: 1096 - protein, 173 aa, Arabidopsis thaliana
  misc_feature (1)..(173): Ceres CLONE ID no. 28528
  misc_feature (43)..(159): Pfam Name: DUF1677 Pfam Description: Protein of unknown function (DUF1677)
  misc_feature: Phenotype: WHOLE PLANT - Small Useful for modulating plant size
  misc_feature: Phenotype: SILIQUES - Sickle Useful for modifying fruit shape, composition and seed yield
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVVATKPEKGGLARSSSCMPALAKELKDRTLVN

SEQ ID NO: 1097 - DNA, 546 bp, Populus balsamifera subsp. trichocarpa
  misc_feature (1)..(546): Ceres ANNOT ID no. 1477416
  misc_feature 116633:<222: Transcription Factor
  misc_feature: Phenotype: WHOLE PLANT - Small Useful for modulating plant size
  misc_feature: Phenotype: SILIQUES - Sickle Useful for modifying fruit shape, composition and seed yield
atggcaccaaacagagaaacactagttgactcttactcaaagagtggtaacaaagcccacaagccccgtagactttcaatggaaaatctccaaagaacgatatctgacatctcatttgaactcagcaaggaaggagttgatcatcatgcgaagctcgcgccgatttctgagatagaagatgccaagtgtgagtgctgtggcatgtgtgaagagtgcacccctgagtacataaaacgagtgcgagacaagttctcagggaaattggtttgtgggttatgtgcagaagcagttagtcaggaaatggagaaaaatggaggcaataaagaagaggccttgaacgagcacatgaatgcatgcgtacggtttaataggtttgggagggcatatcctgtcttgtcccaatctgaagccatgagggcgatgctaaaaaagagtgcaagtcttcgagccaagtccattagtcctagagatagatcaggtggtcaccagaagggtactactggcattgcaaggagctctagttgtattccatcaatcacaaggtag

SEQ ID NO: 1098 - protein, 155 aa, Populus balsamifera subsp. trichocarpa
  misc_feature (1)..(155): Ceres ANNOT ID no. 1477416
  misc_feature (32)..(150): Pfam Name: DUF1677 Pfam Description: Protein of unknown function (DUF1677)
  misc_feature 116691:<222: Transcription Factor
  misc_feature: Phenotype: WHOLE PLANT - Small Useful for modulating plant size
  misc_feature: Phenotype: SILIQUES - Sickle Useful for modifying fruit shape, composition and seed yield
  misc_feature (1)..(155): Functional Homolog of  Ceres CLONE ID no. 28528 at SEQ ID NO. 1132 with e-value of 4.70E-36 and BLAST sequence identity of 60.9
MENLQRTISDISFELSKEGVDHHAKLAPISEIEDAKCECCGMCEECTPEYIKRVRDKFSGKLVCGLCAEAVSQEMEKNGGNKEEALNEHMNACVRFNRFGRAYPVLSQSEAMRAMLKKSASLRAKSISPRDRSGGHQKGTTGIARSSSCIPSITR

SEQ ID NO: 1099 - protein, 157 aa, Arabidopsis thaliana
  misc_feature (1)..(157): Ceres CLONE ID no. 28602
  misc_feature (51)..(156): Pfam Name: HSP20 Pfam Description: Hsp20/alpha crystallin family
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MSLIPSFFGNNRRSNSIFDPFSLDVWDPFKELQFPSSLSGETSAITNARVDWKETAEAHVFKADLPGMKKEEVKVEIEDDSVLKISGERHVEKEEKQDTWHRVERSSGQFSRKFKLPENVKMDQVKASMENGVLTVTVPKVEEAKKKAQVKSIDISG

SEQ ID NO: 1100 - DNA, 471 bp, Populus balsamifera subsp. trichocarpa
  misc_feature (1)..(471): Ceres ANNOT ID no. 1461728
  misc_feature 116868:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgtcgatgatcccaagtttctttggcaaccgaaggagcagcatcttcgatcctttctctcttgacgtttgggaccctttaaaggatttcccttttccttccccttccttccctcgcgatgaaaactctgcttttgttaacactcgcatcgactggaaggaaaccccagaagcccatgtcttcaaggccgatcttcctggcctcagaaaagaggaagtgaaggtccagattgaagatgatagggttctccaaatcagcggagagaggaatgtcgagaaggaagacaagaacgatacttggcatcgcgtggagaggagcagtggcaaattctcgaggaggtttaggctgcctgaaaataccaagatgaatcaggtcaaggcttctatggaaaatggggttctcacggtgaccgtgcccaaggaagaagcagtcaagaaacctgaagtcaagagcattgaaatctctggttga

SEQ ID NO: 1101 - protein, 156 aa, Populus balsamifera subsp. trichocarpa
  misc_feature (1)..(156): Ceres ANNOT ID no. 1461728
  misc_feature (51)..(155): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 117002:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(156): Functional Homolog of  Ceres CLONE ID no. 28602 at SEQ ID NO. 1135 with e-value of 8.60E-60 and BLAST sequence identity of 79.2
MSMIPSFFGNRRSSIFDPFSLDVWDPLKDFPFPSPSFPRDENSAFVNTRIDWKETPEAHVFKADLPGLRKEEVKVQIEDDRVLQISGERNVEKEDKNDTWHRVERSSGKFSRRFRLPENTKMNQVKASMENGVLTVTVPKEEAVKKPEVKSIEISG

SEQ ID NO: 1102 - DNA, 480 bp, Populus balsamifera subsp. trichocarpa
  misc_feature (1)..(480): Ceres ANNOT ID no. 1488330
  misc_feature 117114:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaatgattccgagcttctttaacaaccgccgaggcggcagcatcttcgactcattctccgcattcgacatttgggatccactcaaagagttccctttcacttccacctcaaattctctcctttctcgtgaaaattcagcctttgtcaacacccgcattgattggaaagagacaccagaagcccatgtcttcaaggcagatcttccagggcttaaaaaagaggaagtgaaggtcgaaattgaagatgacagggtgcttcagattagcggagaaaggaatgtggagaaggaagacaagaacgatgcatggcatagggtggagcgaagcagtggcaagttcttgaggaggtttaggctgcctgagaatgcaaaaatggatcaggtcaaggcttctatggaaaatggagtacttaccgtgactgtgcctaaagaagagatcaagaaacctgatgtcaaggctattgaaatctctggttga

SEQ ID NO: 1103 - protein, 159 aa, Populus balsamifera subsp. trichocarpa
  misc_feature (1)..(159): Ceres ANNOT ID no. 1488330
  misc_feature (55)..(158): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 117250:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(159): Functional Homolog of  Ceres CLONE ID no. 28602 at SEQ ID NO. 1135 with e-value of 3.40E-56 and BLAST sequence identity of 76.6
MAMIPSFFNNRRGGSIFDSFSAFDIWDPLKEFPFTSTSNSLLSRENSAFVNTRIDWKETPEAHVFKADLPGLKKEEVKVEIEDDRVLQISGERNVEKEDKNDAWHRVERSSGKFLRRFRLPENAKMDQVKASMENGVLTVTVPKEEIKKPDVKAIEISG

SEQ ID NO: 1104 - DNA, 477 bp, Populus balsamifera subsp. trichocarpa
  misc_feature (1)..(477): Ceres ANNOT ID no. 1460480
  misc_feature 117362:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaatggttccaagcttctttaacaatcgacgaggcagtagcattttggacccattctctgcttttgacatttgggatccactcaaggacttccctttcacttcctctaattccctcatctctcgtgaaaattcagcttctgttaacacccgcattgattggaaagagaccccagaagcccatgtcttcaaggctgatcttccagggcttaagaaggaggaggtgaaggttgagattgaagatgacagagtcctccagattagcggagagaggagtgtggagaaggaagacaagaacgacacatggcatcgtgtagagcgtaggagtggcaagttctcgaggaggtttaggctgcctgagaatgccaaggtggatcaagttaaggcttcaatggagaatggggttcttactgtcactgtgcctaaggaggaagtcaagaaacctgaagtcaaggcaattgaaatctttggttga

SEQ ID NO: 1105 - protein, 158 aa, Populus balsamifera subsp. trichocarpa
  misc_feature (1)..(158): Ceres ANNOT ID no. 1460480
  misc_feature (54)..(157): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 117496:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(158): Functional Homolog of  Ceres CLONE ID no. 28602 at SEQ ID NO. 1135 with e-value of 7.10E-56 and BLAST sequence identity of 74.6
MAMVPSFFNNRRGSSILDPFSAFDIWDPLKDFPFTSSNSLISRENSASVNTRIDWKETPEAHVFKADLPGLKKEEVKVEIEDDRVLQISGERSVEKEDKNDTWHRVERRSGKFSRRFRLPENAKVDQVKASMENGVLTVTVPKEEVKKPEVKAIEIFG

SEQ ID NO: 1106 - DNA, 468 bp, Populus balsamifera subsp. trichocarpa
  misc_feature (1)..(468): Ceres ANNOT ID no. 1461614
  misc_feature 117608:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaatgattccaagcttcttcaacaaccgatcacgagacatcatcttcgaccctttctcttctttcgatccattcaaggacttccctttcccttcttcttccctcatctctcgtgagaattcagctttcgttaacactcgcattgactggaaagagaccccagaagcccatgtcttcaaagctgatctcccggggcttaaaaaggaggaagtgaaagtcgagattgaagatgacagggtgcttcaaattagcggggagaggaacgtggagaaggaagacaagaatgatacatggcatcgtgttgaacgtagcagtggcaagttcttgagaaggttcaagctgcctgagaatgccaagatagatcaagtcaaggctggtttggagaatggggtgcttactgttactgtgccgaaggaggaagtcaagaaacctgatgtcaagaaagctattgaaatatctggttga

SEQ ID NO: 1107 - protein, 155 aa, Populus balsamifera subsp. trichocarpa
  misc_feature (1)..(155): Ceres ANNOT ID no. 1461614
  misc_feature (50)..(154): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 117742:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(155): Functional Homolog of  Ceres CLONE ID no. 28602 at SEQ ID NO. 1135 with e-value of 1.00E-54 and BLAST sequence identity of 74.5
MAMIPSFFNNRSRDIIFDPFSSFDPFKDFPFPSSSLISRENSAFVNTRIDWKETPEAHVFKADLPGLKKEEVKVEIEDDRVLQISGERNVEKEDKNDTWHRVERSSGKFLRRFKLPENAKIDQVKAGLENGVLTVTVPKEEVKKPDVKKAIEISG

SEQ ID NO: 1108 - DNA, 459 bp, Populus balsamifera subsp. trichocarpa
  misc_feature (1)..(459): Ceres ANNOT ID no. 1479711
  misc_feature 117854:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaatgatcccaagcttcttcgacaacagacgaggcaccatctttgatccattcacttgggaacccttcaaggacttccctttcccttcatcctcacttgtctctcatgacaattcagcctttgttaacacgcgcatcgattggaaagagaccccagaagcccatgtctttaaggccgatcttcctggtcttaagaaggaggaggtgaaggtggaggttgaggatgacagggtgcttcagatcagcggggagaggaacgtggagaaggaggacaagaatgacacatggcatcgtgtcgagcgtagcagcggcaagttcctgaggaggttcagactgcctgagaatgctaaggtggatcaggtcaaggcttctatggagaatggggtgcttacagtgactgtgccgaaggaggaagttaagaaacctgatgtcaaggctattgaaatctctggttga

SEQ ID NO: 1109 - protein, 152 aa, Populus balsamifera subsp. trichocarpa
  misc_feature (1)..(152): Ceres ANNOT ID no. 1479711
  misc_feature (48)..(151): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 117988:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(152): Functional Homolog of  Ceres CLONE ID no. 28602 at SEQ ID NO. 1135 with e-value of 1.70E-54 and BLAST sequence identity of 74.6
MAMIPSFFDNRRGTIFDPFTWEPFKDFPFPSSSLVSHDNSAFVNTRIDWKETPEAHVFKADLPGLKKEEVKVEVEDDRVLQISGERNVEKEDKNDTWHRVERSSGKFLRRFRLPENAKVDQVKASMENGVLTVTVPKEEVKKPDVKAIEISG

SEQ ID NO: 1110 - DNA, 459 bp, Populus balsamifera subsp. trichocarpa
  misc_feature (1)..(459): Ceres ANNOT ID no. 1479712
  misc_feature 118100:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaatgatcccaagcttcttcgacaacagacgaggcaccatctttgatccattcacttgggaacccttcaaggacttctctttcccttcatcctcacttgtctctcatgacaattcagcctttgtcaagacgcgcatcgattggaaagagaccccagaagcccatgtctttaaggccgatcttcctggtcttaagaaggaggaggtgaaggtggagattgaggatgacagggtgcttcagatcagcggggagaggaacgtggagaaggaggacaagaatgacacatggcatcgtgtcgagcgtagcagcggcaagttcgtgaggaggttcagactgcctgagaatgctaaggtggatcaggtcaaggcttctatggagaatggggtgcttacagtgacggtgccgaaggaggaagtcaagaaacctgatgtcaaggctattgaaatctctggttga

SEQ ID NO: 1111 - protein, 152 aa, Populus balsamifera subsp. trichocarpa
  misc_feature (1)..(152): Ceres ANNOT ID no. 1479712
  misc_feature (48)..(151): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 118234:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(152): Functional Homolog of  Ceres CLONE ID no. 28602 at SEQ ID NO. 1135 with e-value of 4.50E-54 and BLAST sequence identity of 74.6
MAMIPSFFDNRRGTIFDPFTWEPFKDFSFPSSSLVSHDNSAFVKTRIDWKETPEAHVFKADLPGLKKEEVKVEIEDDRVLQISGERNVEKEDKNDTWHRVERSSGKFVRRFRLPENAKVDQVKASMENGVLTVTVPKEEVKKPDVKAIEISG

SEQ ID NO: 1112 - DNA, 477 bp, Populus balsamifera subsp. trichocarpa
  misc_feature (1)..(477): Ceres ANNOT ID no. 1488329
  misc_feature 118346:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaacgattccaagcttcttttacaaccaacgagccaacagtattttcgacccagtctctgcattcgacgtttgggatccactcaaagacttccctttcacttccccgcattcactcatctctcgtgaaaactcagcctttgtcaacacccgcattgattggaaagagaccccagaagcccatgtattcgaggcagatcttccggggctaaaaagagaggaagtgaaggtcgaaatcgaagatgacagagtgcttcagatcagcggagagaggaatgtggagaaggaagaccagaacgatacatggcatcgtgtggagcgtagctgtggcaagttcctgaggaggttcaggctgcctgagaatgcgaaaatggatcatgtcaaggcttctatggagaacggggttcttactgtcactgtgcctaaagaggaagtcaagaaacctgaagtcaaggcgattgacatctctagttaa

SEQ ID NO: 1113 - protein, 158 aa, Populus balsamifera subsp. trichocarpa
  misc_feature (1)..(158): Ceres ANNOT ID no. 1488329
  misc_feature (54)..(157): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 118480:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(158): Functional Homolog of  Ceres CLONE ID no. 28602 at SEQ ID NO. 1135 with e-value of 9.39E-54 and BLAST sequence identity of 74.5
MATIPSFFYNQRANSIFDPVSAFDVWDPLKDFPFTSPHSLISRENSAFVNTRIDWKETPEAHVFEADLPGLKREEVKVEIEDDRVLQISGERNVEKEDQNDTWHRVERSCGKFLRRFRLPENAKMDHVKASMENGVLTVTVPKEEVKKPEVKAIDISS

SEQ ID NO: 1114 - DNA, 483 bp, Populus balsamifera subsp. trichocarpa
  misc_feature (1)..(483): Ceres ANNOT ID no. 1460481
  misc_feature 118592:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcgttgattccaagcttctttgacagccaacgaggcaacaacatcttcgatccattctcatcattagacatctgggatccattcaaggacttaacccctttcatttcctcttcaaactctctcttttctcgtgaaaatccagcttttgttaacacccgtattgattggaaagagaccccagaagcccatgtcttccaggcagatcttccggggcttaaaaaggaggaggtaaaggtagaaattgaagatgacagagtgctccagattagcggacagaggaacgtggagaaggaagacaagaacgacacatggcatcgtgtggagcgtagcagtggcaagttcttgaggaggtttaggctgcctgagaatgccaagatggaccaaattaaggcttgtatggagaatggggttcttaccgtcactgtgcctacggaggaagtcaagaaacctgatgtcaagactgttgaaatctctgaatga

SEQ ID NO: 1115 - protein, 160 aa, Populus balsamifera subsp. trichocarpa
  misc_feature (1)..(160): Ceres ANNOT ID no. 1460481
  misc_feature (56)..(159): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 118728:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(160): Functional Homolog of  Ceres CLONE ID no. 28602 at SEQ ID NO. 1135 with e-value of 2.00E-53 and BLAST sequence identity of 73.2
MALIPSFFDSQRGNNIFDPFSSLDIWDPFKDLTPFISSSNSLFSRENPAFVNTRIDWKETPEAHVFQADLPGLKKEEVKVEIEDDRVLQISGQRNVEKEDKNDTWHRVERSSGKFLRRFRLPENAKMDQIKACMENGVLTVTVPTEEVKKPDVKTVEISE

SEQ ID NO: 1116 - DNA, 468 bp, Populus balsamifera subsp. trichocarpa
  misc_feature (1)..(468): Ceres ANNOT ID no. 1461613
  misc_feature 118843:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaatgatcccaagcttcttcaacaaccgatcacgagacatcatcttcgacccgttctcttctttcgatccattcaaggacttccctttcccttcatctcccctcatccctcgcgagaattcagctctcgttaacactcgcattgactggacagagaccccagaggcccatgtattcaaagcagatctcccggggcttaaaaaggaggaagtgaaagtcgagatcgaagatgacagggtgcttcaaattagcggggagaggaacgtggagaaggaagacatgaatgatacatggcatcgtgttgaacgtagcagtggcaagttcttgagaaggttcaaactgcctgagaatgtcaagacagatcaagtcaaggctggtatggaaaacggggtgcttactgtcactgtgcctaagaaggaagtcaagaaaccagatgccaagaagactattgaaatctccggttaa

SEQ ID NO: 1117 - protein, 155 aa, Populus balsamifera subsp. trichocarpa
  misc_feature (1)..(155): Ceres ANNOT ID no. 1461613
  misc_feature (50)..(154): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 118977:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(155): Functional Homolog of  Ceres CLONE ID no. 28602 at SEQ ID NO. 1135 with e-value of 2.50E-53 and BLAST sequence identity of 73.2
MAMIPSFFNNRSRDIIFDPFSSFDPFKDFPFPSSPLIPRENSALVNTRIDWTETPEAHVFKADLPGLKKEEVKVEIEDDRVLQISGERNVEKEDMNDTWHRVERSSGKFLRRFKLPENVKTDQVKAGMENGVLTVTVPKKEVKKPDAKKTIEISG

SEQ ID NO: 1118 - DNA, 489 bp, Populus balsamifera subsp. trichocarpa
  misc_feature (1)..(489): Ceres ANNOT ID no. 1458198
  misc_feature 119089:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgtctctcatcccaagctccctctttggtggccgaagaaccaacgtctttgatcctttctctcttgacatctgggaccctttccaggactttcccttcacaagcacagccctgtcagccccacgttcagaggtcgccaaagaaacatcagcatttgccagcacacgcatagactggaaggagaccccagaggctcatgttttcaaggctgatcttccagggctgaaaaaagaggaagtgaaagtggagatagaggaaggcaaggttttacaaataagtggagagagaagcaaggagaatgaagagaaaaatgacaagtggcatagagttgagagatcgagtggtaagttcttgaggaggttcagattgcctgagaatgctaaagctgatcaggtgaaggctagtatggaaaacggggtcttgacagtgactgtgcctaaagaggaagtcaagaagcctgatgttaagtccattgagatctccggctga

SEQ ID NO: 1119 - protein, 162 aa, Populus balsamifera subsp. trichocarpa
  misc_feature (1)..(162): Ceres ANNOT ID no. 1458198
  misc_feature (58)..(161): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 119225:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(162): Functional Homolog of  Ceres CLONE ID no. 28602 at SEQ ID NO. 1135 with e-value of 3.60E-52 and BLAST sequence identity of 73.3
MSLIPSSLFGGRRTNVFDPFSLDIWDPFQDFPFTSTALSAPRSEVAKETSAFASTRIDWKETPEAHVFKADLPGLKKEEVKVEIEEGKVLQISGERSKENEEKNDKWHRVERSSGKFLRRFRLPENAKADQVKASMENGVLTVTVPKEEVKKPDVKSIEISG

SEQ ID NO: 1120 - DNA, 483 bp, Populus balsamifera subsp. trichocarpa
  misc_feature (1)..(483): Ceres ANNOT ID no. 1488327
  misc_feature 119340:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggaaatgattccaagcttcttagacaaccaccgaggcagaagcattatcgatccattctcttcttttgatatttggaatccgttcaaggacttctctcctttcacttccacctcaaattctctcctttctcatgaaaattcagcttttgtaaacacccgcgtggattggaaagagacaccagaagcccatgtcttcaaggcagatcttccagggcttaaaaaagaggaagtgaaggtcggagttgaagatgacagggtgcttcagattagcggagaaaggaatgtagagaaggaagacaagaacgatacatggcatagggtggagcgaagcagtggcaagttcttgaggaggtttaggctgcccaaggatgcgaaaatggatcaggtcaaggcttctatggaaaacggagttcttattgtgactgtgcctaaagaggagctcaagaaacctggtgtcaaggctattgaaatctctggttaa

SEQ ID NO: 1121 - protein, 160 aa, Populus balsamifera subsp. trichocarpa
  misc_feature (1)..(160): Ceres ANNOT ID no. 1488327
  misc_feature (56)..(159): Pfam Name: HSP20 Pfam Description: Hsp20/alpha crystallin family
  misc_feature: SWISSPROT Homolog: HSP13_SOYBN 17.5 kDa class I heat shock protein (HSP 17.5-M) with e-value of 5.5e-59 and BLAST sequence identity of 75.2
  misc_feature: SWISSPROT Homolog: HSP11_SOYBN 17.3 kDa class I heat shock protein (HSP 17.3) with e-value of 7.0e-59 and BLAST sequence identity of 76.4
  misc_feature: SWISSPROT Homolog: HSP11_LYCES 17.8 kDa class I heat shock protein with e-value of 2.4e-58 and BLAST sequence identity of 73.9
  misc_feature: SWISSPROT Homolog: HSP14_SOYBN 17.5 kDa class I heat shock protein (HSP 17.5-E) with e-value of 2.7e-57 and BLAST sequence identity of 73.4
  misc_feature: SWISSPROT Homolog: HSP12_MEDSA 18.2 kDa class I heat shock protein with e-value of 3.5e-57 and BLAST sequence identity of 75.3
  misc_feature 119476:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: HYPOCOTYL - Long Useful for making taller plants
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(160): Functional Homolog of  Ceres CLONE ID no. 28602 at SEQ ID NO. 1135 with e-value of 9.70E-52 and BLAST sequence identity of 72.0
MEMIPSFLDNHRGRSIIDPFSSFDIWNPFKDFSPFTSTSNSLLSHENSAFVNTRVDWKETPEAHVFKADLPGLKKEEVKVGVEDDRVLQISGERNVEKEDKNDTWHRVERSSGKFLRRFRLPKDAKMDQVKASMENGVLIVTVPKEELKKPGVKAIEISG

SEQ ID NO: 1122 - protein, 133 aa, Arabidopsis thaliana
  misc_feature (1)..(133): Ceres CLONE ID no. 28643
  misc_feature (24)..(107): Pfam Name: Ribosomal_S24e Pfam Description: Ribosomal protein S24e
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
MAEKAVTIKTRNFMTNRLLARKQFVIDVLHPGRANVSKAELKEKLARMYEVKDPNAIFCFKFRTHFGGGKSSGYGLIYDTVENAKKFEPKYRLIRNGLDTKIEKSRKQIKERKNRAKKIRGVKKTKAGDAKKK

SEQ ID NO: 1123 - DNA, 405 bp, Populus balsamifera subsp. trichocarpa
  misc_feature (1)..(405): Ceres ANNOT ID no. 1469464
  misc_feature 119660:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atggcagacaaagcagttaccattcgtaccaggaagttcatgacaaatcgtctcctttcaaggaagcaatttatcattgatgttcttcatcctggtagagccaatgtttctaaggcagaactgaaggagaagctggcaaatttgtatgaggtgaaggaccccaatacaatctttgtgttcaaatttaggacccattttggaggtgggaaatccactggatttgggttgatttatgatacagttgacaatgcaaagaagtacgagcccaagtacaggctcattaggaatgggcttgccactaagatagagaagtcgaggaagcaattgaaggagagaaagaacagggcaaagaaagtccgtggagtcaagaagactaaggctggagatgctgcaaagaagaagtga

SEQ ID NO: 1124 - protein, 134 aa, Populus balsamifera subsp. trichocarpa
  misc_feature (1)..(134): Ceres ANNOT ID no. 1469464
  misc_feature (24)..(107): Pfam Name: Ribosomal_S24e Pfam Description: Ribosomal protein S24e
  misc_feature: SWISSPROT Homolog: RS24_ARATH 40S ribosomal protein S24 with e-value of 9.3e-64 and BLAST sequence identity of 95.5
  misc_feature: SWISSPROT Homolog: RS24_SPOFR 40S ribosomal protein S24 with e-value of 4.4e-41 and BLAST sequence identity of 63.9
  misc_feature: SWISSPROT Homolog: RS24_BOVIN 40S ribosomal protein S24 with e-value of 1.3e-39 and BLAST sequence identity of 64.1
  misc_feature: SWISSPROT Homolog: RS24_PONPY 40S ribosomal protein S24 with e-value of 1.3e-39 and BLAST sequence identity of 64.1
  misc_feature: SWISSPROT Homolog: RS24_XENLA 40S ribosomal protein S24 (S19) with e-value of 2.8e-39 and BLAST sequence identity of 63.3
  misc_feature 119755:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(134): Functional Homolog of  Ceres CLONE ID no. 28643 at SEQ ID NO. 1158 with e-value of 6.69E-60 and BLAST sequence identity of 87.2
MADKAVTIRTRKFMTNRLLSRKQFIIDVLHPGRANVSKAELKEKLANLYEVKDPNTIFVFKFRTHFGGGKSTGFGLIYDTVDNAKKYEPKYRLIRNGLATKIEKSRKQLKERKNRAKKVRGVKKTKAGDAAKKK

SEQ ID NO: 1125 - DNA, 405 bp, Populus balsamifera subsp. trichocarpa
  misc_feature (1)..(405): Ceres ANNOT ID no. 1463508
  misc_feature 119829:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgtcagacaaggctgtgactattagaacaagaaagtttatgacaaacaggcttctttcaaggaagcagtttatcattgatgttttgcatcctgggagagctaatgtttctaaggctgaattgaaggagaaactggcaagtttatatgaagtgaaagacccgaattcgatttttgtgttcaagttccgtactcattttggaggtgggaaatcaactgggtttgggctgatttatgactctgtggagagcgccaagaaatatgaaccaaagtacaggctaatcaggaatggactcgccaccaaggtggaaaaatcaaggaagcagctaaaggaaaggaagaacagggcaaagaaagttcgaggtgtaaagaagaccaaggctggagatgctgcaaagaagaagtga

SEQ ID NO: 1126 - protein, 134 aa, Populus balsamifera subsp. trichocarpa
  misc_feature (1)..(134): Ceres ANNOT ID no. 1463508
  misc_feature (24)..(107): Pfam Name: Ribosomal_S24e Pfam Description: Ribosomal protein S24e
  misc_feature: SWISSPROT Homolog: RS24_ARATH 40S ribosomal protein S24 with e-value of 9.3e-64 and BLAST sequence identity of 95.5
  misc_feature: SWISSPROT Homolog: RS24_SPOFR 40S ribosomal protein S24 with e-value of 4.4e-41 and BLAST sequence identity of 63.9
  misc_feature: SWISSPROT Homolog: RS24_BOVIN 40S ribosomal protein S24 with e-value of 1.3e-39 and BLAST sequence identity of 64.1
  misc_feature: SWISSPROT Homolog: RS24_PONPY 40S ribosomal protein S24 with e-value of 1.3e-39 and BLAST sequence identity of 64.1
  misc_feature: SWISSPROT Homolog: RS24_XENLA 40S ribosomal protein S24 (S19) with e-value of 2.8e-39 and BLAST sequence identity of 63.3
  misc_feature 119924:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(134): Functional Homolog of  Ceres CLONE ID no. 28643 at SEQ ID NO. 1158 with e-value of 7.70E-59 and BLAST sequence identity of 84.9
MSDKAVTIRTRKFMTNRLLSRKQFIIDVLHPGRANVSKAELKEKLASLYEVKDPNSIFVFKFRTHFGGGKSTGFGLIYDSVESAKKYEPKYRLIRNGLATKVEKSRKQLKERKNRAKKVRGVKKTKAGDAAKKK

SEQ ID NO: 1127 - DNA, 405 bp, Populus balsamifera subsp. trichocarpa
  misc_feature (1)..(405): Ceres ANNOT ID no. 1459366
  misc_feature 119998:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atggcagacaaggctgtgactattagaacaagaaagtttatgacaaacaggcttctttctaggaagcagtttatcattgacgtcttgcatcctgggagagctaatgtttctaaggctgaattgaaagagaagttggcaagtttatatgaagtgaaagacctgaattcgatttttgtgttcaagttccgtactcattttggtggtgggaaatcaactgggtttgggctgatttatgactctgttgagagcgccaagaagtacgagcccaagtacaggctaatcaggaatggactagccaccaaggtggaaaaatcaaggaagcaactaaaggaaaggaagaatagggccaagaaagttcgaggtgtaaagaagactaaggctggagatgctgcaaagaagaagtga

SEQ ID NO: 1128 - protein, 134 aa, Populus balsamifera subsp. trichocarpa
  misc_feature (1)..(134): Ceres ANNOT ID no. 1459366
  misc_feature (24)..(107): Pfam Name: Ribosomal_S24e Pfam Description: Ribosomal protein S24e
  misc_feature: SWISSPROT Homolog: RS24_ARATH 40S ribosomal protein S24 with e-value of 9.3e-64 and BLAST sequence identity of 95.5
  misc_feature: SWISSPROT Homolog: RS24_SPOFR 40S ribosomal protein S24 with e-value of 4.4e-41 and BLAST sequence identity of 63.9
  misc_feature: SWISSPROT Homolog: RS24_BOVIN 40S ribosomal protein S24 with e-value of 1.3e-39 and BLAST sequence identity of 64.1
  misc_feature: SWISSPROT Homolog: RS24_PONPY 40S ribosomal protein S24 with e-value of 1.3e-39 and BLAST sequence identity of 64.1
  misc_feature: SWISSPROT Homolog: RS24_XENLA 40S ribosomal protein S24 (S19) with e-value of 2.8e-39 and BLAST sequence identity of 63.3
  misc_feature 120093:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(134): Functional Homolog of  Ceres CLONE ID no. 28643 at SEQ ID NO. 1158 with e-value of 4.20E-58 and BLAST sequence identity of 84.9
MADKAVTIRTRKFMTNRLLSRKQFIIDVLHPGRANVSKAELKEKLASLYEVKDLNSIFVFKFRTHFGGGKSTGFGLIYDSVESAKKYEPKYRLIRNGLATKVEKSRKQLKERKNRAKKVRGVKKTKAGDAAKKK

SEQ ID NO: 1129 - DNA, 498 bp, Populus balsamifera subsp. trichocarpa
  misc_feature (1)..(498): Ceres ANNOT ID no. 1542246
  misc_feature 120167:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atggcagacaaagcagttaccattcgtaccaggaagttcatgacaaatcgtcttctttcaaggaagcaatttatcattgatgttcttcatcctggcagagccaatgtttctaaggcagaattgaaggagaagctggcaagtttgtatgaggtgaaggacacaaatacaatctttgtgttcaagtttaggacacattttggaggtgggaaatccactggatttgggttgatttatgatacagttgacaatgcaaagaagtatgagccgaagtataggcttattaggaatgggcttgccactaaggttgagaagtcaaggaagcaattgaaggagagaaagaacagagccaagaaagtccgcggagtaaagaaggtgagcgagtggttttatttatggttgtgtttcgatgcattgctgcaagagcaacaacttaccttgatatttactcatgcagacaaaggctggagacgctgcaaagaagaagtagggagtttgtga

SEQ ID NO: 1130 - protein, 165 aa, Populus balsamifera subsp. trichocarpa
  misc_feature (1)..(165): Ceres ANNOT ID no. 1542246
  misc_feature (24)..(107): Pfam Name: Ribosomal_S24e Pfam Description: Ribosomal protein S24e
  misc_feature: SWISSPROT Homolog: RS24_ARATH 40S ribosomal protein S24 with e-value of 9.3e-64 and BLAST sequence identity of 95.5
  misc_feature: SWISSPROT Homolog: RS24_SPOFR 40S ribosomal protein S24 with e-value of 4.4e-41 and BLAST sequence identity of 63.9
  misc_feature: SWISSPROT Homolog: RS24_BOVIN 40S ribosomal protein S24 with e-value of 1.3e-39 and BLAST sequence identity of 64.1
  misc_feature: SWISSPROT Homolog: RS24_PONPY 40S ribosomal protein S24 with e-value of 1.3e-39 and BLAST sequence identity of 64.1
  misc_feature: SWISSPROT Homolog: RS24_XENLA 40S ribosomal protein S24 (S19) with e-value of 2.8e-39 and BLAST sequence identity of 63.3
  misc_feature 120266:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(165): Functional Homolog of  Ceres CLONE ID no. 28643 at SEQ ID NO. 1158 with e-value of 1.00E-54 and BLAST sequence identity of 85.4
MADKAVTIRTRKFMTNRLLSRKQFIIDVLHPGRANVSKAELKEKLASLYEVKDTNTIFVFKFRTHFGGGKSTGFGLIYDTVDNAKKYEPKYRLIRNGLATKVEKSRKQLKERKNRAKKVRGVKKVSEWFYLWLCFDALLQEQQLTLIFTHADKGWRRCKEEVGSL

SEQ ID NO: 1131 - protein, 262 aa, Arabidopsis thaliana
  misc_feature (1)..(262): Ceres CLONE ID no. 29150
  misc_feature: Phenotype: WHOLE PLANT - Yellow-Green Viable 1 Useful for making lethal plants for genetic confinement systems
MALFSPPISSSSLQNPNFIPKFSFSLLSSNRFSLLSVTRASSDSGSTSPTAAVSVEAPEPVEVIVKEPPQSTPAVKKEETATAKNVAVEGEEMKTTESVIKFQDARWINGTWDLKQFEKDGKTDWDSVIVAEAKRRKWLEENPETTSNDEPVLFDTSIIPWWAWIKRYHLPEAELLNGRAAMIGFFMAYFVDSLTGVGLVDQMGNFFCKTLLFVAVAGVLFIRKNEDVDKLKNLFDETTLYDKQWQAAWKNDDDESLGSKKK

SEQ ID NO: 1132 - DNA, 957 bp, Populus balsamifera subsp. trichocarpa
  misc_feature (1)..(957): Ceres ANNOT ID no. 1485362
  misc_feature 120420:<222: Transcription Factor
  misc_feature: Phenotype: WHOLE PLANT - Yellow-Green Viable 1 Useful for making lethal plants for genetic confinement systems
atgtctttgttccctccgccactaactcgccttccactctccttctcttccaagcaccatatcattttcaaacccacactctctctcagacccacaagccctccttttctcctctccacttccaaggcctctacagacgatggaggagctggagtttcagcctcttccgccactgtagaagaaccaaaattggagcagaaggcaccagattcttctgaatcagttcctgtggctgagaagaactctaatggagctgtggctcctggtggaggggtggaggttgaagtgagtaaatttgaggaccccaggtggatttcagggacttgggacttgaagcagtttgagaaagatgggaaaactgattgggatgctgttattgatgctggagaaaaagtgaaagtggctgcattattggggcttggaattgactggtgtcatacaggacctgctcatccaacagcttggaataatgggattgaatcagcttgtataggtgttgtttcctgtcagatcgttgttcagagtccttgtatgtatgtaaatgaaatgatatctttctgtgctccagaggttaggaggagaaaatggctcgagggtaacccagaatcatcaagtaatgatgaccctgttgtttttgacacctcaataataccatggtgggcatggatgaaaagattccatctgcctgaagcagaacttctcaatggccgtgctgcaatgattgggttcttcatggcttacctggttgatagcttgactggtgttggtgtcgttgatcagatgggcaacttcttctgcaaaactctattgtttgtagctgtggtaggagtacttttaatacgaaagaatgaggatttagaaaccataaaaacattgctggaggagacaaccttctatgacaggcaatggcaagcaacctggcaggatgagacatcttccatccctaaaaatgagtag

SEQ ID NO: 1133 - protein, 318 aa, Populus balsamifera subsp. trichocarpa
  misc_feature (1)..(318): Ceres ANNOT ID no. 1485362
  misc_feature 120477:<222: Transcription Factor
  misc_feature: Phenotype: WHOLE PLANT - Yellow-Green Viable 1 Useful for making lethal plants for genetic confinement systems
  misc_feature (1)..(318): Functional Homolog of  Ceres CLONE ID no. 29150 at SEQ ID NO. 1172 with e-value of 3.09E-62 and BLAST sequence identity of 62.0
MSLFPPPLTRLPLSFSSKHHIIFKPTLSLRPTSPPFLLSTSKASTDDGGAGVSASSATVEEPKLEQKAPDSSESVPVAEKNSNGAVAPGGGVEVEVSKFEDPRWISGTWDLKQFEKDGKTDWDAVIDAGEKVKVAALLGLGIDWCHTGPAHPTAWNNGIESACIGVVSCQIVVQSPCMYVNEMISFCAPEVRRRKWLEGNPESSSNDDPVVFDTSIIPWWAWMKRFHLPEAELLNGRAAMIGFFMAYLVDSLTGVGVVDQMGNFFCKTLLFVAVVGVLLIRKNEDLETIKTLLEETTFYDRQWQATWQDETSSIPKNE

SEQ ID NO: 1134 - protein, 412 aa, Arabidopsis thaliana
  misc_feature (1)..(412): Ceres CLONE ID no. 29310
  misc_feature (1)..(412): Also Known As Ceres CDNA ID no. 24418089
  misc_feature (1)..(412): Also Known As Ceres GEMINI ID 533E12
  misc_feature (297)..(373): Pfam Name: Helicase_C Pfam Description: Helicase conserved C-terminal domain
  misc_feature (62)..(229): Pfam Name: DEAD Pfam Description: DEAD/DEAH box helicase
  misc_feature 120596:<222: Transcription Factor
  misc_feature: Phenotype: Activates expression of the gene endogenous to the AtATTPS3 (SEQ ID NO 4165) regalutory region Useful for modulating Terpenoid Biosynthesis
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKGDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 1135 - DNA, 1242 bp, Populus balsamifera subsp. trichocarpa; identical to SEQ ID NO: 179
  misc_feature (1)..(1242): Ceres ANNOT ID no. 1455209
  misc_feature 120699:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 1136 - protein, 413 aa, Populus balsamifera subsp. trichocarpa; identical to SEQ ID NO: 180
  misc_feature (1)..(413): Ceres ANNOT ID no. 1455209
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 4.3e-217 and BLAST sequence identity of 99.8
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 6.0e-211 and BLAST sequence identity of 96.4
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.2e-205 and BLAST sequence identity of 93.5
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.2e-205 and BLAST sequence identity of 93.0
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 8.4e-205 and BLAST sequence identity of 92.7
  misc_feature 120818:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(413): Functional Homolog of  Ceres CLONE ID no. 29310 at SEQ ID NO. 1175 with e-value of 5.10E-204 and BLAST sequence identity of 93.4

SEQ ID NO: 1137 - DNA, 1242 bp, Populus balsamifera subsp. trichocarpa; identical to SEQ ID NO: 181
  misc_feature (1)..(1242): Ceres ANNOT ID no. 1446198
  misc_feature 120929:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 1138 - protein, 413 aa, Populus balsamifera subsp. trichocarpa; identical to SEQ ID NO: 182
  misc_feature (1)..(413): Ceres ANNOT ID no. 1446198
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 4.3e-217 and BLAST sequence identity of 99.8
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 6.0e-211 and BLAST sequence identity of 96.4
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.2e-205 and BLAST sequence identity of 93.5
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.2e-205 and BLAST sequence identity of 93.0
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 8.4e-205 and BLAST sequence identity of 92.7
  misc_feature 121048:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(413): Functional Homolog of  Ceres CLONE ID no. 29310 at SEQ ID NO. 1175 with e-value of 3.60E-203 and BLAST sequence identity of 92.4

SEQ ID NO: 1139 - DNA, 1242 bp, Populus balsamifera subsp. trichocarpa; identical to SEQ ID NO: 183
  misc_feature (1)..(1242): Ceres ANNOT ID no. 1490273
  misc_feature 121159:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 1140 - protein, 413 aa, Populus balsamifera subsp. trichocarpa; identical to SEQ ID NO: 184
  misc_feature (1)..(413): Ceres ANNOT ID no. 1490273
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 4.3e-217 and BLAST sequence identity of 99.8
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 6.0e-211 and BLAST sequence identity of 96.4
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.2e-205 and BLAST sequence identity of 93.5
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.2e-205 and BLAST sequence identity of 93.0
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 8.4e-205 and BLAST sequence identity of 92.7
  misc_feature 121278:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(413): Functional Homolog of  Ceres CLONE ID no. 29310 at SEQ ID NO. 1175 with e-value of 8.59E-202 and BLAST sequence identity of 92.2

SEQ ID NO: 1141 - DNA, 1224 bp, Populus balsamifera subsp. trichocarpa; identical to SEQ ID NO: 185
  misc_feature (1)..(1224): Ceres ANNOT ID no. 1530603
  misc_feature 121389:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 1142 - protein, 407 aa, Populus balsamifera subsp. trichocarpa; identical to SEQ ID NO: 186
  misc_feature (1)..(407): Ceres ANNOT ID no. 1530603
  misc_feature (292)..(368): Pfam Name: Helicase_C Pfam Description: Helicase conserved C-terminal domain
  misc_feature (63)..(224): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 4.3e-217 and BLAST sequence identity of 99.8
  misc_feature: SWISSPROT Homolog: IF4A2_ARATH Eukaryotic initiation factor 4A-2 (EC 3.6.1.-) (ATP-dependent RNA helicase eIF4A-2) (eIF-4A-2) with e-value of 6.0e-211 and BLAST sequence identity of 96.4
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.2e-205 and BLAST sequence identity of 93.5
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.2e-205 and BLAST sequence identity of 93.0
  misc_feature: SWISSPROT Homolog: IF411_TOBAC Eukaryotic initiation factor 4A-11 (EC 3.6.1.-) (ATP-dependent RNA helicase eIF4A-11) (eIF-4A-11) with e-value of 8.4e-205 and BLAST sequence identity of 92.7
  misc_feature 121508:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(407): Functional Homolog of  Ceres CLONE ID no. 29310 at SEQ ID NO. 1175 with e-value of 7.20E-198 and BLAST sequence identity of 92.8

SEQ ID NO: 1143 - protein, 378 aa, Arabidopsis thaliana
  misc_feature (1)..(378): Ceres CLONE ID no. 29363
  misc_feature (236)..(262): Pfam Name: zf-CCCH Pfam Description: Zinc finger C-x8-C-x5-C-x3-H type (and similar)
  misc_feature (312)..(349): Pfam Name: zf-C3HC4 Pfam Description: Zinc finger, C3HC4 type (RING finger)
  misc_feature: Phenotype: INFLORESCENCE - Short Useful for modulating plant height
MEPFVVKENIVASASSPMKKRRIDHTESADGSAINASNSSSIGGNDTVMNMAEFGNDNSNNQESQQFCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 1144 - DNA, 972 bp, Populus balsamifera subsp. trichocarpa; identical to SEQ ID NO: 146
  misc_feature (1)..(972): Ceres ANNOT ID no. 1471301
  misc_feature 121725:<222: Transcription Factor
  misc_feature: Phenotype: INFLORESCENCE - Short Useful for modulating plant height

SEQ ID NO: 1145 - protein, 323 aa, Populus balsamifera subsp. trichocarpa; identical to SEQ ID NO: 147
  misc_feature (1)..(323): Ceres ANNOT ID no. 1471301
  misc_feature (186)..(212): Pfam Name: zf-CCCH Pfam Description: Zinc finger C-x8-C-x5-C-x3-H type (and similar)
  misc_feature (262)..(299): Pfam Name: zf-C3HC4 Pfam Description: Zinc finger, C3HC4 type (RING finger)
  misc_feature: SWISSPROT Homolog: ZN183_BOVIN Zinc finger protein 183 with e-value of 1.3e-57 and BLAST sequence identity of 40.4
  misc_feature: SWISSPROT Homolog: R113A_HUMAN RING finger protein 113A (Zinc finger protein 183) with e-value of 3.1e-56 and BLAST sequence identity of 40.2
  misc_feature: SWISSPROT Homolog: R113B_HUMAN RING finger protein 113B (Zinc finger protein 183-like 1) with e-value of 3.6e-55 and BLAST sequence identity of 39.0
  misc_feature: SWISSPROT Homolog: RN113_CAEEL Putative RING finger protein 113 homolog with e-value of 2.5e-47 and BLAST sequence identity of 38.4
  misc_feature: SWISSPROT Homolog: CWC24_USTMA Pre-mRNA-splicing factor CWC24 with e-value of 2.2e-46 and BLAST sequence identity of 37.3
  misc_feature 121833:<222: Transcription Factor
  misc_feature: Phenotype: INFLORESCENCE - Short Useful for modulating plant height
  misc_feature (1)..(323): Functional Homolog of  Ceres CLONE ID no. 29363 at SEQ ID NO. 1184 with e-value of 1.99E-129 and BLAST sequence identity of 74.2

SEQ ID NO: 1146 - protein, 177 aa, Arabidopsis thaliana
  misc_feature (1)..(177): Ceres CLONE ID no. 29637
  misc_feature (1)..(177): Also Known As Ceres CDNA ID no. 23366647
  misc_feature (1)..(177): Also Known As Ceres GEMINI ID 553C3
  misc_feature (15)..(86): Pfam Name: RRM_1 Pfam Description: RNA recognition motif. (a.k.a. RRM RBD, or RNP domain)
  misc_feature 121950:<222: Transcription Factor
  misc_feature: Phenotype: Activates expression of the gene endogenous to the AtHMGS (SEQ ID NO 4144) regalutory region Useful for modulating Terpenoid Biosynthesis
MAAVQQQQAMQKNTLYVGGLADEVNESILHAAFIPFGDIKDVKTPLDQANQKHRSFGFVTFLEREDASAAMDNMDGAELYGRVLTVNYALPEKIKGGEQGWAAHPLWADADTWFERQQQEKEILKMQAENKAAMETAEELHRKKLAEDRQGEMEEDTDTKDDPMARAEADALSHGDA

SEQ ID NO: 1147 - DNA, 525 bp, Populus balsamifera subsp. trichocarpa
  misc_feature (1)..(525): Ceres ANNOT ID no. 1458617
  misc_feature 122011:<222: Transcription Factor
  misc_feature: Phenotype: Activates expression of the gene endogenous to the AtHMGS (SEQ ID NO 4144) regalutory region Useful for modulating Terpenoid Biosynthesis
atggcagcacagcagcaagtgcaaaagaacacgctatacgtaggaggattagctgaggaagtaaacgaagcaatactccacgctactttcattccttttggtgacattaaggatgtcaaaacccccttagatcaagccacacagaaacaccgctcttttggcttcgttactttcctcgaaagagaggacgccgcctccgccatggacaatatggatggcgctgagctctatggtcgtgtcctcaccgttaattacgctttgcctgagaagattaagggtggtgaacaaggttgggctgcccagccaatctgggctgatgcggacacatggttcgaaaggcagcagcaagaggaggaaatgcagcgtatgcaggcagagaacagggctgcaatggaagctgcagaagagttgcacagaaagaagatggcagaggagcgagaaggggagaaggaagatgaagggcaggtcaaggatgatccaatggcaagggctgaagcggaggttttgaaacagaacatatcttag

SEQ ID NO: 1148 - protein, 174 aa, Populus balsamifera subsp. trichocarpa
  misc_feature (1)..(174): Ceres ANNOT ID no. 1458617
  misc_feature (12)..(83): Pfam Name: RRM_1 Pfam Description: RNA recognition motif. (a.k.a. RRM RBD, or RNP domain)
  misc_feature: SWISSPROT Homolog: PPIE_HUMAN Peptidyl-prolyl cis-trans isomerase E (EC 5.2.1.8) (PPIase E) (Rotamase E) (Cyclophilin E) (Cyclophilin 33) with e-value of 1.5e-26 and BLAST sequence identity of 40.7
  misc_feature: SWISSPROT Homolog: PPIE_MOUSE Peptidyl-prolyl cis-trans isomerase E (EC 5.2.1.8) (PPIase E) (Rotamase E) (Cyclophilin E) (Cyclophilin 33) with e-value of 2.4e-26 and BLAST sequence identity of 52.8
  misc_feature: SWISSPROT Homolog: PPIE_DROME Peptidyl-prolyl cis-trans isomerase E (EC 5.2.1.8) (PPIase E) (Rotamase E) (Cyclophilin E) (Cyclophilin 33) with e-value of 1.9e-24 and BLAST sequence identity of 40.9
  misc_feature: SWISSPROT Homolog: PPIE_SCHMA Peptidyl-prolyl cis-trans isomerase E (EC 5.2.1.8) (PPIase E) (Rotamase E) (Cyclophilin E) with e-value of 1.2e-12 and BLAST sequence identity of 43.1
  misc_feature: SWISSPROT Homolog: GRP1_DAUCA Glycine-rich RNA-binding protein with e-value of 1.6e-11 and BLAST sequence identity of 43.9
  misc_feature 122100:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(174): Functional Homolog of  Ceres CLONE ID no. 29637 at SEQ ID NO. 1187 with e-value of 1.59E-74 and BLAST sequence identity of 83.7
MAAQQQVQKNTLYVGGLAEEVNEAILHATFIPFGDIKDVKTPLDQATQKHRSFGFVTFLEREDAASAMDNMDGAELYGRVLTVNYALPEKIKGGEQGWAAQPIWADADTWFERQQQEEEMQRMQAENRAAMEAAEELHRKKMAEEREGEKEDEGQVKDDPMARAEAEVLKQNIS

SEQ ID NO: 1149 - DNA, 516 bp, Populus balsamifera subsp. trichocarpa
  misc_feature (1)..(516): Ceres ANNOT ID no. 1464333
  misc_feature 122166:<222: Transcription Factor
  misc_feature: Phenotype: Activates expression of the gene endogenous to the AtHMGS (SEQ ID NO 4144) regalutory region Useful for modulating Terpenoid Biosynthesis
atggcggcacagcagcaagtacagaagaacaccctatacgtaggaggattagctgaggaagcaaacgaatcaatactccacgccgctttcattccttttggtgacattaaagatgtcaaaacccctttagatcaagctaaacagaaacaccgctcttttggcttcgttactctcctcgaaagagaggtcgctgttgctgccatgggcaatatggacggcgctgagctctatggtcgtgtcctcaccgttaattacgccttgcccgagaagattaagggtggtgaacagggttgggctgcccaaccaagcaagtatttctctttgattctttcttttttgttggacgttgctacattatgttggcgctggcttcagtttttaggcgttcgatttgaggggcagcagcaagaggaggaaatgcagcgtatgcaggcagagaacagggctgcaatgcaacctgcagagaacttgcacgtgaagaaaatggcggaggagcgagaaggggaaaaggaatga

SEQ ID NO: 1150 - protein, 171 aa, Populus balsamifera subsp. trichocarpa
  misc_feature (1)..(171): Ceres ANNOT ID no. 1464333
  misc_feature (12)..(83): Pfam Name: RRM_1 Pfam Description: RNA recognition motif. (a.k.a. RRM RBD, or RNP domain)
  misc_feature: SWISSPROT Homolog: PPIE_HUMAN Peptidyl-prolyl cis-trans isomerase E (EC 5.2.1.8) (PPIase E) (Rotamase E) (Cyclophilin E) (Cyclophilin 33) with e-value of 1.5e-26 and BLAST sequence identity of 40.7
  misc_feature: SWISSPROT Homolog: PPIE_MOUSE Peptidyl-prolyl cis-trans isomerase E (EC 5.2.1.8) (PPIase E) (Rotamase E) (Cyclophilin E) (Cyclophilin 33) with e-value of 2.4e-26 and BLAST sequence identity of 52.8
  misc_feature: SWISSPROT Homolog: PPIE_DROME Peptidyl-prolyl cis-trans isomerase E (EC 5.2.1.8) (PPIase E) (Rotamase E) (Cyclophilin E) (Cyclophilin 33) with e-value of 1.9e-24 and BLAST sequence identity of 40.9
  misc_feature: SWISSPROT Homolog: PPIE_SCHMA Peptidyl-prolyl cis-trans isomerase E (EC 5.2.1.8) (PPIase E) (Rotamase E) (Cyclophilin E) with e-value of 1.2e-12 and BLAST sequence identity of 43.1
  misc_feature: SWISSPROT Homolog: GRP1_DAUCA Glycine-rich RNA-binding protein with e-value of 1.6e-11 and BLAST sequence identity of 43.9
  misc_feature 122255:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(171): Functional Homolog of  Ceres CLONE ID no. 29637 at SEQ ID NO. 1187 with e-value of 7.40E-54 and BLAST sequence identity of 80.4
MAAQQQVQKNTLYVGGLAEEANESILHAAFIPFGDIKDVKTPLDQAKQKHRSFGFVTLLEREVAVAAMGNMDGAELYGRVLTVNYALPEKIKGGEQGWAAQPSKYFSLILSFLLDVATLCWRWLQFLGVRFEGQQQEEEMQRMQAENRAAMQPAENLHVKKMAEEREGEKE

SEQ ID NO: 1151 - protein, 372 aa, Arabidopsis thaliana
  misc_feature (1)..(372): Ceres CLONE ID no. 29675
  misc_feature (136)..(159): Pfam Name: LRR_1 Pfam Description: Leucine Rich Repeat
  misc_feature: Utility: Mannitol Useful for making plants with enhanced tolerance to drought
  misc_feature: Phenotype: WHOLE PLANT - Mannitol Useful for making plants with enhanced tolerance to drought
MRKLLASPFSSLLAVVFISVISVVRCCSPKDQTALNAFKSSLSEPNLGIFNTWSENTDCCKEWYGISCDPDSGRVTDISLRGESEDAIFQKAGRSGYMSGSIDPAVCDLTALTSLVLADWKGITGEIPPCITSLASLRILDLAGNKITGEIPAEIGKLSKLAVLNLAENQMSGEIPASLTSLIELKHLELTENGITGVIPADFGSLKMLSRVLLGRNELTGSIPESISGMERLADLDLSKNHIEGPIPEWMGNMKVLSLLNLDCNSLTGPIPGSLLSNSGLDVANLSRNALEGTIPDVFGSKTYLVSLDLSHNSLSGRIPDSLSSAKFVGHLDISHNKLCGRIPTGFPFDHLEATSFSDNQCLCGGPLTTSC

SEQ ID NO: 1152 - DNA, 1098 bp, Populus balsamifera subsp. trichocarpa
  misc_feature (1)..(1098): Ceres ANNOT ID no. 1461449
  misc_feature: Utility: Mannitol Useful for making plants with enhanced tolerance to drought
  misc_feature 122433:<222: Transcription Factor
  misc_feature: Phenotype: WHOLE PLANT - Mannitol Useful for making plants with enhanced tolerance to drought
atgagtgcgttactcacaacactagctctcctcttcaccctcatctacacagtcacttccagctgcactccatcagacctagcagcattactagccttcaagtcttccctcaatgaaccatacttaggcatcttcaacacatggtcaggcactaactgctgctccaactggtacggcatcagctgtgaccccaccacaggcagagtcgcagacatcaacctgcgaggtgaatccgaagaccccatcttcgagaaggctggcaggtcaggctacatgactggttccatcaacccttcattatgtaaacttgacaggctctctacgctcattctggcagactggaaaggggtttcgggtgaaattcctggatgtgttgcttctttaagtaatctccgaatcttggatcttataggtaaccaaatatctggcaagattcctgcaaatattgggaatctacagagacttactgttttaaaccttgctgataatggactcactggagagatccctgcttctctcacagctttggcaaatatgaagcatttggatcttagcagcaataagttgactggtcagttgccagctgattttggtaacttgaaaatgcttagccgtgcattgttgagtaaaaaccagctgagtggagcaataccaaactctatatcgggcatgtatcggctagcagacttggatttgtctgttaataaaatctcgggttcggtaccgggctggttaggcagcatgcgggttctttctacgcttaatctggatagtaacatgatttccggtcaattgccagcatctttgttgagcagtaccggtttggggatattgaacttgagcaggaatgctattgaaggtaacataccggatgctttcggaccgaaatcttacttcatggctcttgacttgtcttacaacaatctgaagggtccgatacccggttcactttcgtcggcagcatatgtggggcatttggatttaagccacaatcatctttgcggaacaattcctgttgggacaccatttgatcaccttgaagcatcctcgtttagttttaatgattgtctttgcgggaatccattaaagacttgttaa

SEQ ID NO: 1153 - protein, 365 aa, Populus balsamifera subsp. trichocarpa
  misc_feature (1)..(365): Ceres ANNOT ID no. 1461449
  misc_feature (178)..(201): Pfam Name: LRR_1 Pfam Description: Leucine Rich Repeat
  misc_feature: SWISSPROT Homolog: DR100_ARATH DNA-damage-repair/toleration protein DRT100 precursor with e-value of 6.5e-198 and BLAST sequence identity of 100.0
  misc_feature: SWISSPROT Homolog: BRI1_LYCES Brassinosteroid LRR receptor kinase precursorchloroplast precursor with e-value of 2.5e-43 and BLAST sequence identity of 34.5
  misc_feature SWISSPROT Homolog: BRI1_LYCESEC 2.7.11.1(tBRI1)Altered brassinolide sensitivity 1Systemin receptor SR160
  misc_feature: SWISSPROT Homolog: BRI1_LYCPE Systemin receptor SR160 precursor chloroplast precursor EC 2.7.11.1 (Brassinosteroid LRR receptor kinase) with e-value of 2.5e-43 and BLAST sequence identity of 34.3
  misc_feature: SWISSPROT Homolog: BRL1_ARATH Serine/threonine-protein kinase BRI1-like 1 precursor chloroplast precursor with e-value of 2.0e-38 and BLAST sequence identity of 31.6
  misc_feature: SWISSPROT Homolog: BRL1_ARATH EC 2.7.11.1 BRASSINOSTEROID INSENSITIVE 1-like protein 1
  misc_feature: SWISSPROT Homolog: PGIP2_ARATH Polygalacturonase inhibitor 2 precursor (Polygalacturonase-inhibiting protein) (PGIP-2) with e-value of 2.0e-38 and BLAST sequence identity of 32.7
  misc_feature: Utility: Mannitol Useful for making plants with enhanced tolerance to drought
  misc_feature 122562:<222: Transcription Factor
  misc_feature: Phenotype: WHOLE PLANT - Mannitol Useful for making plants with enhanced tolerance to drought
  misc_feature (1)..(365): Functional Homolog of  Ceres CLONE ID no. 29675 at SEQ ID NO. 1192 with e-value of 6.89E-129 and BLAST sequence identity of 64.4
MSALLTTLALLFTLIYTVTSSCTPSDLAALLAFKSSLNEPYLGIFNTWSGTNCCSNWYGISCDPTTGRVADINLRGESEDPIFEKAGRSGYMTGSINPSLCKLDRLSTLILADWKGVSGEIPGCVASLSNLRILDLIGNQISGKIPANIGNLQRLTVLNLADNGLTGEIPASLTALANMKHLDLSSNKLTGQLPADFGNLKMLSRALLSKNQLSGAIPNSISGMYRLADLDLSVNKISGSVPGWLGSMRVLSTLNLDSNMISGQLPASLLSSTGLGILNLSRNAIEGNIPDAFGPKSYFMALDLSYNNLKGPIPGSLSSAAYVGHLDLSHNHLCGTIPVGTPFDHLEASSFSFNDCLCGNPLKTC

SEQ ID NO: 1154 - DNA, 1101 bp, Populus balsamifera subsp. trichocarpa
  misc_feature (1)..(1101): Ceres ANNOT ID no. 1440240
  misc_feature: Utility: Mannitol Useful for making plants with enhanced tolerance to drought
  misc_feature 122670:<222: Transcription Factor
  misc_feature: Phenotype: WHOLE PLANT - Mannitol Useful for making plants with enhanced tolerance to drought
atgagtgtgttactactcacaacagtactaactctcctcttcaccctcatctccgtcacttccagctgcactccatcagacctagcagcgttacaagccttcaagtctaccctcgatgaaccatacttgggcatcttcaatacctgggcaggcaccaactgctgctccaactggtacggcatcagctgtgaccccaccacgggcagagtcgcagacatcaacctgcgtggtgaatccgaagaccccatcttcgaaaaagctggcaggtcaggttacatgacaggttccatcaacccttcaatatgcaaacttgacagactctctactttcattctagcagactggaaaggggtttcaggtgaaatccctgaatgtgttgtttctttaagtaatctccgaatcttggatctcataggtaacaagatctctggcaagattcctgctaatatcgggaatctacagagactcacggttttaaatcttgccgataacggactcactggagagattccttcgtcacttacaaagttggaaaacatgaagcatttggatcttagcaacaatatgctgactggtcagttaccttctgattttggtaacttgaaaatgcttagccgtgcattgttgagtaaaaaccagctaagtggagccataccaagctctatatcggttatgtatcggcttgcagacttggatttgtctgttaatcagatttcgggttggctaccagactggataggcagcatgccggttctttctacgcttaacttggatagtaacatgatttccggtccattgccacaatctttgttgagtagtaccggtttggggatgttgaacttgagcaagaatgctattgaaggtaacataccggatgctttcgggccgaaaacttactttatggctcttgatttgtcgtacaacaatttgaagggaccgatacccagttcactttcgtcggcggcatatgtggggcatttggatttaagccataactatctctgcggaccaattcctgttgggtcaccatttgatcaccttgaagcatcctcatatagttttaatgattgtctttgcgggaacccattgagggcttgttaa

SEQ ID NO: 1155 - protein, 366 aa, Populus balsamifera subsp. trichocarpa
  misc_feature (1)..(366): Ceres ANNOT ID no. 1440240
  misc_feature (179)..(202): Pfam Name: LRR_1 Pfam Description: Leucine Rich Repeat
  misc_feature: SWISSPROT Homolog: DR100_ARATH DNA-damage-repair/toleration protein DRT100 precursor with e-value of 6.5e-198 and BLAST sequence identity of 100.0
  misc_feature: SWISSPROT Homolog: BRI1_LYCES Brassinosteroid LRR receptor kinase precursorchloroplast precursor with e-value of 2.5e-43 and BLAST sequence identity of 34.5
  misc_feature SWISSPROT Homolog: BRI1_LYCESEC 2.7.11.1(tBRI1)Altered brassinolide sensitivity 1Systemin receptor SR160
  misc_feature: SWISSPROT Homolog: BRI1_LYCPE Systemin receptor SR160 precursor chloroplast precursor EC 2.7.11.1 (Brassinosteroid LRR receptor kinase) with e-value of 2.5e-43 and BLAST sequence identity of 34.3
  misc_feature: SWISSPROT Homolog: BRL1_ARATH Serine/threonine-protein kinase BRI1-like 1 precursor chloroplast precursor with e-value of 2.0e-38 and BLAST sequence identity of 31.6
  misc_feature: SWISSPROT Homolog: BRL1_ARATH EC 2.7.11.1 BRASSINOSTEROID INSENSITIVE 1-like protein 1
  misc_feature: SWISSPROT Homolog: PGIP2_ARATH Polygalacturonase inhibitor 2 precursor (Polygalacturonase-inhibiting protein) (PGIP-2) with e-value of 2.0e-38 and BLAST sequence identity of 32.7
  misc_feature: Utility: Mannitol Useful for making plants with enhanced tolerance to drought
  misc_feature 122800:<222: Transcription Factor
  misc_feature: Phenotype: WHOLE PLANT - Mannitol Useful for making plants with enhanced tolerance to drought
  misc_feature (1)..(366): Functional Homolog of  Ceres CLONE ID no. 29675 at SEQ ID NO. 1192 with e-value of 4.99E-126 and BLAST sequence identity of 63.8
MSVLLLTTVLTLLFTLISVTSSCTPSDLAALQAFKSTLDEPYLGIFNTWAGTNCCSNWYGISCDPTTGRVADINLRGESEDPIFEKAGRSGYMTGSINPSICKLDRLSTFILADWKGVSGEIPECVVSLSNLRILDLIGNKISGKIPANIGNLQRLTVLNLADNGLTGEIPSSLTKLENMKHLDLSNNMLTGQLPSDFGNLKMLSRALLSKNQLSGAIPSSISVMYRLADLDLSVNQISGWLPDWIGSMPVLSTLNLDSNMISGPLPQSLLSSTGLGMLNLSKNAIEGNIPDAFGPKTYFMALDLSYNNLKGPIPSSLSSAAYVGHLDLSHNYLCGPIPVGSPFDHLEASSYSFNDCLCGNPLRAC

SEQ ID NO: 1156 - protein, 360 aa, Arabidopsis thaliana
  misc_feature (1)..(360): Ceres CLONE ID no. 29678
  misc_feature (93)..(356): Pfam Name: polyprenyl_synt Pfam Description: Polyprenyl synthetase
  misc_feature: Utility: ABA Useful for making plants with enhanced tolerance to drought
  misc_feature: Phenotype: WHOLE PLANT - ABA Useful for making plants with enhanced tolerance to drought
MATTVHLSSFSLFIQSRGRRDNSISSVKSLKKRTGLSPSSALTSQGGRDMIPPERKCNDHNSAFDFKLYMIRKAESVNAALDVSVPLREPLTVQEAVRYSLLAGGKRVRPLLCIAVCELVGGDEATAMSAACAVEMIHTSSLIHDDLPCMDNADLRRGKPTNHKVYGEDMAVLAGDALLALAFEHMTVVSSGLVAPERMIRAVVELARAIGTTGLVAGQMIDLASERLNPDKVGLEHLEFIHLHKTAALLEAAAVLGVIMGGGTEEEIEKLRKYARCIGLLFQVVDDIPDVTKSTEELGKTAGKDVMAGKLTYPRLIGLERSKEVAEELRREAEEQLLGFDPSKAAPLVALASYIACRHN

SEQ ID NO: 1157 - DNA, 1101 bp, Populus balsamifera subsp. trichocarpa
  misc_feature (1)..(1101): Ceres ANNOT ID no. 1487885
  misc_feature: Utility: ABA Useful for making plants with enhanced tolerance to drought
  misc_feature 123011:<222: Transcription Factor
  misc_feature: Phenotype: WHOLE PLANT - ABA Useful for making plants with enhanced tolerance to drought
atgacttctgtgaatctgggtccatgggttcagataacttcaatcatcaacaaaaaaacaagatccagatccagacccatgtcaaacttcttgtccccgggccttaaaacccttcaaatcgcttcaacacatcaaagacagagaaaacccatgtcttcaatttgcgcagttcttacagaagaagagactcttcaagaagatcaacacaaacccacttttgatttcaagtcttatatgatacagaaagccaattctgttaacaaagcattagatactgctgttactcttaaagaaccggctaaaatccatgagtctatgcgttactctcttttggctggtggcaagagggttcggccagtgctttgtctagctgcatgtgagcttgttggtgggtctgaatccatggctatgcctgctgcttgtgctgtagaaatgatccatactatgtcattaatacatgatgatcttccttgcatggataatgatgatcttcgccgcggaaaatccaccaatcatattgtttttggtgaggatgttgcggttttggcaggggatgctttactggcatttgcatttgaacatattgcagtgtctacactcaatgtttcgcctcttagaattgttcgtgcagttggtgaattggcgaaagtgattggtgctgaaggacttgttgctggacaagttgtggatatttgttctgaagggttgtccgaagtggggttagaacagcttgaatttattcatattcataagactgctaagttgttggaaggtgcggttgttttaggggctatattaggtggagggaccgatgaggaagttgagaaattgaggcgatacgcgaggagtattggattgttgtttcaagtagtggatgatattcttgatgttaccaaatcttcacaagaattggggaaaactgcagggaaagatttggttgcggataaagttacttatcctaagttaatgggaattgagaagtctagggagtttgctgagaagttgcttaacgaagctagggagttgcttgctggatttgatcaagagaaggcggctccgttgattgctttggctaattacattgcttacaggcaaaactaa

SEQ ID NO: 1158 - protein, 316 aa, Populus balsamifera subsp. trichocarpa
  misc_feature (1)..(316): Ceres ANNOT ID no. 1487885
  misc_feature (52)..(312): Pfam Name: polyprenyl_synt Pfam Description: Polyprenyl synthetase
  misc_feature: SWISSPROT Homolog: GGPP3_ARATH Geranylgeranyl pyrophosphate synthetase 3, with e-value of 6.3e-184 and BLAST sequence identity of 99.2
  misc_feature: SWISSPROT Homolog: GGPP3_ARATH GGPP synthetase 3 (GGPS3)
  misc_feature: SWISSPROT Homolog: GGPP3_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_SINAL Geranylgeranyl pyrophosphate synthetase, with e-value of 3.5e-119 and BLAST sequence identity of 65.3
  misc_feature: SWISSPROT Homolog: GGPPS_SINAL GGPP synthetase (GGPS)
  misc_feature: SWISSPROT Homolog: GGPPS_SINAL Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPP1_ARATH Geranylgeranyl pyrophosphate synthetase 1, with e-value of 1.8e-117 and BLAST sequence identity of 65.1
  misc_feature: SWISSPROT Homolog: GGPP1_ARATH GGPP synthetase 1 (GGPS1)
  misc_feature: SWISSPROT Homolog: GGPP1_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_CATRO Geranylgeranyl pyrophosphate synthetase, with e-value of 1.4e-108 and BLAST sequence identity of 69.3
  misc_feature: SWISSPROT Homolog: GGPPS_CATRO GGPP synthetase (GGPS)
  misc_feature: SWISSPROT Homolog: GGPPS_CATRO Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_HEVBR Geranylgeranyl pyrophosphate synthetase, with e-value of 6.0e-108 and BLAST sequence identity of 62.6
  misc_feature: SWISSPROT Homolog: GGPPS_HEVBR GGPP synthetase
  misc_feature: SWISSPROT Homolog: GGPPS_HEVBR Dimethylallyltranstransferase (EC 2.5.1.1); Geranyltranstransferase (EC 2.5.1.10); Farnesyltranstransferase (EC 2.5.1.29);
  misc_feature: Utility: ABA Useful for making plants with enhanced tolerance to drought
  misc_feature 123196:<222: Transcription Factor
  misc_feature: Phenotype: WHOLE PLANT - ABA Useful for making plants with enhanced tolerance to drought
  misc_feature (1)..(316): Functional Homolog of  Ceres CLONE ID no. 29678 at SEQ ID NO. 1197 with e-value of 8.49E-108 and BLAST sequence identity of 70.0
MSSICAVLTEEETLQEDQHKPTFDFKSYMIQKANSVNKALDTAVTLKEPAKIHESMRYSLLAGGKRVRPVLCLAACELVGGSESMAMPAACAVEMIHTMSLIHDDLPCMDNDDLRRGKSTNHIVFGEDVAVLAGDALLAFAFEHIAVSTLNVSPLRIVRAVGELAKVIGAEGLVAGQVVDICSEGLSEVGLEQLEFIHIHKTAKLLEGAVVLGAILGGGTDEEVEKLRRYARSIGLLFQVVDDILDVTKSSQELGKTAGKDLVADKVTYPKLMGIEKSREFAEKLLNEARELLAGFDQEKAAPLIALANYIAYRQN

SEQ ID NO: 1159 - DNA, 1098 bp, Populus balsamifera subsp. trichocarpa
  misc_feature (1)..(1098): Ceres ANNOT ID no. 1457156
  misc_feature: Utility: ABA Useful for making plants with enhanced tolerance to drought
  misc_feature 123295:<222: Transcription Factor
  misc_feature: Phenotype: WHOLE PLANT - ABA Useful for making plants with enhanced tolerance to drought
atgacttctgtgaatctgggttcatggtttcagacatcaatcatcaacaaagatacaggacccagatccatacccatctcaaattttttatctccaggttctaaaagtcttcaaattccttcagtacatcaaaaacagagaaaacccatgtcttcaatttgtgcggttctcgcaaaagaagagactcttcaagaagatcaacgaaaacccacttttgatttcaagtcttacatgctacaaaaagccaattctgttaacaaagcattagatgctgctgtttctcttaaagagccggctaaaatccatgagtctatgcgatactctcttttggctggtggcaagagggttaggccagtgctttgtctcgctgcgtgtgaccttgttggtgggtctgaatccatggctttgcctgctgcttgtgccgtagaaatgatccatactatgtcattaatgcatgatgatcttccttgcatggataacgatgatcttcgccgtggaaaacccaccaatcatattgtttttggtgaggatgttgcggttttggcaggggatgctttactgtcatttgcatttgaacatattgcagtgtctacaatccatgtttcgcctcttagaattgttcgtgcaattggtgaattggcgaaagctattggtgctgaaggacttgtcgccgggcaagttgttgatatttgttctgaagggttgtccgaagtggggttggagcagcttgaatttattcatgtacataagactgcgaagttgttggaaggtgctgttgttctaggggccatattaggtggaggaaccgatgaggaagttgagaaattgaggacctatgcaagaagtattggattattgtttcaagtagtggatgatattcttgatgttaccaaatcttcacaagaattggggaaaactgcagggaaggatttggttgcggataaggttacttatcctaggttaatgggaattgagaagtctcgggagtttgctgagaggttgctgaacgaagccaaggacatgcttgctggatttaatcaagagaaggccgctccgttgatagctttggctaattacattgcttacaggcaaaactaa

SEQ ID NO: 1160 - protein, 365 aa, Populus balsamifera subsp. trichocarpa
  misc_feature (1)..(365): Ceres ANNOT ID no. 1457156
  misc_feature (101)..(361): Pfam Name: polyprenyl_synt Pfam Description: Polyprenyl synthetase
  misc_feature: SWISSPROT Homolog: GGPP3_ARATH Geranylgeranyl pyrophosphate synthetase 3, with e-value of 6.3e-184 and BLAST sequence identity of 99.2
  misc_feature: SWISSPROT Homolog: GGPP3_ARATH GGPP synthetase 3 (GGPS3)
  misc_feature: SWISSPROT Homolog: GGPP3_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_SINAL Geranylgeranyl pyrophosphate synthetase, with e-value of 3.5e-119 and BLAST sequence identity of 65.3
  misc_feature: SWISSPROT Homolog: GGPPS_SINAL GGPP synthetase (GGPS)
  misc_feature: SWISSPROT Homolog: GGPPS_SINAL Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPP1_ARATH Geranylgeranyl pyrophosphate synthetase 1, with e-value of 1.8e-117 and BLAST sequence identity of 65.1
  misc_feature: SWISSPROT Homolog: GGPP1_ARATH GGPP synthetase 1 (GGPS1)
  misc_feature: SWISSPROT Homolog: GGPP1_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_CATRO Geranylgeranyl pyrophosphate synthetase, with e-value of 1.4e-108 and BLAST sequence identity of 69.3
  misc_feature: SWISSPROT Homolog: GGPPS_CATRO GGPP synthetase (GGPS)
  misc_feature: SWISSPROT Homolog: GGPPS_CATRO Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_HEVBR Geranylgeranyl pyrophosphate synthetase, with e-value of 6.0e-108 and BLAST sequence identity of 62.6
  misc_feature: SWISSPROT Homolog: GGPPS_HEVBR GGPP synthetase
  misc_feature: SWISSPROT Homolog: GGPPS_HEVBR Dimethylallyltranstransferase (EC 2.5.1.1); Geranyltranstransferase (EC 2.5.1.10); Farnesyltranstransferase (EC 2.5.1.29);
  misc_feature: Utility: ABA Useful for making plants with enhanced tolerance to drought
  misc_feature 123480:<222: Transcription Factor
  misc_feature: Phenotype: WHOLE PLANT - ABA Useful for making plants with enhanced tolerance to drought
  misc_feature (1)..(365): Functional Homolog of  Ceres CLONE ID no. 29678 at SEQ ID NO. 1197 with e-value of 4.19E-106 and BLAST sequence identity of 64.1
MTSVNLGSWFQTSIINKDTGPRSIPISNFLSPGSKSLQIPSVHQKQRKPMSSICAVLAKEETLQEDQRKPTFDFKSYMLQKANSVNKALDAAVSLKEPAKIHESMRYSLLAGGKRVRPVLCLAACDLVGGSESMALPAACAVEMIHTMSLMHDDLPCMDNDDLRRGKPTNHIVFGEDVAVLAGDALLSFAFEHIAVSTIHVSPLRIVRAIGELAKAIGAEGLVAGQVVDICSEGLSEVGLEQLEFIHVHKTAKLLEGAVVLGAILGGGTDEEVEKLRTYARSIGLLFQVVDDILDVTKSSQELGKTAGKDLVADKVTYPRLMGIEKSREFAERLLNEAKDMLAGFNQEKAAPLIALANYIAYRQN

SEQ ID NO: 1161 - protein, 232 aa, Arabidopsis thaliana
  misc_feature (1)..(232): Ceres CLONE ID no. 29992
  misc_feature (44)..(229): Pfam Name: SOUL Pfam Description: SOUL heme-binding protein
  misc_feature: Utility: MSX Useful for making plants tolerant to low nitrogen
  misc_feature: Phenotype: WHOLE PLANT - MSX Useful for making plants tolerant to low nitrogen
MATGLGFFKLSFLLSLLSGGSDLLGPDAESGVAQIGKFPPSCNRIECPSYELVHSGNGYEIRRYNNTVWVSTEPIPDISLVDATRTAFFQLFAYIQGKNEYHQKIEMTAPVISQVSPSDGPFCESSFTVSFYVPKKNQPDPAPSENLHIQKWNSRYVAVRQFSGFVSDDSIGEQAAALDSSLKGTAWANAIAKSKEDGGVGSDSAYTVAQYNSPFEFSGRVNEIWLPFELDV

SEQ ID NO: 1162 - DNA, 732 bp, Populus balsamifera subsp. trichocarpa
  misc_feature (1)..(732): Ceres ANNOT ID no. 1494652
  misc_feature: Utility: MSX Useful for making plants tolerant to low nitrogen
  misc_feature 123667:<222: Transcription Factor
  misc_feature: Phenotype: WHOLE PLANT - MSX Useful for making plants tolerant to low nitrogen
atggatggtgctatgaaaagctcacgagtctctcgaataaatgttatgagcatgttgaagctatcatttctcttgacccttctctcaagtgcaagctttggcccctggcatgatgaggctaagaggagcggcgttgcgatatacccacctgcttgcaccagtatagaatgcccagtgtttgatgttcttcaacttggcaatggctacgaaattcgtcgctataactcttctgtttggatgtccacctcttctatccaagatatctcccttgttgatgccaccagaactggattcttaaggctatttgactacatccaagggaagaatagctatgaagaaaaaatagagatgacagctccggtgatcactgaagtatcacccagtgatggaccgttctgtgaatcctcattcactgtcagtttctatgtcccaaaagagaaccaagctaatccacctccagcgaaaggcctccatgttcagagatggcaaccgacatatgtagctgtaaggcaattcaatggatttgtcactgactcaaatgttggagaggaagctgctgccttgcaagctagtcttgctgacaccatttgggctgctgccattgagaaaagccgtcctgattccactaccgtctatactgttgcacagtacaactctccatttgagtttgacaacagggtgaatgagatatggatgcaattttacgtagaagatgagctgctggtaatgtaa

SEQ ID NO: 1163 - protein, 228 aa, Populus balsamifera subsp. trichocarpa
  misc_feature (1)..(228): Ceres ANNOT ID no. 1494652
  misc_feature (39)..(220): Pfam Name: SOUL Pfam Description: SOUL heme-binding protein
  misc_feature: SWISSPROT Homolog: HEBP2_MOUSE Heme-binding protein 2 (Protein SOUL) with e-value of 3.9e-26 and BLAST sequence identity of 37.7
  misc_feature: SWISSPROT Homolog: HEBP2_HUMAN Heme-binding protein 2 (Protein SOUL) (Placental protein 23) (PP23) with e-value of 1.7e-25 and BLAST sequence identity of 42.4
  misc_feature: SWISSPROT Homolog: HEBP1_PIG Heme-binding protein 1 with e-value of 1.5e-10 and BLAST sequence identity of 28.8
  misc_feature: SWISSPROT Homolog: HEBP1_MOUSE Heme-binding protein 1 (p22HBP) with e-value of 2.2e-08 and BLAST sequence identity of 28.2
  misc_feature: SWISSPROT Homolog: HEBP1_HUMAN Heme-binding protein 1 (p22HBP) with e-value of 7.1e-08 and BLAST sequence identity of 28.2
  misc_feature: Utility: MSX Useful for making plants tolerant to low nitrogen
  misc_feature 123769:<222: Transcription Factor
  misc_feature: Phenotype: WHOLE PLANT - MSX Useful for making plants tolerant to low nitrogen
  misc_feature (1)..(228): Functional Homolog of  Ceres CLONE ID no. 29992 at SEQ ID NO. 1202 with e-value of 4.89E-73 and BLAST sequence identity of 63.3
MSMLKLSFLLTLLSSASFGPWHDEAKRSGVAIYPPACTSIECPVFDVLQLGNGYEIRRYNSSVWMSTSSIQDISLVDATRTGFLRLFDYIQGKNSYEEKIEMTAPVITEVSPSDGPFCESSFTVSFYVPKENQANPPPAKGLHVQRWQPTYVAVRQFNGFVTDSNVGEEAAALQASLADTIWAAAIEKSRPDSTTVYTVAQYNSPFEFDNRVNEIWMQFYVEDELLVM

SEQ ID NO: 1164 - protein, 219 aa, Arabidopsis thaliana
  misc_feature (1)..(219): Ceres CLONE ID no. 30759
  misc_feature (5)..(76): Pfam Name: GST_N Pfam Description: Glutathione S-transferase, N-terminal domain
  misc_feature (85)..(193): Pfam Name: GST_C Pfam Description: Glutathione S-transferase, C-terminal domain
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
MANEVILLDFWPSMFRMRTRIALREKGVEFEYREEDLRNKSPLLLQMNPIHKKIPVLIHNGKPVNESIIQVQYIDEVWSHKNPILPSDPYLRAQARFWADFIDKKLYDAQRKVWATKGEEQEAGKKDFIEILKTLESELGDKPYFSGDDFGYVDIALIGFYTWFPAYEKFANFSIESEVPKLIAWVKKCLQRESVAKSLPDPEKVTEFVSELRKKFVPE

SEQ ID NO: 1165 - DNA, 663 bp, Populus balsamifera subsp. trichocarpa
  misc_feature (1)..(663): Ceres ANNOT ID no. 1520359
  misc_feature 123937:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctagtgatcaagtgaccctgttggatttctggccaagtccatttggtatgagagtgagattagcgttggctgaaaagggcgtcaagtatgagtacagtgaagaagatttgaggaacaaaagtgctttgctccttcaaatgaatcctgttaacaagcaaatcccagttcttgtccataatgggaaacctgtctgtgagtcacttattattgttcaatatattgatgaggtgtggaaggatagcgctcctttgttgccttctgatccgtaccagagagctcagtctaggttctgggctgattttgttgacaagaagatatatgaccttgggaggaagatatggacgaaaaaaggagaagaacaggaggcagccaagaaggacttcattgacagcctcaagttgatggaaggagagctcggagacaagccttactttgggggcgagaccatcggctacgttgatatagcacttgttcctttctattcctggttttatgcctatgagaccatcggaaacttcaacatagaggccgagtgtccgaagatgattgcttactgtaagaggtgcttgcagaaagagactgtatccaaggcccttgaagatccacaaaaggtctatgatttcgttctgatgctgatgaagaagtttggtattgagtag

SEQ ID NO: 1166 - protein, 220 aa, Populus balsamifera subsp. trichocarpa
  misc_feature (1)..(220): Ceres ANNOT ID no. 1520359
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 124052:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 1.10E-80 and BLAST sequence identity of 67.9
MASDQVTLLDFWPSPFGMRVRLALAEKGVKYEYSEEDLRNKSALLLQMNPVNKQIPVLVHNGKPVCESLIIVQYIDEVWKDSAPLLPSDPYQRAQSRFWADFVDKKIYDLGRKIWTKKGEEQEAAKKDFIDSLKLMEGELGDKPYFGGETIGYVDIALVPFYSWFYAYETIGNFNIEAECPKMIAYCKRCLQKETVSKALEDPQKVYDFVLMLMKKFGIE

SEQ ID NO: 1167 - DNA, 663 bp, Populus balsamifera subsp. trichocarpa
  misc_feature (1)..(663): Ceres ANNOT ID no. 1494753
  misc_feature 124141:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctggtgatcaagtaaccctgttggatttctggtcaagtccatttggtatgagagtgagaatagcattggctgaaaagggtgtaaagtatgagtacagtgaacaagatttgaggaacaaaagtgatttgcttcttcaaatgaatcccgttcacaagaaaatcccagttcttgtccatgatgggaaacctgtttgtgaatcacttattattgttcagtatattgatgaggtgtggaaggataaggctcctttgttgccttctgatcctcacgagagagctcagtctaggttctgggcagattttgttgacaaaaagatgtatgactttgggaggaagatatggacaacaaaaggagaagatcaggaggcagccaagaaggatttcattgacagcctcaagctcttggaaggagagcttggagacaagccttactttgggggcgagaccctcggcttcgttgatgttgccctacttcctttctattgctggttttacgcctatgaaaccatcggcaacttcaatatagaggctgactgtccgaagctgattgcttactgtaagaggtgcctgcagaaagagagcgtatccaagtctcttaaagatccacataaagtctatgattttgttgtgatgctgaggaagatgttcgggcttgagtag

SEQ ID NO: 1168 - protein, 220 aa, Populus balsamifera subsp. trichocarpa
  misc_feature (1)..(220): Ceres ANNOT ID no. 1494753
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 124256:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 4.90E-80 and BLAST sequence identity of 68.6
MAGDQVTLLDFWSSPFGMRVRIALAEKGVKYEYSEQDLRNKSDLLLQMNPVHKKIPVLVHDGKPVCESLIIVQYIDEVWKDKAPLLPSDPHERAQSRFWADFVDKKMYDFGRKIWTTKGEDQEAAKKDFIDSLKLLEGELGDKPYFGGETLGFVDVALLPFYCWFYAYETIGNFNIEADCPKLIAYCKRCLQKESVSKSLKDPHKVYDFVVMLRKMFGLE

SEQ ID NO: 1169 - DNA, 663 bp, Populus balsamifera subsp. trichocarpa
  misc_feature (1)..(663): Ceres ANNOT ID no. 1441875
  misc_feature 124345:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctggtgatcaagtaaccctgttggatttctgggcaagtccatttggtatgagagtgagaatagcattggctgaaaagggtgtaaagtacgagtacagtgaacaagatttgaggaacaaaagtgctttacttcttcaaatgaatcctgttcacaagaaaatcccagttcttgtccatgatggaaaacctatttgtgagtcacttatcattgttcagtatattgatgacgtgtggaaggacaaggctcctttgttgccttctgatccttaccagagagctcagtcaaggttctgggcagattttgttgacaaaaagttatatgaccttgggaggaagatatggacaacaaaaggagaagatcaggaggccgccaagaaggatttcatcgacagcctcaagcttttggaaggggagcttggagacaagccttattttggtggcgagaccctcggctacgttgatgtagcactacttcctttctattgctggttttatgcctatgaaacagtcggcaacttcaatatagaggctgtctgtccaaagctgattgcttactgtaagaggtgcttggagaaagagagtgtatccaagtctcttgaagatccacagaaagtctctgatttcgttgtgatgaggagaaagatgcttgggcttgagtaa

SEQ ID NO: 1170 - protein, 220 aa, Populus balsamifera subsp. trichocarpa
  misc_feature (1)..(220): Ceres ANNOT ID no. 1441875
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 124460:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 1.70E-79 and BLAST sequence identity of 68.3
MAGDQVTLLDFWASPFGMRVRIALAEKGVKYEYSEQDLRNKSALLLQMNPVHKKIPVLVHDGKPICESLIIVQYIDDVWKDKAPLLPSDPYQRAQSRFWADFVDKKLYDLGRKIWTTKGEDQEAAKKDFIDSLKLLEGELGDKPYFGGETLGYVDVALLPFYCWFYAYETVGNFNIEAVCPKLIAYCKRCLEKESVSKSLEDPQKVSDFVVMRRKMLGLE

SEQ ID NO: 1171 - DNA, 660 bp, Populus balsamifera subsp. trichocarpa
  misc_feature (1)..(660): Ceres ANNOT ID no. 1467006
  misc_feature 124549:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctgatgaggtgacactgctggatttttgggcaagcccttttggtataagagtgagaatagcattggcagagaagggagtcaagtatgagtacagtgaacagaacttgagggacaagagtgcattgcttcttcagatgaacccagtctacaagcagatcccaactctcatccacaatggaagatcagtctgtgagtcccttattattgttcagtatgttgacgatgtatggaagggaaaggcccctcttctgccttctgatccttaccaaagagcccagtccagattctgggcagattttattgacaagaaggtatttgagattactacgaagttatggagaacgaaaggagaagaactggagggagcaaaaaaggattttatcgagtgcctcaagctgttggaaggagagcttggagacaagccttatttcggcggagagaactttgggtacgtggatgttgcgttcgttcctttctactgctggttttatgcctatgagacctgtggaaacttcagcatagaggcagagtgccccaagatcattgcatgggctaagagatgcatgcaaaaagagagtgtatccaagtctcttgaagacccaaaaaaggtgtacgagttcgtcttggagcgcaggaagaggtttggggtggattaa

SEQ ID NO: 1172 - protein, 219 aa, Populus balsamifera subsp. trichocarpa
  misc_feature (1)..(219): Ceres ANNOT ID no. 1467006
  misc_feature (5)..(76): Pfam Name: GST_N Pfam Description: Glutathione S-transferase, N-terminal domain
  misc_feature (85)..(193): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 124664:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(219): Functional Homolog of  Ceres CLONE ID no. 30759 at SEQ ID NO. 1205 with e-value of 9.19E-79 and BLAST sequence identity of 66.6
MADEVTLLDFWASPFGIRVRIALAEKGVKYEYSEQNLRDKSALLLQMNPVYKQIPTLIHNGRSVCESLIIVQYVDDVWKGKAPLLPSDPYQRAQSRFWADFIDKKVFEITTKLWRTKGEELEGAKKDFIECLKLLEGELGDKPYFGGENFGYVDVAFVPFYCWFYAYETCGNFSIEAECPKIIAWAKRCMQKESVSKSLEDPKKVYEFVLERRKRFGVD

SEQ ID NO: 1173 - DNA, 663 bp, Populus balsamifera subsp. trichocarpa
  misc_feature (1)..(663): Ceres ANNOT ID no. 1441867
  misc_feature 124753:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctgatgatcaagtaaccctgttggatttgtgggcaagtccatttggcatgagagtgagaatagcattggctgaaaaggctgtcaagtatgagtacagtgaacaagatttgtggaacaaaggtgatttacttcttcaaatgaatcctgttcacaagaaaatcccagttcttgtccatgatgggaaacctatttgtgagtcacttatcattgttcagtatattgatgaggtgtggaatgataaggctcctttgttgtcttctgatccctacgagagagctcaatctaggttctgggcagactttgttgataagaagatacatgacgtcgggaggaagatatggacaacaaaaggagaagatcaggaggcagccaagaaggatttcattgacagcctcaagcttttggaaggagagcttggagacaagccttactttgggggcgacaccctcggttacgttgatgtagcactacttcctttctattgctggttttatgcctatgaaaccatcggcaacttcaatatagaggctgattgtccgaagctgattgcttactgtaagaggtgcttggagaaagagagtgtatccaagtccgttaaagatccacagaaagtctatgatttcgttgtgatgctgaggaagaagtttgggcttgagtag

SEQ ID NO: 1174 - protein, 220 aa, Populus balsamifera subsp. trichocarpa
  misc_feature (1)..(220): Ceres ANNOT ID no. 1441867
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 124868:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 6.49E-78 and BLAST sequence identity of 66.3
MADDQVTLLDLWASPFGMRVRIALAEKAVKYEYSEQDLWNKGDLLLQMNPVHKKIPVLVHDGKPICESLIIVQYIDEVWNDKAPLLSSDPYERAQSRFWADFVDKKIHDVGRKIWTTKGEDQEAAKKDFIDSLKLLEGELGDKPYFGGDTLGYVDVALLPFYCWFYAYETIGNFNIEADCPKLIAYCKRCLEKESVSKSVKDPQKVYDFVVMLRKKFGLE

SEQ ID NO: 1175 - DNA, 663 bp, Populus balsamifera subsp. trichocarpa
  misc_feature (1)..(663): Ceres ANNOT ID no. 1441871
  misc_feature 124957:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctggtgatcaggtaaccctgttggatttctggtcaagtccatttggtatgagagtgagaatagcgttggctgaaaagggtgtaaagtatgagtactgtgaacaagatttgaggaacaaaagtgatttgcttcttcaaatgaatcctgttcacaagaaaatcccagttcttgtccatgatgggaaacctgtttgtgagtcacttatcattgttcagtatattgatgaggtgtggaaggacaaggctcctttgttgccttctgatcctcacaagagagctcagtctaggttttgggcagattttgtcgacaaaaagatatatgactttgggaggaagatatggacaacaaacggggaagatcaggaggcagccaagaaggatttcattgacagcctcaagcttttggaaggagagcttggagacaagccttactttgggggcgagaccctcggctatgttgatgtagcactacttcctttctattgctggttttatgcctatgaaaccatcggcaacttcaatatagaagctgactgtccgaagcttattgcttgctgtaagaggtgcttgcagaaagagagcgtatccaagtctctaaaagatcctcagatactctatgatttcgctgtgatggtgaggaagaagcttgggcttgagtag

SEQ ID NO: 1176 - protein, 220 aa, Populus balsamifera subsp. trichocarpa
  misc_feature (1)..(220): Ceres ANNOT ID no. 1441871
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 125072:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 1.10E-77 and BLAST sequence identity of 67.1
MAGDQVTLLDFWSSPFGMRVRIALAEKGVKYEYCEQDLRNKSDLLLQMNPVHKKIPVLVHDGKPVCESLIIVQYIDEVWKDKAPLLPSDPHKRAQSRFWADFVDKKIYDFGRKIWTTNGEDQEAAKKDFIDSLKLLEGELGDKPYFGGETLGYVDVALLPFYCWFYAYETIGNFNIEADCPKLIACCKRCLQKESVSKSLKDPQILYDFAVMVRKKLGLE

SEQ ID NO: 1177 - DNA, 663 bp, Populus balsamifera subsp. trichocarpa
  misc_feature (1)..(663): Ceres ANNOT ID no. 1441864
  misc_feature 125161:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctggtgatcaagtaaccctgttggatttgtgggcaagtccatttggtatgagagtgagaatagcattggctgaaaaggctgtaaagtatgagtacagtgaacaagatttgtggaacaaaggtgctttacttcttcaaatgaatcctgttcacaagagaatcccagttcttgtccatgatgggaaacctatttttgagtcacttatcattgttcagtatattgatgaggtgtggaaggataaggctcctttgttgccttctgatccctacgagagagctcaatctaggttctgggcagattttgttgataagaagttatatgaccttgggaggaagatatggacaacaaaaggagaagatcaggaggcagccaagaaggatttcatcgacagcctcaagcttttggaaggggagcttggagacaagccttattttggtggcgagaccctcggctacgttgatgtagcactacttcctttctattgctggttttatgcctatgaaacagtcggcaacttcaatatagaggctgtctgtccaaagctgattgcttactgtaagaggtgcttggagaaagagagtgtatccaagtctcttgaagatccacagaaagtctctgatttcgttgtgatgaggagaaagatgcttgggcttgagtaa

SEQ ID NO: 1178 - protein, 220 aa, Populus balsamifera subsp. trichocarpa
  misc_feature (1)..(220): Ceres ANNOT ID no. 1441864
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 125276:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 7.40E-77 and BLAST sequence identity of 66.5
MAGDQVTLLDLWASPFGMRVRIALAEKAVKYEYSEQDLWNKGALLLQMNPVHKRIPVLVHDGKPIFESLIIVQYIDEVWKDKAPLLPSDPYERAQSRFWADFVDKKLYDLGRKIWTTKGEDQEAAKKDFIDSLKLLEGELGDKPYFGGETLGYVDVALLPFYCWFYAYETVGNFNIEAVCPKLIAYCKRCLEKESVSKSLEDPQKVSDFVVMRRKMLGLE

SEQ ID NO: 1179 - DNA, 663 bp, Populus balsamifera subsp. trichocarpa
  misc_feature (1)..(663): Ceres ANNOT ID no. 1441868
  misc_feature 125365:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctggtgatcaagtaaccctgttgaatttctgggcaagtccatttggtatgagagtgagaatagcattggctgaaaagggtgtaaagtatgagtacggcgaacaagatttgaggaacaaaactgctttacttcttcaaatgaatcctgttcactcgaaaatcctagttcttgtccataatgggaaacctgcttgtgagtcacttatcattgttcagtatattaatgaggcgtggaaggacaaggctcctttgttgccttctgatccttaccagggagctctgtcaaggttctgggcagattttgttgacaaaaagatatatgacctcgggaggaagatatggacaacaaaaagagaagatcaggagtcagccaagaaggatttcattgatagcctcaagctgttggaaggagagcttggagacaagccttactttgggggcgacaccctcggctacgttgatgtagcactacttcctttctattgctggttttatgcctatgaaaccatcggcaacttcaatatagaggctgattgtccgaagctgattgcttactgcaagaggtgcttgcagaaagagagtgtatccaagtctcttgaagatccacagaaagtctctgatttcgttgtgatgatgagaaagaagcttgggcttgagtaa

SEQ ID NO: 1180 - protein, 220 aa, Populus balsamifera subsp. trichocarpa
  misc_feature (1)..(220): Ceres ANNOT ID no. 1441868
  misc_feature (6)..(77): Pfam Name: GST_N Pfam Description: Glutathione S-transferase, N-terminal domain
  misc_feature (86)..(194): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 125480:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(220): Functional Homolog of  Ceres CLONE ID no. 30759 at SEQ ID NO. 1205 with e-value of 6.69E-76 and BLAST sequence identity of 65.2
MAGDQVTLLNFWASPFGMRVRIALAEKGVKYEYGEQDLRNKTALLLQMNPVHSKILVLVHNGKPACESLIIVQYINEAWKDKAPLLPSDPYQGALSRFWADFVDKKIYDLGRKIWTTKREDQESAKKDFIDSLKLLEGELGDKPYFGGDTLGYVDVALLPFYCWFYAYETIGNFNIEADCPKLIAYCKRCLQKESVSKSLEDPQKVSDFVVMMRKKLGLE

SEQ ID NO: 1181 - DNA, 711 bp, Populus balsamifera subsp. trichocarpa
  misc_feature (1)..(711): Ceres ANNOT ID no. 1441859
  misc_feature 125569:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctggtgatcaagtaaccctgttggatttctggtcaagtccatttggtatgagagtgagaatagcattggctgaaaagggtgtaaagtatgagtacagtgaacaagatttgaggaacaaaagtgatttgcttcttcaaatgaatcccgttcacaagaaaatcccagttcttgtccatgatgggaaacctgtttgtgaatcacttattattgttcagtatattgatgaggtgtggaaggataaggctcctttgttgccttctgatcctcacgagagagctcagtctaggttctgggcagattttgttgacaaaaagtcaccttcaagtatccaaaaatatatcatcgatgctgacattatagagatgtatgactttgggaggaagatatggacaacaaaaggagaagatcaggaggcagccaagaaggatttcattgacagcctcaagctcttggaaggagagcttggagacaagccttactttgggggcgagaccctcggcttcgttgatgttgccctacttcctttctattgctggttttacgcctatgaaaccatcggcaacttcaatatagaggctgactgtccgaagctgattgcttactgtaagaggtgcctgcagaaagagagcgtatccaagtctcttaaagatccacataaagtctatgattttgttgtgatgctgaggaagatgttcgggcttgagtag

SEQ ID NO: 1182 - protein, 236 aa, Populus balsamifera subsp. trichocarpa
  misc_feature (1)..(236): Ceres ANNOT ID no. 1441859
  misc_feature (6)..(77): Pfam Name: GST_N Pfam Description: Glutathione S-transferase, N-terminal domain
  misc_feature (86)..(210): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 125684:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(236): Functional Homolog of  Ceres CLONE ID no. 30759 at SEQ ID NO. 1205 with e-value of 6.69E-76 and BLAST sequence identity of 68.6
MAGDQVTLLDFWSSPFGMRVRIALAEKGVKYEYSEQDLRNKSDLLLQMNPVHKKIPVLVHDGKPVCESLIIVQYIDEVWKDKAPLLPSDPHERAQSRFWADFVDKKSPSSIQKYIIDADIIEMYDFGRKIWTTKGEDQEAAKKDFIDSLKLLEGELGDKPYFGGETLGFVDVALLPFYCWFYAYETIGNFNIEADCPKLIAYCKRCLQKESVSKSLKDPHKVYDFVVMLRKMFGLE

SEQ ID NO: 1183 - DNA, 660 bp, Populus balsamifera subsp. trichocarpa
  misc_feature (1)..(660): Ceres ANNOT ID no. 1467009
  misc_feature 125776:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
atggctgatgaggtgacactgctggatttttgggcaagcccttttggcatgagagttaaaatagcattggcagagaagggagtcaagtatgagtacagtgaacaggacttgagggacaagagtgcattgcttcttcagatgaacccagtctacaagaagattccagttctcgtccacagaggaaaaccagtttgcgagtcccttattattgttcagtatattgatgatgtgtggaggggcaagactcctttgctaccttctgatccttatgaaagagctcagtccatgttctgggctgattttattgataaaaagatacatgatctttctaggaagatatggacaacaaaaggagaagaaatggaggcggcaaagaagggtttctttgaatgccttgagttattggagggagaactaggagagaagccttattttgggggtgagactctggggtatgtggatattgcctttcttcctttctgttgcgggttttctacttatgagaccatcggaaacttcagcatagaagctcaatgtcccaagatcattgcatgggctaaaaggtgcctgcaaaaagagagtgtagccaagtctcttgcagaacctggaaaggtccacgagttggttatggagataagaaagagccttgggtttgactga

SEQ ID NO: 1184 - protein, 219 aa, Populus balsamifera subsp. trichocarpa
  misc_feature (1)..(219): Ceres ANNOT ID no. 1467009
  misc_feature (5)..(76): Pfam Name: GST_N Pfam Description: Glutathione S-transferase, N-terminal domain
  misc_feature (85)..(193): Pfam Name: GST_C Pfam Description: Glutathione S-transferase, C-terminal domain
  misc_feature: SWISSPROT Homolog: GSTXC_TOBAC Probable glutathione S-transferase parC (EC 2.5.1.18) (Auxin-regulated protein parC) with e-value of 8.2e-88 and BLAST sequence identity of 75.7
  misc_feature: SWISSPROT Homolog: GSTX4_TOBAC Probable glutathione S-transferase (EC 2.5.1.18) (Auxin-induced protein PCNT107) with e-value of 1.0e-87 and BLAST sequence identity of 75.7
  misc_feature: SWISSPROT Homolog: LGUL_SOYBN Lactoylglutathione lyase (EC 4.4.1.5) (Methylglyoxalase) (Aldoketomutase) (Glyoxalase I) with e-value of 1.4e-74 and BLAST sequence identity of 62.1
  misc_feature: SWISSPROT Homolog: GSTXA_TOBAC Probable glutathione S-transferase parA (EC 2.5.1.18) (Auxin-regulated protein parA) (STR246C protein) with e-value of 3.8e-74 and BLAST sequence identity of 62.6
  misc_feature: SWISSPROT Homolog: GSTX1_NICPL Probable glutathione S-transferase MSR-1 (EC 2.5.1.18) (Auxin-regulated protein MSR-1) with e-value of 1.1e-69 and BLAST sequence identity of 59.8
  misc_feature 125891:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Useful for modulating plant height
  misc_feature: Phenotype: FLOWER - Other Useful for making ornamental plants with modified flowers
  misc_feature (1)..(219): Functional Homolog of  Ceres CLONE ID no. 30759 at SEQ ID NO. 1205 with e-value of 1.40E-75 and BLAST sequence identity of 65.8
MADEVTLLDFWASPFGMRVKIALAEKGVKYEYSEQDLRDKSALLLQMNPVYKKIPVLVHRGKPVCESLIIVQYIDDVWRGKTPLLPSDPYERAQSMFWADFIDKKIHDLSRKIWTTKGEEMEAAKKGFFECLELLEGELGEKPYFGGETLGYVDIAFLPFCCGFSTYETIGNFSIEAQCPKIIAWAKRCLQKESVAKSLAEPGKVHELVMEIRKSLGFD

SEQ ID NO: 1185 - protein, 202 aa, Arabidopsis thaliana
  misc_feature (1)..(202): Ceres CLONE ID no. 31014
  misc_feature (36)..(180): Pfam Name: PMSR Pfam Description: Peptide methionine sulfoxide reductase
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
MNILNRLGLGSSGQTNMDPSPIAQGNDDDTPAPGNQFAQFGAGCFWGVELAFQRVPGVTQTEAGYTQGTVHNPSYGDVCSGTTGHSEVVRVQYDLNDCTYESLLDLFWSRHDPTTLNRQGNDVGTQYRSGIYFYTPEQEKLARESLERHQQQMERKIMTEILPAKKFYRAEEHHQQYLSKGGRFGQGQSTAKGCNDPIRCYG

SEQ ID NO: 1186 - DNA, 795 bp, Populus balsamifera subsp. trichocarpa
  misc_feature (1)..(795): Ceres ANNOT ID no. 1527449
  misc_feature 126068:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
atgctccgaaatcttgctacccacttctcctctacctcctccaccaccaccagcagcagcaccacccctcttctcgtcctctcaaaacctttccgttctctctcatcaaaatcgctactttttctctctaaacccttcaatttccctcgaacctcaaaacccatctcttattacaagccatcaatgaacatccttaacaaactaggctttggtcccaggtcacctgacccatcaacaatggacccaacaatcccacaaggtcccgatgatgacttaccagctcctggtcagcaatttgctcagtttggagctggttgtttttggggtgttgaattagcatttcaaagagtccctggtgttactaaaactgaagtgggttatactcagggcttattgcataatccaacttatgaggatgtttgttccggcactactaatcataatgaagttgttagggttcagtatgaccctaaagagtgtagctttgacactttgcttgatgttttgtgggctagacatgaccctactgccttgaatcgccaggggaatgatgtgggaacacagtacaggtctggaatatactattacacccctgagcaggagaaagcagcgaaggagtccttggaacggcagcagaagctcttgaacaggaagatagtcactgagattttacctgccaaaaaattctacagagcagaagaataccaccagcagtatcttgcgaagggtggccgatttggatttatgcaatctgctgagaaaggatgcaatgatccaatcaaatgctatggctaa

SEQ ID NO: 1187 - protein, 203 aa, Populus balsamifera subsp. trichocarpa
  misc_feature (1)..(203): Ceres ANNOT ID no. 1527449
  misc_feature (37)..(190): Pfam Name: PMSR Pfam Description: Peptide methionine sulfoxide reductase
  misc_feature: SWISSPROT Homolog: MSRA_LACSA Peptide methionine sulfoxide reductase (EC 1.8.4.6) (Protein-methionine-S-oxide reductase) (Peptide Met(O) reductase) with e-value of 1.2e-84 and BLAST sequence identity of 75.5
  misc_feature: SWISSPROT Homolog: MSRA_ARATH Peptide methionine sulfoxide reductase (EC 1.8.4.6) (Protein-methionine-S-oxide reductase) (Peptide Met(O) reductase) with e-value of 5.0e-81 and BLAST sequence identity of 71.4
  misc_feature: SWISSPROT Homolog: MSRA_BRANA Peptide methionine sulfoxide reductase (EC 1.8.4.6) (Protein-methionine-S-oxide reductase) (Peptide Met(O) reductase) with e-value of 6.5e-79 and BLAST sequence identity of 71.6
  misc_feature: SWISSPROT Homolog: MSRA_LYCES Peptide methionine sulfoxide reductase with e-value of 1.4e-67 and BLAST sequence identity of 66.0
  misc_feature: SWISSPROT Homolog: MSRA_LYCES EC 1.8.4.6 Protein-methionine-S-oxide reductase Peptide Met(O) reductase Fruit-ripening protein E4 (Fragment)
  misc_feature: SWISSPROT Homolog: MSRA_FRAAN Peptide methionine sulfoxide reductase with e-value of 1.2e-63 and BLAST sequence identity of 66.3
  misc_feature: SWISSPROT Homolog: MSRA_FRAAN EC 1.8.4.6 (Protein-methionine-S-oxide reductase) Peptide Met(O) reductase Fruit-ripening protein E4
  misc_feature 126204:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(203): Functional Homolog of  Ceres CLONE ID no. 31014 at SEQ ID NO. 1226 with e-value of 8.39E-85 and BLAST sequence identity of 76.6
MNILNKLGFGPRSPDPSTMDPTIPQGPDDDLPAPGQQFAQFGAGCFWGVELAFQRVPGVTKTEVGYTQGLLHNPTYEDVCSGTTNHNEVVRVQYDPKECSFDTLLDVLWARHDPTALNRQGNDVGTQYRSGIYYYTPEQEKAAKESLERQQKLLNRKIVTEILPAKKFYRAEEYHQQYLAKGGRFGFMQSAEKGCNDPIKCYG

SEQ ID NO: 1188 - DNA, 987 bp, Populus balsamifera subsp. trichocarpa
  misc_feature (1)..(987): Ceres ANNOT ID no. 1484207
  misc_feature 126297:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
atgctccaaactctatccacccatctctcctccacctccacctccacctccaccaccacacctctcctcctcctctcaaaacccttcctgtctccctctgcaaaatcccagctttctcactctaaacccttcaacttccctcgaaccttaaaacccatctcttattacaagccccccatgaacatccttagcaaactaggctttggtactaggtcacctgacccatccacaatggacccaacaatcccacaaggtcctgacgatgacttaccagctcctggtcagcaatttgctcagtttggagctggttgtttttggggtgttgaattggcatttcaaagagtcccgggcgttaccaaaactgaagtgggttatactcaaggcttatcacataatccaagttatgaagatgtttgtactggtactaccaagcatagcgaagttgttagggttcagtatgaccctaaagagggtagctttgagactttgcttgatgctttttgggctagacatgatcctactaccttgaatcgccagggatatgagctgggttttgattggattgtggtggatcggttgcactttaatgttgctgtgcaaaggagtccaattttcatcatggctactctatgtcatatgaggattattgggtattatcactttttttcattggaacatgcgctccattcggacatcaatattctaggcagtagtcctggtatgcctgtggtcgttgggaatgatgtgggaacacagtacaggtctggaatatactattacacccctgagcaggagaaggcagcaaaggaatccatggaacagcagcagaagctctcaaacaggaaaatagtcacggagattttacctgccaaaaaattctaccgagcagaagaataccaccaacagtatcttgccaaaggaggccgttttggatttaaacaatcttctgagaaaggctgcaatgatccaatcagatgctatggctaa

SEQ ID NO: 1189 - protein, 269 aa, Populus balsamifera subsp. trichocarpa
  misc_feature (1)..(269): Ceres ANNOT ID no. 1484207
  misc_feature (37)..(121): Pfam Name: PMSR Pfam Description: Peptide methionine sulfoxide reductase
  misc_feature: SWISSPROT Homolog: MSRA_LACSA Peptide methionine sulfoxide reductase (EC 1.8.4.6) (Protein-methionine-S-oxide reductase) (Peptide Met(O) reductase) with e-value of 1.2e-84 and BLAST sequence identity of 75.5
  misc_feature: SWISSPROT Homolog: MSRA_ARATH Peptide methionine sulfoxide reductase (EC 1.8.4.6) (Protein-methionine-S-oxide reductase) (Peptide Met(O) reductase) with e-value of 5.0e-81 and BLAST sequence identity of 71.4
  misc_feature: SWISSPROT Homolog: MSRA_BRANA Peptide methionine sulfoxide reductase (EC 1.8.4.6) (Protein-methionine-S-oxide reductase) (Peptide Met(O) reductase) with e-value of 6.5e-79 and BLAST sequence identity of 71.6
  misc_feature: SWISSPROT Homolog: MSRA_LYCES Peptide methionine sulfoxide reductase with e-value of 1.4e-67 and BLAST sequence identity of 66.0
  misc_feature: SWISSPROT Homolog: MSRA_LYCES EC 1.8.4.6 Protein-methionine-S-oxide reductase Peptide Met(O) reductase Fruit-ripening protein E4 (Fragment)
  misc_feature: SWISSPROT Homolog: MSRA_FRAAN Peptide methionine sulfoxide reductase with e-value of 1.2e-63 and BLAST sequence identity of 66.3
  misc_feature: SWISSPROT Homolog: MSRA_FRAAN EC 1.8.4.6 (Protein-methionine-S-oxide reductase) Peptide Met(O) reductase Fruit-ripening protein E4
  misc_feature 126439:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(269): Functional Homolog of  Ceres CLONE ID no. 31014 at SEQ ID NO. 1226 with e-value of 6.59E-69 and BLAST sequence identity of 77.1
MNILSKLGFGTRSPDPSTMDPTIPQGPDDDLPAPGQQFAQFGAGCFWGVELAFQRVPGVTKTEVGYTQGLSHNPSYEDVCTGTTKHSEVVRVQYDPKEGSFETLLDAFWARHDPTTLNRQGYELGFDWIVVDRLHFNVAVQRSPIFIMATLCHMRIIGYYHFFSLEHALHSDINILGSSPGMPVVVGNDVGTQYRSGIYYYTPEQEKAAKESMEQQQKLSNRKIVTEILPAKKFYRAEEYHQQYLAKGGRFGFKQSSEKGCNDPIRCYG

SEQ ID NO: 1190 - protein, 295 aa, Arabidopsis thaliana
  misc_feature (1)..(295): Ceres CLONE ID no. 31044
  misc_feature (98)..(161): Pfam Name: AP2 Pfam Description: AP2 domain
  misc_feature: Phenotype: WHOLE PLANT - Small Useful for modulating plant size
  misc_feature: Phenotype: ROSETTE LEAVES - Other Useful for making ornamental plants with modified leaves
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 1191 - DNA, 810 bp, Populus balsamifera subsp. trichocarpa
  misc_feature (1)..(810): Ceres ANNOT ID no. 1486207
  misc_feature 126636:<222: Transcription Factor
  misc_feature: Phenotype: WHOLE PLANT - Small Useful for modulating plant size
  misc_feature: Phenotype: ROSETTE LEAVES - Other Useful for making ornamental plants with modified leaves
atggaaaaacatatcatccttgagattgatgcacaagacaattcccttacatcatcttccacttccaccaccaccaccaccaccaccacttcttcctcctcctcttctttttctaccaccatttcatacactgatcgaatctcaaaaaaagaagagaattctattgctgatccaaagggatcgagaaaatctcaagagttgcaaagtggcaatgagggtaataaaaagcgaaagactaccagaaatgagaataatgggaagcatccaacatacagaggagtaagaatgaggagctggggcaaatgggtgtgtgagatcagagagccaaggaagaagtcaagaatatggcttggaacataccctacagccgaaatggctgctcgagcccatgatgtagccgccttagccattaaaggcggctcagcctacctcaatttccctgaattggttgatgaactgcctcgtccactcagcaagtctcctaaggacattcaagctgcagctgccaaggcagccgccgcttcattccccgaaacaagacactgtgaagcagaagctgaagctgaagctgatatgagccatgccgagcttaacgtttccaatttatcagataatttggccatggacaacatacaagagtcaagcagttctccttcaactgatgttgatgacaagttgtttgaccttcctgatctcttcatcgacggcgttaatcacagtgatggattttgttattattctccaccatggcaattatgttctgctgatactggcttccggcttgaagagccatttttatgggagtactag

SEQ ID NO: 1192 - protein, 269 aa, Populus balsamifera subsp. trichocarpa
  misc_feature (1)..(269): Ceres ANNOT ID no. 1486207
  misc_feature (89)..(152): Pfam Name: AP2 Pfam Description: AP2 domain
  misc_feature: SWISSPROT Homolog: TINY_ARATH Transcriptional factor TINY with e-value of 1.2e-33 and BLAST sequence identity of 55.6
  misc_feature: SWISSPROT Homolog: DRE1D_ARATH Dehydration-responsive element-binding protein 1D with e-value of 2.9e-28 and BLAST sequence identity of 57.0
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1B_ARATH Dehydration-responsive element-binding protein 1B with e-value of 1.1e-26 and BLAST sequence identity of 57.5
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 1.9e-26 and BLAST sequence identity of 49.2
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1C_ARATH Dehydration-responsive element-binding protein 1C with e-value of 4.9e-26 and BLAST sequence identity of 46.0
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 126773:<222: Transcription Factor
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(269): Functional Homolog of  Ceres CLONE ID no. 31044 at SEQ ID NO. 1231 with e-value of 4.10E-60 and BLAST sequence identity of 57.8
MEKHIILEIDAQDNSLTSSSTSTTTTTTTTSSSSSSFSTTISYTDRISKKEENSIADPKGSRKSQELQSGNEGNKKRKTTRNENNGKHPTYRGVRMRSWGKWVCEIREPRKKSRIWLGTYPTAEMAARAHDVAALAIKGGSAYLNFPELVDELPRPLSKSPKDIQAAAAKAAAASFPETRHCEAEAEAEADMSHAELNVSNLSDNLAMDNIQESSSSPSTDVDDKLFDLPDLFIDGVNHSDGFCYYSPPWQLCSADTGFRLEEPFLWEY

SEQ ID NO: 1193 - DNA, 786 bp, Populus balsamifera subsp. trichocarpa
  misc_feature (1)..(786): Ceres ANNOT ID no. 1496976
  misc_feature 126864:<222: Transcription Factor
  misc_feature: Phenotype: WHOLE PLANT - Small Useful for modulating plant size
  misc_feature: Phenotype: ROSETTE LEAVES - Other Useful for making ornamental plants with modified leaves
atggaaaaacatatcaaccttgagattgatgctcaagacaatccccttgcctcatcttccaccaccacctccaccaccaaggggaacatctcttcctcctccacgcccatttcatgcataaagcaccaaggctcaaagaaagaagagaattgtattgctccaagagtatcaagaaaagctcaagaattacagagtagtggcaacgagggtggtaaaaggcgaaagaccaccgagaatgagaaaaatgggaagcatccgacatatagaggagtgaggatgagaagttggggcaaatgggtgtccgaaatcagagagccaaggaagaagtcgagaatatggcttggaacataccctacagctgaaatggcagctcgagcacatgatgtagccgcgttagccatcaaagggggctcagcttatctcaattttcctgaattcgctcatgaactccctcccccactcagcaagtcccctaaggacattcaagctgcagccgccaaggcagcggctgcttcgttcactgaaacaagatactgtgaaggtgaaggtgggggcgaagccgagcttaacgtttcgaatttatcagatagtttggccatggacaacacacaagaatcaagcagttctccttctactgattctgatgacacgttatttgaccttcctgacctcttcatcgatggcgttcatcacagtgatggattttgctattattcttcatcatggcaattatgtgcagccgatactggcttccggcttggagagccatttttattggagtactag

SEQ ID NO: 1194 - protein, 261 aa, Populus balsamifera subsp. trichocarpa
  misc_feature (1)..(261): Ceres ANNOT ID no. 1496976
  misc_feature (86)..(149): Pfam Name: AP2 Pfam Description: AP2 domain
  misc_feature: SWISSPROT Homolog: TINY_ARATH Transcriptional factor TINY with e-value of 1.2e-33 and BLAST sequence identity of 55.6
  misc_feature: SWISSPROT Homolog: DRE1D_ARATH Dehydration-responsive element-binding protein 1D with e-value of 2.9e-28 and BLAST sequence identity of 57.0
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1B_ARATH Dehydration-responsive element-binding protein 1B with e-value of 1.1e-26 and BLAST sequence identity of 57.5
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 1.9e-26 and BLAST sequence identity of 49.2
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1C_ARATH Dehydration-responsive element-binding protein 1C with e-value of 4.9e-26 and BLAST sequence identity of 46.0
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 127001:<222: Transcription Factor
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(261): Functional Homolog of  Ceres CLONE ID no. 31044 at SEQ ID NO. 1231 with e-value of 5.99E-59 and BLAST sequence identity of 58.9
MEKHINLEIDAQDNPLASSSTTTSTTKGNISSSSTPISCIKHQGSKKEENCIAPRVSRKAQELQSSGNEGGKRRKTTENEKNGKHPTYRGVRMRSWGKWVSEIREPRKKSRIWLGTYPTAEMAARAHDVAALAIKGGSAYLNFPEFAHELPPPLSKSPKDIQAAAAKAAAASFTETRYCEGEGGGEAELNVSNLSDSLAMDNTQESSSSPSTDSDDTLFDLPDLFIDGVHHSDGFCYYSSSWQLCAADTGFRLGEPFLLEY

SEQ ID NO: 1195 - protein, 251 aa, Arabidopsis thaliana
  misc_feature (1)..(251): Ceres CLONE ID no. 31507
  misc_feature (64)..(188): Pfam Name: Aconitase_C Pfam Description: Aconitase C-terminal domain
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
MAASLQSANPTLSRTLASPNKPSSFATFRSPFLRFNSTSVASNFKPLVSREASSSFVTRSAAEPQERKTFHGLCYVVGDNIDTDQIIPAEFLTLVPSNPEEYEKLGSYALVGLPASYKERFVQPGEMKTKYSIIIGGENFGCGSSREHAPVCLGAAGAKAVVAQSYARIFFRNSVATGEVYPLDSEVRVCDECTTGDVATVELREGDSILINHTTGKEYKLKPIGDAGPVIDAGGIFAYARKAGMIPSAAA

SEQ ID NO: 1196 - DNA, 768 bp, Populus balsamifera subsp. trichocarpa
  misc_feature (1)..(768): Ceres ANNOT ID no. 1447204
  misc_feature 127196:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
atggcagcctgccgctctaccaccacaatctccctctccagaaaccctagtttctccaccaccaatcccaaaccttccctctctttcctctctcctccttgtctcaaactcccttccattctcccctccttcaaacccctaacctcccacgccccacctgaccaacttctctccatcccacgcgccacggccgccgccacccccaccaccacccccaccacttccttccacggccattgctatgtcgtcggcgacaacatcgacaccgatcaaattatccccgccgaataccttacccttgtcccttccaagcaagaggaatacgaaaaactcggatcctacgctttaatcggacttccggcgacttacaaaacccgattcatcgaagcgaaccaaacgaaaacgaaatactcgatcgtgattgggggcgaaaattttgggtgcgggtcttcgcgtgaacacgcacctgtagcgcttggtgcagcgggggcagctgcggttgttgcggaatcgtatgcgaggattttctttaggaattcagttgcgacgggagagatatatccgcttgaatcggaagttaggatttgtgaagagtgtaagactggtgatttgattacgattgaacttgcggaaagtaagttgattaaccatacgagtggaaaggagtataagttgaagcctattggtgatgctggtcctgttatcgaagctggtggcattttcgcttatgccaggaagaccggaatgattccttcccaagcaccatga

SEQ ID NO: 1197 - protein, 255 aa, Populus balsamifera subsp. trichocarpa
  misc_feature (1)..(255): Ceres ANNOT ID no. 1447204
  misc_feature (139)..(194): Pfam Name: Aconitase_C Pfam Description: Aconitase C-terminal domain
  misc_feature: SWISSPROT Homolog: LEUD2_THEMA 3-isopropylmalate dehydratase small subunit 2 (EC 4.2.1.33) (Isopropylmalate isomerase 2) (Alpha-IPM isomerase 2) (IPMI 2) with e-value of 7.8e-28 and BLAST sequence identity of 42.4
  misc_feature: SWISSPROT Homolog: LEUD1_PYRAB 3-isopropylmalate dehydratase small subunit 1 (EC 4.2.1.33) (Isopropylmalate isomerase 1) (Alpha-IPM isomerase 1) (IPMI 1) with e-value of 1.7e-25 and BLAST sequence identity of 39.5
  misc_feature: SWISSPROT Homolog: LEUD_CLOAB 3-isopropylmalate dehydratase small subunit (EC 4.2.1.33) (Isopropylmalate isomerase) (Alpha-IPM isomerase) (IPMI) with e-value of 2.7e-25 and BLAST sequence identity of 46.7
  misc_feature: SWISSPROT Homolog: LEUD1_METKA 3-isopropylmalate dehydratase small subunit 1 (EC 4.2.1.33) (Isopropylmalate isomerase 1) (Alpha-IPM isomerase 1) (IPMI 1) with e-value of 3.5e-25 and BLAST sequence identity of 40.2
  misc_feature: SWISSPROT Homolog: LEUD1_PYRFU 3-isopropylmalate dehydratase small subunit 1 (EC 4.2.1.33) (Isopropylmalate isomerase 1) (Alpha-IPM isomerase 1) (IPMI 1) with e-value of 3.1e-24 and BLAST sequence identity of 38.4
  misc_feature 127321:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature (1)..(255): Functional Homolog of  Ceres CLONE ID no. 31507 at SEQ ID NO. 1236 with e-value of 2.29E-82 and BLAST sequence identity of 72.7
MAACRSTTTISLSRNPSFSTTNPKPSLSFLSPPCLKLPSILPSFKPLTSHAPPDQLLSIPRATAAATPTTTPTTSFHGHCYVVGDNIDTDQIIPAEYLTLVPSKQEEYEKLGSYALIGLPATYKTRFIEANQTKTKYSIVIGGENFGCGSSREHAPVALGAAGAAAVVAESYARIFFRNSVATGEIYPLESEVRICEECKTGDLITIELAESKLINHTSGKEYKLKPIGDAGPVIEAGGIFAYARKTGMIPSQAP

SEQ ID NO: 1198 - protein, 219 aa, Arabidopsis thaliana
  misc_feature (1)..(219): Ceres CLONE ID no. 31894
  misc_feature (1)..(219): Also Known As Ceres CDNA ID no. 23358176
  misc_feature (1)..(219): Also Known As Ceres GEMINI ID 535C8
  misc_feature 127444:<222: Transcription Factor
  misc_feature: Phenotype: Activates expression of the gene endogenous to the AtHMGS (SEQ ID NO 4144) regalutory region Useful for modulating Terpenoid Biosynthesis
MSERDRRERERDRDREPDRDRRRGRDDRDRDRDRDRERDRERDRDRGLRNKKSRSRTPDHHARARHVRSPERYRSRSRSIDRDRDRDRQRHHRRRSPSPDAPSRKRPRQGSVDDEKERNRKRVVTDSVDENAPTITKKKDKQPSDAADNGGGEDEEGMDVNEIEMMKMLGIPTGFDSTKGKPVAGADVSGIRAVTKRQPRQYMNRRGGFNRPLPAERNR

SEQ ID NO: 1199 - DNA, 588 bp, Populus balsamifera subsp. trichocarpa
  misc_feature (1)..(588): Ceres ANNOT ID no. 1478160
  misc_feature 127511:<222: Transcription Factor
  misc_feature: Phenotype: Activates expression of the gene endogenous to the AtHMGS (SEQ ID NO 4144) regalutory region Useful for modulating Terpenoid Biosynthesis
atgggagacagagacagactcaccgatcgcgaccgtgaaagagaccgcgaccgagaccgagaccgagaaagacgccgcgataaagaagaccgcgaccgggaccggacccgaatcacccgctctcgcacgcgctcaccagaccgcatgcgttcccgaaacaggcgctctcgttctcgctctccagaccggtctcatagatctcaccgccgccaccgccaccagaggactccatcctcgtcaccgccgcgaaagcgacatcgacccgagagcgatgacgatagagagagggaaaagcaaagagcggcggttttcgattttgtagacgggatagcgagagagcaattagagaagaacgaaagtgataataatgataatggaatgggagagggtgggggtttgatggatgaggatgagatggagatgatgaagaaattagggattccaacggggtttgattcgacgaaagggaagccggtgcctggtgcggatgttagtggagttaaagccgttacgaaacggcagcctaggcagtatatgaatcgtagaggagggtttaatcggcccttgcccctggagcggaatcgctga

SEQ ID NO: 1200 - protein, 195 aa, Populus balsamifera subsp. trichocarpa
  misc_feature (1)..(195): Ceres ANNOT ID no. 1478160
  misc_feature: SWISSPROT Homolog: SNUT3_XENTR U4/U6.U5 tri-snRNP-associated protein 3 with e-value of 4.7e-21 and BLAST sequence identity of 41.7
  misc_feature: SWISSPROT Homolog: SNUT3_XENLA U4/U6.U5 tri-snRNP-associated protein 3 with e-value of 2.0e-20 and BLAST sequence identity of 40.7
  misc_feature: SWISSPROT Homolog: SNUT3_HUMAN U4/U6.U5 tri-snRNP-associated protein 3 with e-value of 5.4e-20 and BLAST sequence identity of 42.3
  misc_feature: SWISSPROT Homolog: SNUT3_HUMAN U4/U6.U5 tri-snRNP-associated 27 kDa protein (27K) Nucleic acid-binding protein RY-1
  misc_feature: SWISSPROT Homolog: RBM25_HUMAN Probable RNA-binding protein 25 (RNA-binding motif protein 25) (RNA-binding region-containing protein 7) (Protein S164) with e-value of 6.4e-20 and BLAST sequence identity of 46.0
  misc_feature: SWISSPROT Homolog: SNUT3_MOUSE U4/U6.U5 tri-snRNP-associated protein 3 with e-value of 1.1e-19 and BLAST sequence identity of 41.8
  misc_feature 127600:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(195): Functional Homolog of  Ceres CLONE ID no. 31894 at SEQ ID NO. 1239 with e-value of 1.80E-52 and BLAST sequence identity of 66.4
MGDRDRLTDRDRERDRDRDRDRERRRDKEDRDRDRTRITRSRTRSPDRMRSRNRRSRSRSPDRSHRSHRRHRHQRTPSSSPPRKRHRPESDDDREREKQRAAVFDFVDGIAREQLEKNESDNNDNGMGEGGGLMDEDEMEMMKKLGIPTGFDSTKGKPVPGADVSGVKAVTKRQPRQYMNRRGGFNRPLPLERNR

SEQ ID NO: 1201 - protein, 329 aa, Arabidopsis thaliana
  misc_feature (1)..(329): Ceres CLONE ID no. 32082
  misc_feature (43)..(293): Pfam Name: peroxidase Pfam Description: Peroxidase
  misc_feature: Phenotype: WHOLE PLANT - Small Useful for modulating plant size
  misc_feature: Phenotype: INFLORESCENCE - Other Useful for making ornamental plants with modified flowers
MARFDIVLLIGLCLIISVFPDTTTAQLSRGFYSKTCPNVEQIVRNAVQKKIKKTFVAVPATLRLFFHDCFVNGCDASVMIQSTPKNKAEKDHPDNISLAGDGFDVVIQAKKALDSNPSCRNKVSCADILTLATRDVVVAAGGPSYEVELGRFDGLVSTASSVEGNLPGPSDNVDKLNALFTKNKLTQEDMIALSAAHTLGFAHCGKIFKRIHKFNGINSVDPTLNKAYAIELQKACPKNVDPRIAINMDPVTPKTFDNTYFKNLQQGKGLFTSDQVLFTDGRSRPTVNAWASNSTAFNRAFVIAMTKLGRVGVKNSSNGNIRRDCGAFN

SEQ ID NO: 1202 - DNA, 996 bp, Populus balsamifera subsp. trichocarpa
  misc_feature (1)..(996): Ceres ANNOT ID no. 1446894
  misc_feature 127770:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
atggcagctgcccggttccatctcttacttgttctttcactcactctcagtttgtgccacttccctgacaccacatgggcgcagcttaggcaaaattactacgctagcagttgccccagagtggaaagcatagttaggggtgtcgttcagaataaaattaaacaaacctttgttacgattccggcaactctcaggcttttcttccatgattgctttgttcagggctgtgatgcttcagttatagtggcctccactgcaaccaacaaggcggagaaggaccattctgataatttatcattagctggagatggatttgacactgtgatcaaagcgaaagcggctgttgatgccacccccggatgcaaaaacaaggtctcgtgtgctgatatccttgccatagcaacaagagatgttatcgcactgtctggtgggccttcatatcctgttgaattgggacgattggatggtttaagctcaacagctgctagtgtcaatgggaagctgcctcagccaactttctctttgaatcagcttactgctatgtttgctgccaacggactcagccaaactgacatgattgctctctcagcggcacacacgcttggattctctcattgtagcaaatttgccaacaggatatatagttttagcaggcaaggtccgatcgaccctacactcaaccgaacatatgcaaaaacactgcaaactctgtgccccaaaaacgttgactccagaatagccatcaacatggacccaaacactcccaacacctttgacaacatgtattacaagaacctcgtgcaaggaatgggcctcttcacctctgatcaagttctattcacagactcaaggtccaagccaactgttactaaatgggctactgactcacaggcctttcaacaagcctttatcactgccatgacaaagttgggccgcgtcggtgtcaagagcggtcgaaatgggaaaattcgtcaagactgcgcagttttggcttaa

SEQ ID NO: 1203 - protein, 331 aa, Populus balsamifera subsp. trichocarpa
  misc_feature (1)..(331): Ceres ANNOT ID no. 1446894
  misc_feature (45)..(295): Pfam Name: peroxidase Pfam Description: Peroxidase
  misc_feature: SWISSPROT Homolog: PER35_ARATH Peroxidase 35 precursor (EC 1.11.1.7) (Atperox P35) (ATP21a) with e-value of 1.2e-175 and BLAST sequence identity of 99.7
  misc_feature: SWISSPROT Homolog: PER73_ARATH Peroxidase 73 precursor (EC 1.11.1.7) (Atperox P73) (PRXR11) (ATP10a) with e-value of 1.5e-143 and BLAST sequence identity of 80.9
  misc_feature: SWISSPROT Homolog: PER50_ARATH Peroxidase 50 precursor (EC 1.11.1.7) (Atperox P50) (PRXR2) (ATP9a) with e-value of 7.7e-124 and BLAST sequence identity of 69.8
  misc_feature: SWISSPROT Homolog: PER51_ARATH Peroxidase 51 precursor (EC 1.11.1.7) (Atperox P51) (ATP37) with e-value of 1.6e-121 and BLAST sequence identity of 68.4
  misc_feature: SWISSPROT Homolog: PER45_ARATH Peroxidase 45 precursor (EC 1.11.1.7) (Atperox P45) (ATP8a) with e-value of 3.3e-107 and BLAST sequence identity of 62.2
  misc_feature 127882:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(331): Functional Homolog of  Ceres CLONE ID no. 32082 at SEQ ID NO. 1242 with e-value of 9.59E-116 and BLAST sequence identity of 65.7
MAAARFHLLLVLSLTLSLCHFPDTTWAQLRQNYYASSCPRVESIVRGVVQNKIKQTFVTIPATLRLFFHDCFVQGCDASVIVASTATNKAEKDHSDNLSLAGDGFDTVIKAKAAVDATPGCKNKVSCADILAIATRDVIALSGGPSYPVELGRLDGLSSTAASVNGKLPQPTFSLNQLTAMFAANGLSQTDMIALSAAHTLGFSHCSKFANRIYSFSRQGPIDPTLNRTYAKTLQTLCPKNVDSRIAINMDPNTPNTFDNMYYKNLVQGMGLFTSDQVLFTDSRSKPTVTKWATDSQAFQQAFITAMTKLGRVGVKSGRNGKIRQDCAVLA

SEQ ID NO: 1204 - DNA, 972 bp, Populus balsamifera subsp. trichocarpa
  misc_feature (1)..(972): Ceres ANNOT ID no. 1543513
  misc_feature 127985:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
atggagagaggttatatgcttctgctggtggttttgatcattgccataggaaggggagagggacaactagtggaaaacttctacagctctagctgtcctaacgtggaaggtatagtgaggcaggctgtttccacaaagttcaggcagacattcactacaatcccagcaactcttcgtctgttttttcatgactgctttgtgacgggttgtgatgcttccaccatggtttcttcaccaaatggagacgcagagaaggacgctccagacaatctttctctagcaggagatggattcgataccgtagtgaaggcaaaacaagcagtggaagcagcttgccccaaagtagtctcctgtgcagacattttagcattagctgctagggatgttgttgtcctggctggaggtccttcattcaacgtagaattaggacgtcgtgatggcatggtttctcaagcatcacttgtgaaaggaaatttaccagatcccgacttcactctttctcaacttaacgctatgtttgctaaaaacaaccttaaccagattgatatgattgcactatcaggagcccacacactaggcttctcccactgcaaccgctttgcgaagagactctactctttttcctcgtcctctccggttgacccttctctagacgcagagtatgcccagcagttgatgaatgcctgtcctagaaatgtagaccccagcatagccattgacatggaccctgtaacctcacgaacctttgacaatgtgtatttccaaaatctggtttctggtaaaggattgttcacttcagatgaagtgctgtttagcgatccagcttctcagccaactgtcaatgattttgctaagaactcgggcgattttaatggagcttttgcgactgctatgagaaagcttggaagggttggagttaagacaggtagccaaggaacgatcaggacagactgtacagtcattaattcttga

SEQ ID NO: 1205 - protein, 323 aa, Populus balsamifera subsp. trichocarpa
  misc_feature (1)..(323): Ceres ANNOT ID no. 1543513
  misc_feature (39)..(286): Pfam Name: peroxidase Pfam Description: Peroxidase
  misc_feature: SWISSPROT Homolog: PER35_ARATH Peroxidase 35 precursor (EC 1.11.1.7) (Atperox P35) (ATP21a) with e-value of 1.2e-175 and BLAST sequence identity of 99.7
  misc_feature: SWISSPROT Homolog: PER73_ARATH Peroxidase 73 precursor (EC 1.11.1.7) (Atperox P73) (PRXR11) (ATP10a) with e-value of 1.5e-143 and BLAST sequence identity of 80.9
  misc_feature: SWISSPROT Homolog: PER50_ARATH Peroxidase 50 precursor (EC 1.11.1.7) (Atperox P50) (PRXR2) (ATP9a) with e-value of 7.7e-124 and BLAST sequence identity of 69.8
  misc_feature: SWISSPROT Homolog: PER51_ARATH Peroxidase 51 precursor (EC 1.11.1.7) (Atperox P51) (ATP37) with e-value of 1.6e-121 and BLAST sequence identity of 68.4
  misc_feature: SWISSPROT Homolog: PER45_ARATH Peroxidase 45 precursor (EC 1.11.1.7) (Atperox P45) (ATP8a) with e-value of 3.3e-107 and BLAST sequence identity of 62.2
  misc_feature 128097:<222: Transcription Factor
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(323): Functional Homolog of  Ceres CLONE ID no. 32082 at SEQ ID NO. 1242 with e-value of 2.20E-100 and BLAST sequence identity of 61.5
MERGYMLLLVVLIIAIGRGEGQLVENFYSSSCPNVEGIVRQAVSTKFRQTFTTIPATLRLFFHDCFVTGCDASTMVSSPNGDAEKDAPDNLSLAGDGFDTVVKAKQAVEAACPKVVSCADILALAARDVVVLAGGPSFNVELGRRDGMVSQASLVKGNLPDPDFTLSQLNAMFAKNNLNQIDMIALSGAHTLGFSHCNRFAKRLYSFSSSSPVDPSLDAEYAQQLMNACPRNVDPSIAIDMDPVTSRTFDNVYFQNLVSGKGLFTSDEVLFSDPASQPTVNDFAKNSGDFNGAFATAMRKLGRVGVKTGSQGTIRTDCTVINS

SEQ ID NO: 1206 - protein, 345 aa, Arabidopsis thaliana
  misc_feature (1)..(345): Ceres CLONE ID no. 32152
  misc_feature (36)..(245): Pfam Name: Thaumatin Pfam Description: Thaumatin family
  misc_feature: Phenotype: WHOLE PLANT - Late Senescence Useful for delaying senescence
  misc_feature: Phenotype: INFLORESCENCE - Tall Useful for making taller plants and plants with longer inflorescences
MMNLSSRRASSTLTLSFTVLLLASTGSYGSTFTFANRCGYTVWPGILSNAGSPTLSTTGFELPKGTSRSLQAPTGWSGRFWARTGCKFDSSGSGTCKTGDCGSNSVECAGLGAAPPVTLAEFTLGTGGDDFYDVSLVDGYNIPMIVEVAGGSGQCASTGCTTDLNIQCPAELRFGDGDACKSACLAFRSPEYCCSGAYATPSSCRPSVYSEMFKAACPRSYSYAYDDATSTFTCAGGDYTVTFCPSSPSQKSTSYSPPVTDSSSTSQGSDPVPGSDTGYAGQGQQTPGQGNVYGSQGTGSEMGTGETMLQDGSWMAGLAMGEASRPAGVSLTVLLAAFTFPFIFS

SEQ ID NO: 1207 - DNA, 1029 bp, Populus balsamifera subsp. trichocarpa
  misc_feature (1)..(1029): Ceres ANNOT ID no. 1450535
  misc_feature 128301:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
atgggttacttctcttgctgcttccccactcttatttccagctttgttcttcttcttcttgtgagttataaaggttgtgtattagctgctacgttcacatttgtaaacaaatgtgagcacacagtttggcctggaattcttgccaatgcgggcagtcctagacttgacagcaccggatttgagcttcaacaagactcttctcgttcttttatagccccaactggctggtctggtcgtttttgggctcgaactgggtgtaatttcgacgaatccggagccgggttatgctcaacaggtgactgcgggtcgggtcaagttgaatgtaacggatttggagctgctccacctgctacattagcagagttcacactcgggtcgggtgggcaggatttttacgatgttagtcttgtagatgggtacaatttgcccatggttgtggaaggtagtggggggtcgggcatgtgcgcttcaacgggctgtatatcggatcttaacatacagtgtccacaagaactgagggttggtgaaggcgacgcgtgtaagagcgcgtgtgaagcttttgggagcccggagtactgttgcagtggcgcgttcaatacacccgccacttgtaaaccttctgtttattcagagatgttcaaggctgcttgtcctaaatcttacagttatgcttatgatgatgcaactagcacttttacttgtagcggtgctgattatacagtgaccttttgcccttcatctccaagtcagaaatcttcaagctactcaacgccaacgacagaaggaacaacaacatcacaggggtctggcacaggatccgggctggaatacacgggctctggttcaggcagtgattctggggctggatccgggactggatccggaggagaaaccatgctagcagatgggtcatggttagctggtttggccatgggagactcgtataagacagcttctccttctgctctacaatcagcaataatggcttttacgactcttgtccttatttttgcccttcttcactcgtag

SEQ ID NO: 1208 - protein, 342 aa, Populus balsamifera subsp. trichocarpa
  misc_feature (1)..(342): Ceres ANNOT ID no. 1450535
  misc_feature (36)..(245): Pfam Name: Thaumatin Pfam Description: Thaumatin family
  misc_feature: SWISSPROT Homolog: TLP1_PYRPY Thaumatin-like protein 1 precursor with e-value of 7.4e-71 and BLAST sequence identity of 55.4
  misc_feature: SWISSPROT Homolog: PR5_ARATH Pathogenesis-related protein 5 precursor (PR-5) with e-value of 1.2e-68 and BLAST sequence identity of 54.8
  misc_feature: SWISSPROT Homolog: TLP1_PRUPE Thaumatin-like protein 1 precursor (PpAZ44) with e-value of 2.0e-68 and BLAST sequence identity of 53.5
  misc_feature: SWISSPROT Homolog: TP1A_MALDO Thaumatin-like protein 1a precursor (Allergen Mal d 2) (Mdtl1) (Pathogenesis-related protein 5a) (PR-5a) with e-value of 2.3e-67 and BLAST sequence identity of 52.3
  misc_feature: SWISSPROT Homolog: TLPH_ARATH Thaumatin-like protein precursor with e-value of 7.9e-67 and BLAST sequence identity of 55.0
  misc_feature 128413:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(342): Functional Homolog of  Ceres CLONE ID no. 32152 at SEQ ID NO. 1247 with e-value of 1.29E-120 and BLAST sequence identity of 71.7
MGYFSCCFPTLISSFVLLLLVSYKGCVLAATFTFVNKCEHTVWPGILANAGSPRLDSTGFELQQDSSRSFIAPTGWSGRFWARTGCNFDESGAGLCSTGDCGSGQVECNGFGAAPPATLAEFTLGSGGQDFYDVSLVDGYNLPMVVEGSGGSGMCASTGCISDLNIQCPQELRVGEGDACKSACEAFGSPEYCCSGAFNTPATCKPSVYSEMFKAACPKSYSYAYDDATSTFTCSGADYTVTFCPSSPSQKSSSYSTPTTEGTTTSQGSGTGSGLEYTGSGSGSDSGAGSGTGSGGETMLADGSWLAGLAMGDSYKTASPSALQSAIMAFTTLVLIFALLHS

SEQ ID NO: 1209 - DNA, 1032 bp, Populus balsamifera subsp. trichocarpa
  misc_feature (1)..(1032): Ceres ANNOT ID no. 1513913
  misc_feature 128519:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggatcacttctcttgctgcttctccagcctcatttccaccctcgttcttctttttctcgtgagttataaaggtggcgtcctagctgctactttcacatttgtaaacaaatgtgagtacacagtttggcctggaattcttgccaatgctggcagtcctagacttgacagcactggatttgaactcctaaaagactcctctcgttcttttatagccccaacaggctggtctggtcgtttctgggctcgaaccggctgtaattttgacgagtccggaactgggtcatgctcaactggtgactgcggatcaggtcaagttgaatgtaacggacttggagcttctccacctgcaacattagcagagttcacactcgggtcgggtgggcaagacttttatgatgttagtcttgtagatgggtacaatttaccaatggttgtagagggtagtggtgggtcgggtatgtgtgcttcaacgggttgtgtttcggatcttaatagacagtgtccccaagaactgagaagtggtgaaggtgatgcgtgtaagagcgcgtgtgaagcttttgggagccctgagtactgttgtagtggcgcgtttaatacgcctgccacttgtaaaccttctgtttattcagagatgtttaaggctgcttgccctaaatcttacagttacgcttatgatgatgctactagcacttttacttgtagtggcgctgattatacagtgaccttttgcccctcctctccaagtcagaaatcttcaagctactcaacaccaacgacggaaggaacaacaacatcacaggggtctggtacaggatccgggctggagtacgcgggcactggttcaggtactgaatctggggcgggatctggaactggatctggaggagaaaccatgctagcagacgggtcatggttagctggtttagccatgggagactcatataaaactgcttctccttctgctctacaatcaacagtaatggcttttaccacatctctagtccttattgtttcctttgttttcttgtag

SEQ ID NO: 1210 - protein, 343 aa, Populus balsamifera subsp. trichocarpa
  misc_feature (1)..(343): Ceres ANNOT ID no. 1513913
  misc_feature (36)..(245): Pfam Name: Thaumatin Pfam Description: Thaumatin family
  misc_feature: SWISSPROT Homolog: TLP1_PYRPY Thaumatin-like protein 1 precursor with e-value of 7.4e-71 and BLAST sequence identity of 55.4
  misc_feature: SWISSPROT Homolog: PR5_ARATH Pathogenesis-related protein 5 precursor (PR-5) with e-value of 1.2e-68 and BLAST sequence identity of 54.8
  misc_feature: SWISSPROT Homolog: TLP1_PRUPE Thaumatin-like protein 1 precursor (PpAZ44) with e-value of 2.0e-68 and BLAST sequence identity of 53.5
  misc_feature: SWISSPROT Homolog: TP1A_MALDO Thaumatin-like protein 1a precursor (Allergen Mal d 2) (Mdtl1) (Pathogenesis-related protein 5a) (PR-5a) with e-value of 2.3e-67 and BLAST sequence identity of 52.3
  misc_feature: SWISSPROT Homolog: TLPH_ARATH Thaumatin-like protein precursor with e-value of 7.9e-67 and BLAST sequence identity of 55.0
  misc_feature 128631:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(343): Functional Homolog of  Ceres CLONE ID no. 32152 at SEQ ID NO. 1247 with e-value of 2.10E-120 and BLAST sequence identity of 72.0
MDHFSCCFSSLISTLVLLFLVSYKGGVLAATFTFVNKCEYTVWPGILANAGSPRLDSTGFELLKDSSRSFIAPTGWSGRFWARTGCNFDESGTGSCSTGDCGSGQVECNGLGASPPATLAEFTLGSGGQDFYDVSLVDGYNLPMVVEGSGGSGMCASTGCVSDLNRQCPQELRSGEGDACKSACEAFGSPEYCCSGAFNTPATCKPSVYSEMFKAACPKSYSYAYDDATSTFTCSGADYTVTFCPSSPSQKSSSYSTPTTEGTTTSQGSGTGSGLEYAGTGSGTESGAGSGTGSGGETMLADGSWLAGLAMGDSYKTASPSALQSTVMAFTTSLVLIVSFVFL

SEQ ID NO: 1211 - DNA, 1083 bp, Populus balsamifera subsp. trichocarpa
  misc_feature (1)..(1083): Ceres ANNOT ID no. 1460651
  misc_feature 128737:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggatcacttctcttgctgcttctccagcctcatttccaccctcgttcttctttttctcgtgagttataaaggtggcgtcctagctgctactttcacatttgtaaacaaatgtgagtacacagtttggcctggaattcttgccaatgctggcagtcctagacttgacagcactggatttgaactcctaaaagactcctctcgttcttttatagccccaacaggctggtctggtcgtttctgggctcgaaccggctgtaattttgacgagtccggaactgggtcatgctcaactggtgactgcggatcaggtcaagttgaatgtaacggacttggagcttctccacctgcaacattagcagagttcacactcgggtcgggtgggcaagacttttatgatgttagtcttgtagatgggtacaatttaccaatggttgtagagggtagtggtgggtcgggtatgtgtgcttcaacgggttgtgtttcggatcttaatagacagtgtccccaagaactgagaagtggtgaaggtgatgcgtgtaagagcgcgtgtgaagcttttgggagccctgagtactgttgtagtggcgcgtttaatacgcctgccacttgtaaaccttctgtttattcagagatgtttaaggctgcttgccctaaatcttacagttacgcttatgatgatgctactagcacttttacttgtagtggcgctgattatacagtgaccttttgcccctcctctccaagcagtcagaaatcttcaagctactcaacaccaacgacggaaggaacaacaacatcacaggggtctggtacaggatccgggctggagtacgcgggcactggttcaggtactgaatctggggcgggatctggaactggatctggaggagaaaccatgctagcagacgggtcatgcactaggacctttctctctgtttcatggctcctgctcttgaatgaaaattctttacagatttgcagccttgatgggtgcttggattttgcctttgtcaggaaggctgacagattctcttatccagattgtaaaccacccacttccaagattatcttctacttttaa

SEQ ID NO: 1212 - protein, 360 aa, Populus balsamifera subsp. trichocarpa
  misc_feature (1)..(360): Ceres ANNOT ID no. 1460651
  misc_feature (36)..(245): Pfam Name: Thaumatin Pfam Description: Thaumatin family
  misc_feature: SWISSPROT Homolog: TLP1_PYRPY Thaumatin-like protein 1 precursor with e-value of 7.4e-71 and BLAST sequence identity of 55.4
  misc_feature: SWISSPROT Homolog: PR5_ARATH Pathogenesis-related protein 5 precursor (PR-5) with e-value of 1.2e-68 and BLAST sequence identity of 54.8
  misc_feature: SWISSPROT Homolog: TLP1_PRUPE Thaumatin-like protein 1 precursor (PpAZ44) with e-value of 2.0e-68 and BLAST sequence identity of 53.5
  misc_feature: SWISSPROT Homolog: TP1A_MALDO Thaumatin-like protein 1a precursor (Allergen Mal d 2) (Mdtl1) (Pathogenesis-related protein 5a) (PR-5a) with e-value of 2.3e-67 and BLAST sequence identity of 52.3
  misc_feature: SWISSPROT Homolog: TLPH_ARATH Thaumatin-like protein precursor with e-value of 7.9e-67 and BLAST sequence identity of 55.0
  misc_feature 128851:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(360): Functional Homolog of  Ceres CLONE ID no. 32152 at SEQ ID NO. 1247 with e-value of 1.60E-113 and BLAST sequence identity of 73.9
MDHFSCCFSSLISTLVLLFLVSYKGGVLAATFTFVNKCEYTVWPGILANAGSPRLDSTGFELLKDSSRSFIAPTGWSGRFWARTGCNFDESGTGSCSTGDCGSGQVECNGLGASPPATLAEFTLGSGGQDFYDVSLVDGYNLPMVVEGSGGSGMCASTGCVSDLNRQCPQELRSGEGDACKSACEAFGSPEYCCSGAFNTPATCKPSVYSEMFKAACPKSYSYAYDDATSTFTCSGADYTVTFCPSSPSSQKSSSYSTPTTEGTTTSQGSGTGSGLEYAGTGSGTESGAGSGTGSGGETMLADGSCTRTFLSVSWLLLLNENSLQICSLDGCLDFAFVRKADRFSYPDCKPPTSKIIFYF

SEQ ID NO: 1213 - DNA, 945 bp, Populus balsamifera subsp. trichocarpa
  misc_feature (1)..(945): Ceres ANNOT ID no. 1442535
  misc_feature 128960:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggatcgcatcttcaccagttctgctcttcacatcactctcattttgctcacaatctgcaaagggctatcaggggctacatttacattcataaacagatgtggctacacagtgtggcctggcattctatccaatgcaggcagcactccattggaaagcacaggatttgaacttccacaaggtggatcacgatccttccaggcacctccaaattggtcaggtcggttctggggcagaacgggttgcacatttgacccaaataccggtcagggtacctgcctaacaggtgattgcagctcaaaccaaattgaatgcaatggtaaaaatgcaaacccaccagccactctagcagaattcacagtcggatcaggtgtactggatttttacgatgttagtttagttgacggatacaatctacccatgatcgtcgaaccgaatggcgggtcaggtagttgcttgtcgaccgggtgtgtaacagatatgaaccagcaatgcccaactgaattacgggccgattcagggcaggcctgtaagagtgcatgtgaagcctttgggagtccagagtactgttgcagcggcgcgtatggatcaccggacacatgtaagccgtcggtttattcagagatgtttaaggccgcgtgtccgagatcatatagctatgcttatgatgatgccactagcacatttacatgtacaggagcagattatgttatcacattctgcccttcattaacaagtcaaaaatctgcaagaggcaattctccaccagcaagcacaacaaatgggtctgagacagtatcgggcgatgggccagtaggaatggacacttcatggctgccaaactttctcagtggggactcgccaaatgccctatcttgttctgtttggcaatttaccttgattctttctacaatttcctgtcttctcctctctttggttcattaa

SEQ ID NO: 1214 - protein, 314 aa, Populus balsamifera subsp. trichocarpa
  misc_feature (1)..(314): Ceres ANNOT ID no. 1442535
  misc_feature (32)..(242): Pfam Name: Thaumatin Pfam Description: Thaumatin family
  misc_feature: SWISSPROT Homolog: TLP1_PYRPY Thaumatin-like protein 1 precursor with e-value of 7.4e-71 and BLAST sequence identity of 55.4
  misc_feature: SWISSPROT Homolog: PR5_ARATH Pathogenesis-related protein 5 precursor (PR-5) with e-value of 1.2e-68 and BLAST sequence identity of 54.8
  misc_feature: SWISSPROT Homolog: TLP1_PRUPE Thaumatin-like protein 1 precursor (PpAZ44) with e-value of 2.0e-68 and BLAST sequence identity of 53.5
  misc_feature: SWISSPROT Homolog: TP1A_MALDO Thaumatin-like protein 1a precursor (Allergen Mal d 2) (Mdtl1) (Pathogenesis-related protein 5a) (PR-5a) with e-value of 2.3e-67 and BLAST sequence identity of 52.3
  misc_feature: SWISSPROT Homolog: TLPH_ARATH Thaumatin-like protein precursor with e-value of 7.9e-67 and BLAST sequence identity of 55.0
  misc_feature 129068:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(314): Functional Homolog of  Ceres CLONE ID no. 32152 at SEQ ID NO. 1247 with e-value of 3.59E-100 and BLAST sequence identity of 69.7
MDRIFTSSALHITLILLTICKGLSGATFTFINRCGYTVWPGILSNAGSTPLESTGFELPQGGSRSFQAPPNWSGRFWGRTGCTFDPNTGQGTCLTGDCSSNQIECNGKNANPPATLAEFTVGSGVLDFYDVSLVDGYNLPMIVEPNGGSGSCLSTGCVTDMNQQCPTELRADSGQACKSACEAFGSPEYCCSGAYGSPDTCKPSVYSEMFKAACPRSYSYAYDDATSTFTCTGADYVITFCPSLTSQKSARGNSPPASTTNGSETVSGDGPVGMDTSWLPNFLSGDSPNALSCSVWQFTLILSTISCLLLSLVH

SEQ ID NO: 1215 - DNA, 963 bp, Populus balsamifera subsp. trichocarpa
  misc_feature (1)..(963): Ceres ANNOT ID no. 1452888
  misc_feature 129168:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggatcacgtcttctccagttctgctctacacatcactctcattttgcttacaatctgcaaaggaatatcaggggctaaatttacaatcataaacagatgtgactacacagtatggccaggtattctttccaatgcaggcagcactccattagacagcacaggatttgaacttccacaaggtgaatcacgatcctttcaagcaccaccaaattggtcaggtcgattctggggcagaactggttgcacatttgacccgaataccggtcagggcacctgcataacaggtgactgcagctccaaccaaattgaatgcaatggcaaaaatgcaaaccctccagccactctagccgaattcactgtcggatcaggtgtaaaggatttttacgatgttagtttggttgacggctacaatttacccatgattgtcgaaccaaatggcgggtcagggagttgcttgtcgaccgggtgtatgacagatttgaaccagcaatgcccagctgaattacgggttgaatcagggcaggcctgtaagagtgcatgtgaggcctttgggagccctgagtactgttgcagcggcgcgtatggagcaccagacacatgtaagccatctgcttattcggagatgtttaagaccgcatgtccgagatcatatagctatgcttacgatgatgccactagcacatttacatgtacaggagcagattatgttatcacattctgcccttcatcaacaagtcaaaaatctgcaagagacacgactccaccagcaagcactgcaaatggggctgaaacaggatcaggatcaggggatgggccaattggaattgacacttcatggttgccgaactttctcactggggactcacccacctcaacttcggacaaatgcacatgcagcttaagtggtcactcagaattcgttttgcattggaaggaaaggctgaacaaatccagattgtaa

SEQ ID NO: 1216 - protein, 320 aa, Populus balsamifera subsp. trichocarpa
  misc_feature (1)..(320): Ceres ANNOT ID no. 1452888
  misc_feature (32)..(242): Pfam Name: Thaumatin Pfam Description: Thaumatin family
  misc_feature: SWISSPROT Homolog: TLP1_PYRPY Thaumatin-like protein 1 precursor with e-value of 7.4e-71 and BLAST sequence identity of 55.4
  misc_feature: SWISSPROT Homolog: PR5_ARATH Pathogenesis-related protein 5 precursor (PR-5) with e-value of 1.2e-68 and BLAST sequence identity of 54.8
  misc_feature: SWISSPROT Homolog: TLP1_PRUPE Thaumatin-like protein 1 precursor (PpAZ44) with e-value of 2.0e-68 and BLAST sequence identity of 53.5
  misc_feature: SWISSPROT Homolog: TP1A_MALDO Thaumatin-like protein 1a precursor (Allergen Mal d 2) (Mdtl1) (Pathogenesis-related protein 5a) (PR-5a) with e-value of 2.3e-67 and BLAST sequence identity of 52.3
  misc_feature: SWISSPROT Homolog: TLPH_ARATH Thaumatin-like protein precursor with e-value of 7.9e-67 and BLAST sequence identity of 55.0
  misc_feature 129278:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(320): Functional Homolog of  Ceres CLONE ID no. 32152 at SEQ ID NO. 1247 with e-value of 2.10E-97 and BLAST sequence identity of 67.4
MDHVFSSSALHITLILLTICKGISGAKFTIINRCDYTVWPGILSNAGSTPLDSTGFELPQGESRSFQAPPNWSGRFWGRTGCTFDPNTGQGTCITGDCSSNQIECNGKNANPPATLAEFTVGSGVKDFYDVSLVDGYNLPMIVEPNGGSGSCLSTGCMTDLNQQCPAELRVESGQACKSACEAFGSPEYCCSGAYGAPDTCKPSAYSEMFKTACPRSYSYAYDDATSTFTCTGADYVITFCPSSTSQKSARDTTPPASTANGAETGSGSGDGPIGIDTSWLPNFLTGDSPTSTSDKCTCSLSGHSEFVLHWKERLNKSRL

SEQ ID NO: 1217 - DNA, 978 bp, Populus balsamifera subsp. trichocarpa
  misc_feature (1)..(978): Ceres ANNOT ID no. 1487705
  misc_feature 129381:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggatttactctcattctcacaaaatcacccccattattgtgctgctttcctaagcctgctcttcatttttgaaggtgtttcaggcgctaaattcacatttgttaacaaatgtgatttctcagtctggccaggaatcctaggcagtccagaactagatagcactggctttgagcttaggaaaggtagttctcgctccttccaagccccaacaggctggtctggtcgcttctggggccgaacaggctgcaatttcgactcctcaggccatggttcctgtgttactgcagactgtggctctggccaagtggagtgcaatggtgcaggagccacaccgcctgccactttagctgaattcactctgggctcaggctcccaggatttttatgatgttagtcttgttgatggatacaatttgccaatgattgtagaagtgagtgggggttcaggggagtgcgcgtcgacagggtgtgtcacggaccttaataggaagtgcccgacggagctgagaactgagggcggcagtgcttgtaggagcgcctgtgaggcatttgggaagcctgagtactgctgcagcggcgagtacaactcaccggcatcttgcaagccttccatgtattctcaagtgttcaagagtgcctgtccgaagtcgtatagctacgcatacgatgatgcgactagcacttttacatgtacaggcgcagattacaccatcacattctgccccaatttccatagtctaaagtcttcaagtgatgcgtctccacaagcaatcgggggcgcagccattggtgggtcagggacagagataggagggacggtcaccggatcctcagcacaggaagctgaattacaaagttcatggctggcaagtttggccattggagagtcaacaggaacccaaacccaccattctttagttctccaatttgcattagttttggccacatctctcattcttgccaactctcacctgtag

SEQ ID NO: 1218 - protein, 325 aa, Populus balsamifera subsp. trichocarpa
  misc_feature (1)..(325): Ceres ANNOT ID no. 1487705
  misc_feature (36)..(242): Pfam Name: Thaumatin Pfam Description: Thaumatin family
  misc_feature: SWISSPROT Homolog: TLP1_PYRPY Thaumatin-like protein 1 precursor with e-value of 7.4e-71 and BLAST sequence identity of 55.4
  misc_feature: SWISSPROT Homolog: PR5_ARATH Pathogenesis-related protein 5 precursor (PR-5) with e-value of 1.2e-68 and BLAST sequence identity of 54.8
  misc_feature: SWISSPROT Homolog: TLP1_PRUPE Thaumatin-like protein 1 precursor (PpAZ44) with e-value of 2.0e-68 and BLAST sequence identity of 53.5
  misc_feature: SWISSPROT Homolog: TP1A_MALDO Thaumatin-like protein 1a precursor (Allergen Mal d 2) (Mdtl1) (Pathogenesis-related protein 5a) (PR-5a) with e-value of 2.3e-67 and BLAST sequence identity of 52.3
  misc_feature: SWISSPROT Homolog: TLPH_ARATH Thaumatin-like protein precursor with e-value of 7.9e-67 and BLAST sequence identity of 55.0
  misc_feature 129491:<222: Transcription Factor
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(325): Functional Homolog of  Ceres CLONE ID no. 32152 at SEQ ID NO. 1247 with e-value of 3.89E-96 and BLAST sequence identity of 62.6
MDLLSFSQNHPHYCAAFLSLLFIFEGVSGAKFTFVNKCDFSVWPGILGSPELDSTGFELRKGSSRSFQAPTGWSGRFWGRTGCNFDSSGHGSCVTADCGSGQVECNGAGATPPATLAEFTLGSGSQDFYDVSLVDGYNLPMIVEVSGGSGECASTGCVTDLNRKCPTELRTEGGSACRSACEAFGKPEYCCSGEYNSPASCKPSMYSQVFKSACPKSYSYAYDDATSTFTCTGADYTITFCPNFHSLKSSSDASPQAIGGAAIGGSGTEIGGTVTGSSAQEAELQSSWLASLAIGESTGTQTHHSLVLQFALVLATSLILANSHL

SEQ ID NO: 1219 - protein, 505 aa, Arabidopsis thaliana
  misc_feature (1)..(505): Ceres CLONE ID no. 32348
  misc_feature (34)..(499): Pfam Name: p450 Pfam Description: Cytochrome P450
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 1220 - DNA, 1518 bp, Populus balsamifera subsp. trichocarpa
  misc_feature (1)..(1518): Ceres ANNOT ID no. 1470719
  misc_feature 129767:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggatctcctcctcctggagaagaccctcttgggttctttcgttgccattctcgttgccattctcgtttctaaactacgtggcaaacgttttaaactccctccaggtcctatacctgtccccgtgtttggaaactggcttcaagttggtgatgatttgaaccaccgtaacctcaccgacttagccaagaaattcggtgacatcttcctccttcgtatgggccaacgtaaccttgttgtcgtctcttctcctgacctatccaaagaggttctgcacacacaaggtgttgagttcgggtcgagaacaagaaatgttgtttttgatatctttactggaaagggacaagacatggtgttcactgtctacggtgaacattggaggaagatgaggagaatcatgactgtccctttctttacaaacaaggttgtccaacaatataggtatggctgggaggaggaagccgctcaagttgtcgaggatgttaagaaaaaccctgaggctgcaaccaatgggattgttttgaggaggagattgcaactcatgatgtataataatatgtacaggattatgtttgataggagatttgagagcgaagacgatcctttgtttaacaagctcaaggctttgaatggtgagaggagcagattggctcagagttttgattataattatggtgatttcatccccattttgagacctttcttgagaggttacttgaagatctgccaggaggttaaggagagaaggttgcaactcttcaaggactactttgtcgatgagaggaagaaacttgcaagcacaaagaacatgaacaatgaagggttgaagtgcgccatagaccatatcctcgatgctcaaaagaaaggagagatcaacgaggacaacgttctttacattgttgagaacatcaacgtcgctgcaattgagacaacactatggtcgatcgagtggggaattgctgagcttgtgaaccatcctgaaatccagaagaagttgcgccatgagctcgataccttgcttggacctggtcaccaaatcaccgagcctgacacctacaagctcccttaccttaatgctgtaatcaaagagaccctccgacttaggatggcaattcctctacttgtcccacacatgaaccttcatgatgccaagcttggaggcttcgacattccagctgagagcaagatcttggtcaatgcctggtggctcgccaacaaccctgcccactggaaaaaccctgaagaattcaggccagagaggttcttggaagaggaggccaaggttgaggccaatggcaatgatttcaggtaccttccatttggagttgggagaaggagctgtcctggaattattcttgcattgccaattcttggcattactctgggacgtctggtacagaatttcgagctcttgcctcctcccggacagtcaaagatcgacaccgcagagaaaggtggacagttcagtttgcacatattgaagcactccactattgttgcaaagccaaggtccttttaa

SEQ ID NO: 1221 - protein, 505 aa, Populus balsamifera subsp. trichocarpa
  misc_feature (1)..(505): Ceres ANNOT ID no. 1470719
  misc_feature (34)..(499): Pfam Name: p450 Pfam Description: Cytochrome P450
  misc_feature: SWISSPROT Homolog: TCMO_ARATH Trans-cinnamate 4-monooxygenase with e-value of 8.7e-274 and BLAST sequence identity of 100.0
  misc_feature: SWISSPROT Homolog: TCMO_ARATH EC 1.14.13.11 (Cinnamic acid 4-hydroxylase) CA4H (C4H) (P450C4H) (Cytochrome P450 73)
  misc_feature: SWISSPROT Homolog: TCMO_CATRO Trans-cinnamate 4-monooxygenase with e-value of 3.8e-241 and BLAST sequence identity of 86.1
  misc_feature: SWISSPROT Homolog: TCMO_CATRO EC 1.14.13.11 Cinnamic acid 4-hydroxylase CA4H (C4H) (P450C4H) (Cytochrome P450 73)
  misc_feature: SWISSPROT Homolog: TCMO_CATRO Trans-cinnamate 4-monooxygenase with e-value of 2.7e-240 and BLAST sequence identity of 85.9
  misc_feature: SWISSPROT Homolog: TCMO_CATRO EC 1.14.13.11 Cinnamic acid 4-hydroxylase CA4H (C4H) (P450C4H) (Cytochrome P450 73)
  misc_feature: SWISSPROT Homolog: TCMO_CATRO Trans-cinnamate 4-monooxygenase with e-value of 7.1e-240 and BLAST sequence identity of 85.1
  misc_feature: SWISSPROT Homolog: TCMO_CATRO EC 1.14.13.11 Cinnamic acid 4-hydroxylase CA4H (C4H) (P450C4H) (Cytochrome P450 73)
  misc_feature 129967:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(505): Functional Homolog of  Ceres CLONE ID no. 32348 at SEQ ID NO. 1260 with e-value of 8.69E-241 and BLAST sequence identity of 85.7
MDLLLLEKTLLGSFVAILVAILVSKLRGKRFKLPPGPIPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMNNEGLKCAIDHILDAQKKGEINEDNVLYIVENINVAAIETTLWSIEWGIAELVNHPEIQKKLRHELDTLLGPGHQITEPDTYKLPYLNAVIKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTAEKGGQFSLHILKHSTIVAKPRSF

SEQ ID NO: 1222 - DNA, 1518 bp, Populus balsamifera subsp. trichocarpa
  misc_feature (1)..(1518): Ceres ANNOT ID no. 1543728
  misc_feature 130145:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggatctcctcctcttggagaagaccctgttgggttcttttgttgccattcttgttgccattcttgtttcacaactacgtggcaaacgttttaaactcccacctggtcctttaccggtccccgtgtttggcaactggcttcaagttggtgatgatctgaaccaccgtaacctcactgatttggccaagaagtttggtgacatcctcctcctccgtatgggccaacgtaatcttgttgtcgtctcctcacctgacctagctaaagaggttctgcacacgcaaggtgttgaattcgggtcaagaacaagaaacgttgtttttgatattttcactgggaaaggtcaagacatggttttcactgtctatggtgaacattggaggaagatgaggagaatcatgacagtccctttcttcacgaacaaggttgttcaacaatataggtatggatgggaagaggaagcggctcaagttgtcgaggatgttaagaaaaaccccgaggctgcaactcatgggattgttttgaggaggagactgcaactgatgatgtataacaacatgtataggatcatgtttgataggagatttgagagcgaagaggatcctttgtttaataagcttaaggctttgaatggtgagaggagcagattggctcagagttttgattacaattacggtgattttatccccattttgagacctttcttgagaggttacttgaagatctgcaaggaggttaaagagagaaggctgcaactcttcaaggactactttgttgaagagaggaagaaacttggaagcacaaagagcatgagcaatgaaggcttgaaatgtgcaattgatcatattttggatgctcaaaagaaaggagagatcaatgaggacaacgttctttacatcgtggagaacatcaatgttgctgcaattgagacaacactgtggtcgattgagtggggaattgctgagcttgtgaaccatcctgaaatccagaagaagttgcgtgatgagctcgataccgtgcttggaccgggtcaccaaatcactgagcctgacaccaacaagctgccttaccttaatgctgtcatcaaagagactctccggctcaggatggcgattcctctgcttgtcccacacatgaacctccatgatgctaagcttggaggttttgacatccccgccgagagcaagatcctggtaaacgcatggtggcttgccaacaaccctgctaagtggaaaaaccctgaagaattcaggccagagaggttcttcgaagaggaggccaaggttgaggccaatggcaatgatttcaggtacctcccctttggagttgggagaaggagctgccctggaattattcttgcattaccaattcttggtattactctgggacgtttggtacagaattttgagctcttgcctcctcctggacagtccaagattgacacctcagagaaaggtggacagttcagcttgcacattttgaaacactccaccattgttgcaaagccaaggtccttttag

SEQ ID NO: 1223 - protein, 505 aa, Populus balsamifera subsp. trichocarpa
  misc_feature (1)..(505): Ceres ANNOT ID no. 1543728
  misc_feature (34)..(499): Pfam Name: p450 Pfam Description: Cytochrome P450
  misc_feature: SWISSPROT Homolog: TCMO_ARATH Trans-cinnamate 4-monooxygenase with e-value of 8.7e-274 and BLAST sequence identity of 100.0
  misc_feature: SWISSPROT Homolog: TCMO_ARATH EC 1.14.13.11 (Cinnamic acid 4-hydroxylase) CA4H (C4H) (P450C4H) (Cytochrome P450 73)
  misc_feature: SWISSPROT Homolog: TCMO_CATRO Trans-cinnamate 4-monooxygenase with e-value of 3.8e-241 and BLAST sequence identity of 86.1
  misc_feature: SWISSPROT Homolog: TCMO_CATRO EC 1.14.13.11 Cinnamic acid 4-hydroxylase CA4H (C4H) (P450C4H) (Cytochrome P450 73)
  misc_feature: SWISSPROT Homolog: TCMO_CATRO Trans-cinnamate 4-monooxygenase with e-value of 2.7e-240 and BLAST sequence identity of 85.9
  misc_feature: SWISSPROT Homolog: TCMO_CATRO EC 1.14.13.11 Cinnamic acid 4-hydroxylase CA4H (C4H) (P450C4H) (Cytochrome P450 73)
  misc_feature: SWISSPROT Homolog: TCMO_PHAAU Trans-cinnamate 4-monooxygenase with e-value of 7.1e-240 and BLAST sequence identity of 85.1
  misc_feature: SWISSPROT Homolog: TCMO_PHAAU EC 1.14.13.11 Cinnamic acid 4-hydroxylase CA4H (C4H) (P450C4H) (Cytochrome P450 73)
  misc_feature: SWISSPROT Homolog: TCMO_GLYEC Trans-cinnamate 4-monooxygenase with e-value of 1.2e-239 and BLAST sequence identity of 85.1
  misc_feature: SWISSPROT Homolog: TCMO_GLYEC EC 1.14.13.11 Cinnamic acid 4-hydroxylase CA4H (C4H) (P450C4H) (Cytochrome P450 73)
  misc_feature 130358:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(505): Functional Homolog of  Ceres CLONE ID no. 32348 at SEQ ID NO. 1260 with e-value of 5.50E-239 and BLAST sequence identity of 84.9
MDLLLLEKTLLGSFVAILVAILVSQLRGKRFKLPPGPLPVPVFGNWLQVGDDLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRYGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTNKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 1224 - DNA, 1614 bp, Populus balsamifera subsp. trichocarpa
  misc_feature (1)..(1614): Ceres ANNOT ID no. 1482066
  misc_feature 130536:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcttcttttgttacaaaatcaatgggtttcactcttttagcagtagcatctgtttcatgcataaagtttgcatgccctaacctctccacatatttctcaccactacccatctctgtcatcctccctctacttccactaatcgtgtacttgtttagctccgtttttaccaagtcttcaactggcgacctacctcctggccctgtctcgtacccaatgtttggcaattggctccaagttggcaatgacctgaaccaccgtcttctagcttctatgtcacaaacatatggtcctgtgttcctacttaaacttggttcaaagaacttagctgttgtatccgaccctgaactagccaaccaggtcctgcacacacagggtgttgaattcgggtctcgcccacgtaacgttgtcttcgatatcttcaccggcaatggacaagacatggtgttcacgatctatggtgagcattggagaaaaatgcgtagaatcatgacactaccgtttttcaccaacaaagttgtgaaccaatatagtacttcatgggagcaggaaatggaccttgtggtcgatgaccttagagccaatgagaaagttaggaccgaagggattgttattagaaaacgtctgcagctgatgttgtacaatattatgtacaggatgatgtttgatgcaaaatttcagtcacaggaggaccctttgtttgttcaagcaacaaggtttaattccgagagaagtcggttggcacaaagtttcgagtataattatggagattttatcccttggcttagaccatttttaagggggtacttgaacaagtgcagggatttgcagcagaggaggctagctttcttcaacaactattatattgagaaaagaaggaaaataatggctgccaatggagagaagcacaaggtaagctgtgccatggatcacataatacaggctcaaatgaaaggagaaatcagtgaagaaaatgtactttacattgtggagaacattaatgttgctgctatagagacaacattgtggtctatggaatgggccatagctgaactggtcaatcatccgactgttcagaggaagatcagagatgaaatcagagccgtcctaaagggaagtccagttacagaatctaacctgcatgagctaccatacttgcaagccacaataaaagagacattaaggctacacaccccaattcccttgttagtgccacatatgaaccttgaagaagcaaagctaggagggtttaccattcctaaagagtcaaaggtggtcgtcaatgcatggtggctagctaacaaccctgaatggtgggagaaaccatcagaattccggccagagcgattcttggaagaagaacgtgacacagaggccatcgttggtggaaaggttgattttcggttcctaccatttggcgtgggtagacgttcctgcccagggatcatacttgcaatgccaatcctaggactgattgttgcaagactggtgtcgaattttgagatgatagctcctcctgggatggagaagattgatgtgagtgaaaaaggagggcagttcagcttgcacattgcaagccattccactgttgttttcaaaccaatcaaagcatga

SEQ ID NO: 1225 - protein, 537 aa, Populus balsamifera subsp. trichocarpa
  misc_feature (1)..(537): Ceres ANNOT ID no. 1482066
  misc_feature (65)..(531): Pfam Name: p450 Pfam Description: Cytochrome P450
  misc_feature: SWISSPROT Homolog: TCMO_ARATH Trans-cinnamate 4-monooxygenase with e-value of 8.7e-274 and BLAST sequence identity of 100.0
  misc_feature: SWISSPROT Homolog: TCMO_ARATH EC 1.14.13.11 (Cinnamic acid 4-hydroxylase) CA4H (C4H) (P450C4H) (Cytochrome P450 73)
  misc_feature: SWISSPROT Homolog: TCMO_CATRO Trans-cinnamate 4-monooxygenase with e-value of 3.8e-241 and BLAST sequence identity of 86.
  misc_feature: SWISSPROT Homolog: TCMO_CATRO EC 1.14.13.11 (Cinnamic acid 4-hydroxylase) CA4H (C4H) (P450C4H) (Cytochrome P450 73)
  misc_feature: SWISSPROT Homolog: TCMO_POPKI Trans-cinnamate 4-monooxygenase with e-value of 2.7e-240 and BLAST sequence identity of 85.9
  misc_feature: SWISSPROT Homolog: TCMO_POPKI EC 1.14.13.11 (Cinnamic acid 4-hydroxylase) CA4H (C4H) (P450C4H) (Cytochrome P450 73)
  misc_feature: SWISSPROT Homolog: TCMO_PHAAU Trans-cinnamate 4-monooxygenase with e-value of 7.1e-240 and BLAST sequence identity of 85.1
  misc_feature: SWISSPROT Homolog: TCMO_PHAAU EC 1.14.13.11 (Cinnamic acid 4-hydroxylase) CA4H (C4H) (P450C4H) (Cytochrome P450 73)
  misc_feature: SWISSPROT Homolog: TCMO_GLYEC Trans-cinnamate 4-monooxygenase with e-value of 1.2e-239 and BLAST sequence identity of 85.1
  misc_feature: SWISSPROT Homolog: TCMO_GLYEC EC 1.14.13.11 (Cinnamic acid 4-hydroxylase) CA4H (C4H) (P450C4H) (Cytochrome P450 73)
  misc_feature 130740:<222: Transcription Factor
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(537): Functional Homolog of  Ceres CLONE ID no. 32348 at SEQ ID NO. 1260 with e-value of 3.49E-173 and BLAST sequence identity of 65.8
MASFVTKSMGFTLLAVASVSCIKFACPNLSTYFSPLPISVILPLLPLIVYLFSSVFTKSSTGDLPPGPVSYPMFGNWLQVGNDLNHRLLASMSQTYGPVFLLKLGSKNLAVVSDPELANQVLHTQGVEFGSRPRNVVFDIFTGNGQDMVFTIYGEHWRKMRRIMTLPFFTNKVVNQYSTSWEQEMDLVVDDLRANEKVRTEGIVIRKRLQLMLYNIMYRMMFDAKFQSQEDPLFVQATRFNSERSRLAQSFEYNYGDFIPWLRPFLRGYLNKCRDLQQRRLAFFNNYYIEKRRKIMAANGEKHKVSCAMDHIIQAQMKGEISEENVLYIVENINVAAIETTLWSMEWAIAELVNHPTVQRKIRDEIRAVLKGSPVTESNLHELPYLQATIKETLRLHTPIPLLVPHMNLEEAKLGGFTIPKESKVVVNAWWLANNPEWWEKPSEFRPERFLEEERDTEAIVGGKVDFRFLPFGVGRRSCPGIILAMPILGLIVARLVSNFEMIAPPGMEKIDVSEKGGQFSLHIASHSTVVFKPIKA

SEQ ID NO: 1226 - protein, 454 aa, Arabidopsis thaliana
  misc_feature (1)..(454): Ceres CLONE ID no. 32361
  misc_feature (282)..(354): Pfam Name: GTP_EFTU_D2 Pfam Description: Elongation factor Tu domain 2
  misc_feature (359)..(453): Pfam Name: GTP_EFTU_D3 Pfam Description: Elongation factor Tu C-terminal domain
  misc_feature (65)..(261): Pfam Name: GTP_EFTU Pfam Description: Elongation factor Tu GTP binding domain
  misc_feature: Phenotype: WHOLE PLANT - Dark Green Useful for increasing chlorophyll and photosynthetic capacity
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Oval Shaped Useful for making plants with increased biomass and foliage
  misc_feature: Phenotype: ROSETTE LEAVES - Ovate Shaped Useful for making plants with increased biomass and foliage
MASVVLRNPSSKRLVPFSSQIYSRCGASVTSSYSISHSIGGDDLSSSTFGTSSFWRSMATFTRNKPHVNVGTIGHVDHGKTTLTAAITKVLAEEGKAKAIAFDEIDKAPEEKKRGITIATAHVEYETAKRHYAHVDCPGHADYVKNMITGAAQMDGGILVVSGPDGPMPQTKEHILLARQVGVPSLVCFLNKVDVVDDPELLELVEMELRELLSFYKFPGDDIPIIRGSALSALQGTNDEIGRQAILKLMDAVDEYIPDPVRVLDKPFLMPIEDVFSIQGRGTVATGRIEQGVIKVGEEVEILGLREGGVPLKSTVTGVEMFKKILDNGQAGDNVGLLLRGLKREDIQRGMVIAKPGSCKTYKKFEAEIYVLTKDEGGRHTAFFSNYRPQFYLRTADITGKVELPENVKMVMPGDNVTAVFELIMPVPLETGQRFALREGGRTVGAGVVSKVMT

SEQ ID NO: 1227 - DNA, 1353 bp, Populus balsamifera subsp. trichocarpa
  misc_feature (1)..(1353): Ceres ANNOT ID no. 1471776
  misc_feature 131093:<222: Transcription Factor
  misc_feature: Phenotype: WHOLE PLANT - Dark Green Useful for increasing chlorophyll and photosynthetic capacity
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Oval Shaped Useful for making plants with increased biomass and foliage
  misc_feature: Phenotype: ROSETTE LEAVES - Ovate Shaped Useful for making plants with increased biomass and foliage
atggcttcggtggttcttagaaaccctaattcgaagcgcctcttgccattctcctcacaaatccactgctgctgccgaggatcggcttccactcactcctcaatttccgaatctctttcttcttcaaatgacagaacctcgtcttctccttggtggagatccatggccaccttcacgagaaataaacctcatgtgaatgtgggaacaattggacatgttgatcacggcaagactactttgactgcagctattacaaaggtgttagcagaagaagggaaagccaaggccattgcttttgatgaaattgacaaggcccctgaagagaaaaagagaggaattactattgctacggcccatgtggagtatgaaactactaagcgtcactatgctcatgtggactgccctggacatgcagattatgttaaaaatatgattactggagctgctcaaatggatggtggaattctggttgtatctgctgctgatggacccatgccacaaactaaggaacatattttgcttgcccgccaggttggtgtaccatcacttgtatgcttcctgaataaagttgatgttgtatcagatccagagttaatagagcttgtggaaatggaagtgcgagaacttcttaatttctacaagtttcctggagatgaaatccctattgttcagggatcggcattgtctgctttacagggtacaaatgaggaaataggcaagaatgccattttaaaattaatggatgctgtggacgaatacattcctgaccctgtgcgtcaacttgacaagcctttcttgatgccaatagaagatgttttctcgattcagggacgtggaactgttgcgactggccgtgttgaacaagggaccatcaaagttggcgaagaagttgaaattttgggattatcaaaagatggtcccaagaaaaccactgtaactggtgttgagatgttcaagaaattgttggatcaaggacaggctggagacaatgtaggtcttcttcttcgtggcttgaaacgagaagatgtgcaacgtggacaggttattgccaagcctggaactgtgaagacatccaagaggtttgaggcagagatatactccctcacgaaggatgaaggaggtcgtcatactgcctttttctccaactacagacctcagttttacttgcgaactgcagatatcactggaaaagtagagttgccagaaaatgttaagatggtcatgcctggggacaacgtgaccgcagtctttgagctgatcttaccagttcctcttgaaacaggacaaaggtttgccttgagggaggggggtagaacggttggagcgggggtggtctcaaaagtgcttgattga

SEQ ID NO: 1228 - protein, 450 aa, Populus balsamifera subsp. trichocarpa
  misc_feature (1)..(450): Ceres ANNOT ID no. 1471776
  misc_feature (279)..(350): Pfam Name: GTP_EFTU_D2 Pfam Description: Elongation factor Tu domain 2
  misc_feature (355)..(449): Pfam Name: GTP_EFTU_D3 Pfam Description: Elongation factor Tu C-terminal domain
  misc_feature (65)..(191): Pfam Name: MMR_HSR1 Pfam Description: GTPase of unknown function
  misc_feature: SWISSPROT Homolog: EFTM_ARATH Elongation factor Tu, with e-value of 6.2e-241 and BLAST sequence identity of 100.0
  misc_feature: SWISSPROT Homolog: EFTU_RICHE Elongation factor Tu (EF-Tu) with e-value of 6.2e-154 and BLAST sequence identity of 71.6
  misc_feature: SWISSPROT Homolog: EFTU_RICRI Elongation factor Tu (EF-Tu) with e-value of 2.1e-153 and BLAST sequence identity of 71.3
  misc_feature: SWISSPROT Homolog: EFTU_RICSI Elongation factor Tu (EF-Tu) with e-value of 2.1e-153 and BLAST sequence identity of 71.3
  misc_feature: SWISSPROT Homolog: EFTU_RICCN Elongation factor Tu (EF-Tu) with e-value of 3.4e-153 and BLAST sequence identity of 71.3
  misc_feature 131263:<222: Transcription Factor
  misc_feature: Phenotype: WHOLE PLANT - Dark Green Useful for increasing chlorophyll and photosynthetic capacity
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Oval Shaped Useful for making plants with increased biomass and foliage
  misc_feature: Phenotype: ROSETTE LEAVES - Ovate Shaped Useful for making plants with increased biomass and foliage
  misc_feature (1)..(450): Functional Homolog of  Ceres CLONE ID no. 32361 at SEQ ID NO. 1267 with e-value of 4.79E-208 and BLAST sequence identity of 89.0
MASVVLRNPNSKRLLPFSSQIHCCCRGSASTHSSISESLSSSNDRTSSSPWWRSMATFTRNKPHVNVGTIGHVDHGKTTLTAAITKVLAEEGKAKAIAFDEIDKAPEEKKRGITIATAHVEYETTKRHYAHVDCPGHADYVKNMITGAAQMDGGILVVSAADGPMPQTKEHILLARQVGVPSLVCFLNKVDVVSDPELIELVEMEVRELLNFYKFPGDEIPIVQGSALSALQGTNEEIGKNAILKLMDAVDEYIPDPVRQLDKPFLMPIEDVFSIQGRGTVATGRVEQGTIKVGEEVEILGLSKDGPKKTTVTGVEMFKKLLDQGQAGDNVGLLLRGLKREDVQRGQVIAKPGTVKTSKRFEAEIYSLTKDEGGRHTAFFSNYRPQFYLRTADITGKVELPENVKMVMPGDNVTAVFELILPVPLETGQRFALREGGRTVGAGVVSKVLD

SEQ ID NO: 1229 - DNA, 1344 bp, Populus balsamifera subsp. trichocarpa
  misc_feature (1)..(1344): Ceres ANNOT ID no. 1445033
  misc_feature 131425:<222: Transcription Factor
  misc_feature: Phenotype: WHOLE PLANT - Dark Green Useful for increasing chlorophyll and photosynthetic capacity
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Oval Shaped Useful for making plants with increased biomass and foliage
  misc_feature: Phenotype: ROSETTE LEAVES - Ovate Shaped Useful for making plants with increased biomass and foliage
atggcttctttggcccttagaaaccctaattcgaagcgacttttaccattctcctcacaattctactgctgctgccgaggatcgccatcctcccttaccgaatctcttctctcgtcaaatgacagaacctcttcttctccatggtggagatccatggccaccttcaccagaactaaacctcatgtgaatgtgggaacaattggacatgttgatcatggcaagactaccttgactgctgctattacaaaggtgctagcagaagaagggaaagccaaggccattgcttttgatgaaattgacaaggcccccgaagagaaaaagagaggaattacgattgcaacggcccacgtggagtatgaaactgctaagcgtcactatgcccatgtggactgccctgggcatgcagattatgttaaaaatatgattactggagctgctcaaatggatggcggaattctggttgtatctgctgctgatgggcccatgccacaaacaaaggaacatattttgcttgctcgccaggttggtgtaccatcactcgtgtgctttctgaataaagttgatgttgtatcagatccagagttaatagagcttgtggaaatggaagtccgagaactacttagtttctacaagtttcctggagatgaaatccctattgttcgaggatcggcactgtctgcattacagggtacaaatgaggaaataggcaagaaagccattttaaagttgatggatgctgtggatgaatacattcctgaccctgtgcgtcaactcgaaaagcctttcttgatgccaatagaagatgttttctcaattcagggacgtggaacggttgcgactggacgtgttgaacaagggaccatcaaagttggtgaagaagttgaaattttgggactatcaaaagaaggtcctaagagaactacagtgactggtgttgagatgttcaagaaattgttggatcaaggacaggctggagacaatgtgggtcttctccttcgtggtttgaaacgagaagatgtgcaacgtgggcaggttattgccaagcctggaactgtgaaaacttacaagagatttgaggcagaaatatactccctcacgaaggatgaaggagggcgtcatactgcgtttttctccaactacagacctcagttttacttgcgaactgcagatatcactggaaaagtagagttgccagaaaatgttaagatggtcatgcccggggacaacgtgaccgcaatctttgagctaatcttaccagttcctcttgaaaaaggacaaaggtttgccttgagggaaggaggtagaacagttggagcaggggtagtctcaaaagtgcttcagtga

SEQ ID NO: 1230 - protein, 447 aa, Populus balsamifera subsp. trichocarpa
  misc_feature (1)..(447): Ceres ANNOT ID no. 1445033
  misc_feature (276)..(347): Pfam Name: GTP_EFTU_D2 Pfam Description: Elongation factor Tu domain 2
  misc_feature (352)..(446): Pfam Name: GTP_EFTU_D3 Pfam Description: Elongation factor Tu C-terminal domain
  misc_feature (62)..(188): Pfam Name: MMR_HSR1 Pfam Description: GTPase of unknown function
  misc_feature: SWISSPROT Homolog: EFTM_ARATH Elongation factor Tu, with e-value of 6.2e-241 and BLAST sequence identity of 100.0
  misc_feature: SWISSPROT Homolog: EFTU_RICHE Elongation factor Tu (EF-Tu) with e-value of 6.2e-154 and BLAST sequence identity of 71.6
  misc_feature: SWISSPROT Homolog: EFTU_RICRI Elongation factor Tu (EF-Tu) with e-value of 2.1e-153 and BLAST sequence identity of 71.3
  misc_feature: SWISSPROT Homolog: EFTU_RICSI Elongation factor Tu (EF-Tu) with e-value of 2.1e-153 and BLAST sequence identity of 71.3
  misc_feature: SWISSPROT Homolog: EFTU_RICCN Elongation factor Tu (EF-Tu) with e-value of 3.4e-153 and BLAST sequence identity of 71.3
  misc_feature 131595:<222: Transcription Factor
  misc_feature: Phenotype: WHOLE PLANT - Dark Green Useful for increasing chlorophyll and photosynthetic capacity
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: CAULINE LEAVES - Oval Shaped Useful for making plants with increased biomass and foliage
  misc_feature: Phenotype: ROSETTE LEAVES - Ovate Shaped Useful for making plants with increased biomass and foliage
  misc_feature (1)..(447): Functional Homolog of  Ceres CLONE ID no. 32361 at SEQ ID NO. 1267 with e-value of 2.20E-205 and BLAST sequence identity of 87.6
MASLALRNPNSKRLLPFSSQFYCCCRGSPSSLTESLLSSNDRTSSSPWWRSMATFTRTKPHVNVGTIGHVDHGKTTLTAAITKVLAEEGKAKAIAFDEIDKAPEEKKRGITIATAHVEYETAKRHYAHVDCPGHADYVKNMITGAAQMDGGILVVSAADGPMPQTKEHILLARQVGVPSLVCFLNKVDVVSDPELIELVEMEVRELLSFYKFPGDEIPIVRGSALSALQGTNEEIGKKAILKLMDAVDEYIPDPVRQLEKPFLMPIEDVFSIQGRGTVATGRVEQGTIKVGEEVEILGLSKEGPKRTTVTGVEMFKKLLDQGQAGDNVGLLLRGLKREDVQRGQVIAKPGTVKTYKRFEAEIYSLTKDEGGRHTAFFSNYRPQFYLRTADITGKVELPENVKMVMPGDNVTAIFELILPVPLEKGQRFALREGGRTVGAGVVSKVLQ

SEQ ID NO: 1231 - protein, 169 aa, Arabidopsis thaliana
  misc_feature (1)..(169): Ceres CLONE ID no. 32548
  misc_feature (8)..(79): Pfam Name: RRM_1 Pfam Description: RNA recognition motif. (a.k.a. RRM RBD, or RNP domain)
  misc_feature: Phenotype: ROSETTE LEAVES - Corkscrew Useful for making plants with altered leaf shape eg curled leaves
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 1232 - DNA, 498 bp, Populus balsamifera subsp. trichocarpa
  misc_feature (1)..(498): Ceres ANNOT ID no. 1450324
  misc_feature 131886:<222: Transcription Factor
  misc_feature: Phenotype: ROSETTE LEAVES - Corkscrew Useful for making plants with altered leaf shape eg curled leaves
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggctgctgaggttgagtacaggtgctttgttggtggcctcgcatgggccactactgaccaatcccttcaagaagcgtttagccagtacggtgaaatcatcgattcgaagattataaacgatcgtgaaactggaagatctcgcggctttggatttgttaccttcaacaacgagaaggcaatgagagatgcgattgatggaatgaacggccaagaccttgatgggcgtaacatcaccgtgaatgaagcacaatcccgcggaagcggcggtggtggcggaggtgggggctacagccgtggaggcggtggcggttacggaggtcgccgtgaaggtggcggaggcggttatagccgtggtggaggtggatacggcggtggtggaggtggatacggcggcggcggtggtggttatggtggtggacgtgaccgtgggtacggtgatggtggatcaaggtattcttccaggggcggatctgatggtggtagctggagggactag

SEQ ID NO: 1233 - protein, 165 aa, Populus balsamifera subsp. trichocarpa
  misc_feature (1)..(165): Ceres ANNOT ID no. 1450324
  misc_feature (9)..(80): Pfam Name: RRM_1 Pfam Description: RNA recognition motif. (a.k.a. RRM RBD, or RNP domain)
  misc_feature: SWISSPROT Homolog: GRP8_ARATH Glycine-rich RNA-binding protein 8 (CCR1 protein) with e-value of 1.2e-93 and BLAST sequence identity of 100.0
  misc_feature: SWISSPROT Homolog: GRP7_ARATH Glycine-rich RNA-binding protein 7 with e-value of 1.1e-69 and BLAST sequence identity of 77.0
  misc_feature: SWISSPROT Homolog: GRP10_BRANA Glycine-rich RNA-binding protein 10 with e-value of 1.8e-69 and BLAST sequence identity of 79.9
  misc_feature: SWISSPROT Homolog: GRP2_SINAL Glycine-rich RNA-binding protein GRP2A with e-value of 2.9e-69 and BLAST sequence identity of 77.6
  misc_feature: SWISSPROT Homolog: GRP1_SINAL Glycine-rich RNA-binding protein GRP1A with e-value of 3.3e-68 and BLAST sequence identity of 79.2
  misc_feature 132042:<222: Transcription Factor
  misc_feature: Phenotype: ROSETTE LEAVES - Corkscrew Useful for making plants with altered leaf shape eg curled leaves
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(165): Functional Homolog of  Ceres CLONE ID no. 32548 at SEQ ID NO. 1272 with e-value of 6.90E-58 and BLAST sequence identity of 77.4
MAAEVEYRCFVGGLAWATTDQSLQEAFSQYGEIIDSKIINDRETGRSRGFGFVTFNNEKAMRDAIDGMNGQDLDGRNITVNEAQSRGSGGGGGGGGYSRGGGGGYGGRREGGGGGYSRGGGGYGGGGGGYGGGGGGYGGGRDRGYGDGGSRYSSRGGSDGGSWRD

SEQ ID NO: 1234 - DNA, 513 bp, Populus balsamifera subsp. trichocarpa
  misc_feature (1)..(513): Ceres ANNOT ID no. 1460836
  misc_feature 132178:<222: Transcription Factor
  misc_feature: Phenotype: ROSETTE LEAVES - Corkscrew Useful for making plants with altered leaf shape eg curled leaves
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtctgccgaggttgagtacaggtgctttgttggcggcctcgcttgggccaccactgaccaagtcctccaagaggcttttagccagtacggtgaaatcatcgattcgaagattataaatgaccgtgaaaccggaagatctcgtggttttggatttgtgaccttcggcaatgagaaggcaatgagagatgctattgatggaatgaacggtcaggacctcgatggccgtaacatcaccgtgaacgaagctcaatcccgcggaagtggtggaggtggtggtggcggcggtggttacaaccgcaacagcggtggtggcggttatggaggaggtggacgccgtgaaggcggcggtggttacagccgtggcggaggcggctacggaggcggtggaagcggatatggtagtggtggcggcggcggtggttatggcggtggccgtgaccgtggttatggtgacggtggatctaggtactcttcaaggggtgaatccgaaggtggtagctggaggagttag

SEQ ID NO: 1235 - protein, 170 aa, Populus balsamifera subsp. trichocarpa
  misc_feature (1)..(170): Ceres ANNOT ID no. 1460836
  misc_feature (9)..(80): Pfam Name: RRM_1 Pfam Description: RNA recognition motif. (a.k.a. RRM RBD, or RNP domain)
  misc_feature: SWISSPROT Homolog: GRP8_ARATH Glycine-rich RNA-binding protein 8 (CCR1 protein) with e-value of 1.2e-93 and BLAST sequence identity of 100.0
  misc_feature: SWISSPROT Homolog: GRP7_ARATH Glycine-rich RNA-binding protein 7 with e-value of 1.1e-69 and BLAST sequence identity of 77.0
  misc_feature: SWISSPROT Homolog: GRP10_BRANA Glycine-rich RNA-binding protein 10 with e-value of 1.8e-69 and BLAST sequence identity of 79.9
  misc_feature: SWISSPROT Homolog: GRP2_SINAL Glycine-rich RNA-binding protein GRP2A with e-value of 2.9e-69 and BLAST sequence identity of 77.6
  misc_feature: SWISSPROT Homolog: GRP1_SINAL Glycine-rich RNA-binding protein GRP1A with e-value of 3.3e-68 and BLAST sequence identity of 79.2
  misc_feature 132334:<222: Transcription Factor
  misc_feature: Phenotype: ROSETTE LEAVES - Corkscrew Useful for making plants with altered leaf shape eg curled leaves
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(170): Functional Homolog of  Ceres CLONE ID no. 32548 at SEQ ID NO. 1272 with e-value of 3.80E-57 and BLAST sequence identity of 76.25
MSAEVEYRCFVGGLAWATTDQVLQEAFSQYGEIIDSKIINDRETGRSRGFGFVTFGNEKAMRDAIDGMNGQDLDGRNITVNEAQSRGSGGGGGGGGGYNRNSGGGGYGGGGRREGGGGYSRGGGGYGGGGSGYGSGGGGGGYGGGRDRGYGDGGSRYSSRGESEGGSWRS

SEQ ID NO: 1236 - protein, 73 aa, Arabidopsis thaliana
  misc_feature (1)..(73): Ceres CLONE ID no. 32612
  misc_feature (4)..(73): Pfam Name: S1FA Pfam Description: DNA binding protein S1FA
  misc_feature: Phenotype: WHOLE PLANT - Small Useful for modulating plant size
MAAEFDGKIESKGLNPGLIVLLVIGGLLLTFLVGNFILYTYAQKNLPPRKKKPVSKKKMKKEKMKQGVQVPGE

SEQ ID NO: 1237 - DNA, 342 bp, Populus balsamifera subsp. trichocarpa
  misc_feature (1)..(342): Ceres ANNOT ID no. 1484890
  misc_feature 132513:<222: Transcription Factor
  misc_feature: Phenotype: WHOLE PLANT - Small Useful for modulating plant size
atggaagacgatttcgagttctctaattctcctccttccttccaaaacatgctaaatggatatattgatatatgggtatttgagcattcttatgccctctgcaagatgtgggttgcaccagaacagggggatttgatcaaggatgctgagcctaaagggttaaacccaggattgatagtgctgctggttattggcgggttacttttgacattcctagttggaaattatgtactttactcatacgcgcagaagacccttcctccgagaaagaagaaacccatctcgaagaagaagatgaagaaggagagactgaagcaaggtgtctcagcaccaggagagtga

SEQ ID NO: 1238 - protein, 78 aa, Populus balsamifera subsp. trichocarpa
  misc_feature (1)..(78): Ceres ANNOT ID no. 1484890
  misc_feature (9)..(78): Pfam Name: S1FA Pfam Description: DNA binding protein S1FA
  misc_feature: SWISSPROT Homolog: S1FA3_ARATH DNA-binding protein S1FA3 with e-value of 3.4e-34 and BLAST sequence identity of 100.0
  misc_feature: SWISSPROT Homolog: S1FA_SPIOL DNA-binding protein S1FA with e-value of 7.0e-27 and BLAST sequence identity of 84.8
  misc_feature: SWISSPROT Homolog: S1FA2_ARATH DNA-binding protein S1FA2 with e-value of 3.5e-25 and BLAST sequence identity of 78.5
  misc_feature: SWISSPROT Homolog: S1FA1_ARATH DNA-binding protein S1FA1 with e-value of 5.7e-25 and BLAST sequence identity of 75.0
  misc_feature: SWISSPROT Homolog: S1FA2_ORYSA DNA-binding protein S1FA2 with e-value of 1.8e-21 and BLAST sequence identity of 73.0
  misc_feature 132591:<222: Transcription Factor
  misc_feature: Phenotype: WHOLE PLANT - Small Useful for modulating plant size
  misc_feature (1)..(78): Functional Homolog of  Ceres CLONE ID no. 32612 at SEQ ID NO. 1277 with e-value of 8.89E-26 and BLAST sequence identity of 84.3
MWVAPEQGDLIKDAEPKGLNPGLIVLLVIGGLLLTFLVGNYVLYSYAQKTLPPRKKKPISKKKMKKERLKQGVSAPGE

SEQ ID NO: 1239 - protein, 161 aa, Arabidopsis thaliana
  misc_feature (1)..(161): Ceres CLONE ID no. 32615
  misc_feature (30)..(84): Pfam Name: Homeobox Pfam Description: Homeobox domain
  misc_feature (85)..(129): Pfam Name: HALZ Pfam Description: Homeobox associated leucine zipper
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
MEEGDFFNCCFSEISSGMTMNKKKMKKSNNQKRFSEEQIKSLELIFESETRLEPRKKVQVARELGLQPRQVAIWFQNKRARWKTKQLEKEYNTLRANYNNLASQFEIMKKEKQSLVSELQRLNEEMQRPKEEKHHECCGDQGLALSSSTESHNGRVSQKGG

SEQ ID NO: 1240 - DNA, 717 bp, Populus balsamifera subsp. trichocarpa
  misc_feature (1)..(717): Ceres ANNOT ID no. 1471372
  misc_feature 132748:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atgtttgatggaggagaatattctccttcagcaacagagccttttagctgcttgaacagtgtcacaacctccagaaagaagaagaacaagattaaaaggaggtttagcgatgagcagattaaatcattggaaactatgttcgaatcggaaacaaggcttgagcctcgaaagaagatgcagttggcaagagagcttgggttgcaaccacgacaggttgcgatatggtttcagaataagagagctagatggaagtctaagcaactcgaaagagactacagcatgctacgagctaattacaacagcttggcttcccggtttgagactctgaagaaagagaagcaagcgttggcgatacagttgcagaagctaaatgatctgatgaagaagccggtagaggaaggagagtgttgtggccaaggagctgctgtgaacagcagtgagggcgaatcggagaatggagacgcaaccaagggtgaatcagaaacgaaacctagattgtcaattgaacaaccagagcatggattaggagtcctttcagatgaagatagcagcataaaggtagattattttgaattagaagaagaaccgaacctaatgagtatggtggaaccggctgaaggatcattgacatcacaagaagattgggggagtatagactccgatggcctcttcgatcaatcaagcagtggatatcagtggtgggatttctgggcttga

SEQ ID NO: 1241 - protein, 238 aa, Populus balsamifera subsp. trichocarpa
  misc_feature (1)..(238): Ceres ANNOT ID no. 1471372
  misc_feature (29)..(85): Pfam Name: Homeobox Pfam Description: Homeobox domain
  misc_feature (86)..(130): Pfam Name: HALZ Pfam Description: Homeobox associated leucine zipper
  misc_feature: SWISSPROT Homolog: ATHB7_ARATH Homeobox-leucine zipper protein ATHB-7 (Homeodomain transcription factor ATHB-7) (HD-ZIP protein ATHB-7) with e-value of 5.7e-48 and BLAST sequence identity of 66.0
  misc_feature: SWISSPROT Homolog: ATHB6_ARATH Homeobox-leucine zipper protein ATHB-6 (Homeodomain transcription factor ATHB-6) (HD-ZIP protein ATHB-6) with e-value of 6.3e-26 and BLAST sequence identity of 47.7
  misc_feature: SWISSPROT Homolog: HAT5_ARATH Homeobox-leucine zipper protein HAT5 (HD-ZIP protein 5) (HD-ZIP protein ATHB-1) with e-value of 3.1e-24 and BLAST sequence identity of 48.1
  misc_feature: SWISSPROT Homolog: ATHB5_ARATH Homeobox-leucine zipper protein ATHB-5 (HD-ZIP protein ATHB-5) with e-value of 2.8e-23 and BLAST sequence identity of 46.5
  misc_feature: SWISSPROT Homolog: HAT7_ARATH Homeobox-leucine zipper protein HAT7 (HD-ZIP protein 7) (HD-ZIP protein ATHB-3) with e-value of 5.3e-22 and BLAST sequence identity of 43.8
  misc_feature 132891:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(238): Functional Homolog of  Ceres CLONE ID no. 32615 at SEQ ID NO. 1280 with e-value of 2.00E-44 and BLAST sequence identity of 69.2
MFDGGEYSPSATEPFSCLNSVTTSRKKKNKIKRRFSDEQIKSLETMFESETRLEPRKKMQLARELGLQPRQVAIWFQNKRARWKSKQLERDYSMLRANYNSLASRFETLKKEKQALAIQLQKLNDLMKKPVEEGECCGQGAAVNSSEGESENGDATKGESETKPRLSIEQPEHGLGVLSDEDSSIKVDYFELEEEPNLMSMVEPAEGSLTSQEDWGSIDSDGLFDQSSSGYQWWDFWA

SEQ ID NO: 1242 - protein, 379 aa, Arabidopsis thaliana
  misc_feature (1)..(379): Ceres CLONE ID no. 32737
  misc_feature (108)..(379): Pfam Name: Tub Pfam Description: Tub family
  misc_feature (44)..(97): Pfam Name: F-box Pfam Description: F-box domain
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MPLSRSLLSRRISNSFRFHQGETTTAPESESIPPPSNMAGSSSWSAMLPELLGEIIRRVEETEDRWPQRRDVVTCACVSKKWREITHDFARSSLNSGKITFPSCLKLPGPRDFSNQCLIKRNKKTSTFYLYLALTPSFTDKGKFLLAARRFRTGAYTEYIISLDADDFSQGSNAYVGKLRSDFLGTNFTVYDSQPPHNGAKPSNGKASRRFASKQISPQVPAGNFEVGHVSYKFNLLKSRGPRRMVSTLRCPSPSPSSSSAGLSSDQKPCDVTKIMKKPNKDGSSLTILKNKAPRWHEHLQCWCLNFHGRVTVASVKNFQLVATVDQSQPSGKGDEETVLLQFGKVGDDTFTMDYRQPLSAFQAFAICLTSFGTKLACE

SEQ ID NO: 1243 - DNA, 1134 bp, Populus balsamifera subsp. trichocarpa
  misc_feature (1)..(1134): Ceres ANNOT ID no. 1536373
  misc_feature 133152:<222: Transcription Factor
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcgctgagaagatcgtttttatcgcgaaggttctcaagatcgttcaataaccagaacagaaacgaacgaaatggagtggaatcggggcgactcgttggtgagtcggggggtgagtcggatgggtgggggagtatgttgcctgagttattaggagaaataataaaacgagttgaagagagtgaggatcggtggccacagagacaaaacgtcgtcgcatgtgcttgtgtttgtaagaaatggagagaagttaccaaagacatcgtcaagtctcttcctaacaacaacaacaataatggaagttctggaaaaatcactttcccttcttgccttaaacagccgggtccacgcgacttgccccatcaatgtcttataaaacggaataagaagacttcaacattttacctatatcttgctcttactccatcatttacggataaggggaagtttctcctggcagcacggaggtataggcaaggtgttcacacagagtatatcatctcgcttgatgctgatgacttatcccaaggaagtaatgcttatgttggaaagttaagttcagacttcctcggtaccaactttacaatatatgacagccagccaccacacagtggtgctaagccctcaagtagcagagctagccggcgatttgcaagcaagcaaataagccctcaagtcccggcgggcaattttgaggttgggcaggtctcgtataaatttaacctcttgaagtcaagaggtccaaggaggatggtttgctcacttaagtgcccggtgtcacaagaaactaccaatgtcaaaaatgttgacaactcgaagatgacgcaactggagtctgcttcttctggttttacagttttgcggaacaaagccccaaggtggcatgagcatttgcagtgttggtgcttgaatttccatggtcgggtaacagtagcatcggtgaagaactttcaactggttgcaattatggaccaaagccagccaggagggaaaggagacgaggagactgtcctcctccagtttgggaaggtaggcgatgatactttcaccatggattataggcagccactttcagcttttcaagcatttgccttgtgcctgactagttttggcacgaaactggcatgtgagtaa

SEQ ID NO: 1244 - protein, 377 aa, Populus balsamifera subsp. trichocarpa
  misc_feature (1)..(377): Ceres ANNOT ID no. 1536373
  misc_feature (286)..(377): Pfam Name: Tub Pfam Description: Tub family
  misc_feature (43)..(96): Pfam Name: F-box Pfam Description: F-box domain
  misc_feature: SWISSPROT Homolog: TULP2_MOUSE Tubby-related protein 2 (Tubby-like protein 2) (P4-6 protein) (Fragment) with e-value of 1.1e-39 and BLAST sequence identity of 44.5
  misc_feature: SWISSPROT Homolog: TULP3_MOUSE Tubby-related protein 3 (Tubby-like protein 3) with e-value of 3.8e-36 and BLAST sequence identity of 41.6
  misc_feature: SWISSPROT Homolog: TULP1_HUMAN Tubby-related protein 1 (Tubby-like protein 1) with e-value of 6.9e-36 and BLAST sequence identity of 42.2
  misc_feature: SWISSPROT Homolog: TULP3_HUMAN Tubby-related protein 3 (Tubby-like protein 3) with e-value of 9.6e-36 and BLAST sequence identity of 40.9
  misc_feature: SWISSPROT Homolog: TULP1_MOUSE Tubby-related protein 1 (Tubby-like protein 1) with e-value of 1.8e-35 and BLAST sequence identity of 42.9
  misc_feature 133302:<222: Transcription Factor
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(377): Functional Homolog of  Ceres CLONE ID no. 32737 at SEQ ID NO. 1283 with e-value of 1.79E-146 and BLAST sequence identity of 76.2
MSLRRSFLSRRFSRSFNNQNRNERNGVESGRLVGESGGESDGWGSMLPELLGEIIKRVEESEDRWPQRQNVVACACVCKKWREVTKDIVKSLPNNNNNNGSSGKITFPSCLKQPGPRDLPHQCLIKRNKKTSTFYLYLALTPSFTDKGKFLLAARRYRQGVHTEYIISLDADDLSQGSNAYVGKLSSDFLGTNFTIYDSQPPHSGAKPSSSRASRRFASKQISPQVPAGNFEVGQVSYKFNLLKSRGPRRMVCSLKCPVSQETTNVKNVDNSKMTQLESASSGFTVLRNKAPRWHEHLQCWCLNFHGRVTVASVKNFQLVAIMDQSQPGGKGDEETVLLQFGKVGDDTFTMDYRQPLSAFQAFALCLTSFGTKLACE

SEQ ID NO: 1245 - DNA, 1227 bp, Populus balsamifera subsp. trichocarpa
  misc_feature (1)..(1227): Ceres ANNOT ID no. 1482905
  misc_feature 133442:<222: Transcription Factor
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcgctgagaagatcgtttttatcgcgaaggttctcaagatcgttcaataaccagaacagaaacgaacgaaatggagtggaatcggggcgactcgttggtgagtcggggggtgagtcggatgggtgggggagtatgttgcctgagttattaggagaaataataaaacgagttgaagagagtgaggatcggtggccacagagacaaaacgtcgtcgcatgtgcttgtgtttgtaagaaatggagagaagttaccaaagacatcgtcaagtctcttcctaacaacaacaacaataatggaagttctggaaaaatcactttcccttcttgccttaaacagccgggtccacgcgacttgccccatcaatgtcttataaaacggaataagaagacttcaacattttacctatatcttgctcttactccatcatttacggataaggggaagtttctcctggcagcacggaggtataggcaaggtgttcacacagagtatatcatctcgcttgatgctgatgacttatcccaaggaagtaatgcttatgttggaaagttaagttcagacttcctcggtaccaactttacaatatatgacagccagccaccacacagtggtgctaagccctcaagtagcagagctagccggcgatttgcaagcaagcaaataagccctcaagtcccggcgggcaattttgaggttgggcaggtctcgtataaatttaacctcttgaagtcaagaggtccaaggaggatggtttgctcacttaagtgcccggtgtcacaagaaactaccaatgtcaaaaatgttgacaactcgaagatgacgcaactggagtctgcttcttctggttttacagttttgcggaacaaagccccaaggtggcatgagcatttgcagtgttggtgcttgaatttccatggtcgggtaacagtagcatcggtgaagaactttcaactggttgcaattatggaccaaagccagccaggagggaaaggagacgaggagactgtcctcctccagtttgggaaggtaggcgatgatactttcaccatggattataggcagccactttcagcttttcaagcatttgccttgtgcctgactagttttggcacgaaactggcatatggtgggcaattaagcctcggcgcacaaagctccttgcagtttcctccagagactgttatggcaaaaatattagacactgctgtggtatatgccctttga

SEQ ID NO: 1246 - protein, 408 aa, Populus balsamifera subsp. trichocarpa
  misc_feature (1)..(408): Ceres ANNOT ID no. 1482905
  misc_feature (114)..(377): Pfam Name: Tub Pfam Description: Tub family
  misc_feature (43)..(96): Pfam Name: F-box Pfam Description: F-box domain
  misc_feature: SWISSPROT Homolog: TULP2_MOUSE Tubby-related protein 2 (Tubby-like protein 2) (P4-6 protein) (Fragment) with e-value of 1.1e-39 and BLAST sequence identity of 44.5
  misc_feature: SWISSPROT Homolog: TULP3_MOUSE Tubby-related protein 3 (Tubby-like protein 3) with e-value of 3.8e-36 and BLAST sequence identity of 41.6
  misc_feature: SWISSPROT Homolog: TULP1_HUMAN Tubby-related protein 1 (Tubby-like protein 1) with e-value of 6.9e-36 and BLAST sequence identity of 42.2
  misc_feature: SWISSPROT Homolog: TULP3_HUMAN Tubby-related protein 3 (Tubby-like protein 3) with e-value of 9.6e-36 and BLAST sequence identity of 40.9
  misc_feature: SWISSPROT Homolog: TULP1_MOUSE Tubby-related protein 1 (Tubby-like protein 1) with e-value of 1.8e-35 and BLAST sequence identity of 42.9
  misc_feature 133596:<222: Transcription Factor
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(408): Functional Homolog of  Ceres CLONE ID no. 32737 at SEQ ID NO. 1283 with e-value of 5.40E-145 and BLAST sequence identity of 76.0
MSLRRSFLSRRFSRSFNNQNRNERNGVESGRLVGESGGESDGWGSMLPELLGEIIKRVEESEDRWPQRQNVVACACVCKKWREVTKDIVKSLPNNNNNNGSSGKITFPSCLKQPGPRDLPHQCLIKRNKKTSTFYLYLALTPSFTDKGKFLLAARRYRQGVHTEYIISLDADDLSQGSNAYVGKLSSDFLGTNFTIYDSQPPHSGAKPSSSRASRRFASKQISPQVPAGNFEVGQVSYKFNLLKSRGPRRMVCSLKCPVSQETTNVKNVDNSKMTQLESASSGFTVLRNKAPRWHEHLQCWCLNFHGRVTVASVKNFQLVAIMDQSQPGGKGDEETVLLQFGKVGDDTFTMDYRQPLSAFQAFALCLTSFGTKLAYGGQLSLGAQSSLQFPPETVMAKILDTAVVYAL

SEQ ID NO: 1247 - protein, 185 aa, Arabidopsis thaliana
  misc_feature (1)..(185): Ceres CLONE ID no. 32751
  misc_feature (102)..(143): Pfam Name: zf-C3HC4 Pfam Description: Zinc finger, C3HC4 type (RING finger)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MTRPSRLLETAAPPPQPSEEMIAAESDMVVILSALLCALICVAGLAAVVRCSWLRRFTAGGDSPSPNKGLKKKALQSLPRSTFTAAESTSGAAAEEGDSTECAICLTDFADGEEIRVLPLCGHSFHVECIDKWLVSRSSCPSCRRILTPVRCDRCGHASTAEMKDQAHRHQHHQHSSTTIPTFLP

SEQ ID NO: 1248 - DNA, 603 bp, Populus balsamifera subsp. trichocarpa; identical to SEQ ID NO: 1063
  misc_feature (1)..(603): Ceres ANNOT ID no. 1451171
  misc_feature 133834:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage

SEQ ID NO: 1249 - protein, 200 aa, Populus balsamifera subsp. trichocarpa; identical to SEQ ID NO: 1064
  misc_feature (1)..(200): Ceres ANNOT ID no. 1451171
  misc_feature (101)..(142): Pfam Name: zf-C3HC4 Pfam Description: Zinc finger, C3HC4 type (RING finger)
  misc_feature: SWISSPROT Homolog: ATL2A_ARATH RING-H2 finger protein ATL2A (RING-H2 zinc finger protein RHA3a) with e-value of 1.6e-98 and BLAST sequence identity of 99.5
  misc_feature: SWISSPROT Homolog: ATL4L_ARATH RING-H2 finger protein ATL4L (RING-H2 zinc finger protein RHA3b) with e-value of 5.5e-66 and BLAST sequence identity of 67.8
  misc_feature: SWISSPROT Homolog: ATL1B_ARATH RING-H2 finger protein ATL1B with e-value of 5.8e-39 and BLAST sequence identity of 55.2
  misc_feature: SWISSPROT Homolog: ATL1R_ARATH RING-H2 finger protein ATL1R (RING-H2 finger protein ATL8) with e-value of 7.7e-37 and BLAST sequence identity of 53.5
  misc_feature: SWISSPROT Homolog: ATL5B_ARATH Putative RING-H2 finger protein ATL5B precursor with e-value of 9.0e-27 and BLAST sequence identity of 43.6
  misc_feature 133953:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(200): Functional Homolog of  Ceres CLONE ID no. 32751 at SEQ ID NO. 1288 with e-value of 3.69E-43 and BLAST sequence identity of 61.9

SEQ ID NO: 1250 - protein, 286 aa, Arabidopsis thaliana
  misc_feature (1)..(286): Ceres CLONE ID no. 32753
  misc_feature (26)..(172): Pfam Name: Ribosomal_L18p Pfam Description: Ribosomal L18p/L5e family
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature (249)..(249): Xaa is any aa, unknown, or other
  misc_feature (252)..(252): Xaa is any aa, unknown, or other
MVFVKSTKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEELYKKVHAAIRAXPNXRKTVKPAPKQHKRYNLKKLTYEERKNKLIERVRH

SEQ ID NO: 1251 - DNA, 1029 bp, Populus balsamifera subsp. trichocarpa
  misc_feature (1)..(1029): Ceres ANNOT ID no. 1480607
  misc_feature 134180:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
atggcctatgcgaaggctcagaaatctaaggcctactccaagaggtttcaagtcaagtttaagagaagaagagaggggaagactgactacagggctaggattcgactgattaatcaggacaagaacaagtacaatacgcccaagtatcgatttgttgtccgatttgtatccttcagcaacaaggacattgttgcacaaataacatcagctagcattactggagatactgtccttgcttctgcttatgctcatgaacttcctcgatatgggcttgaagttggtcttacaaactatgcagcagcttactgtaccggacttctcttggctcgccgcttgttgaaaatgcttgagatggatgaggaatatgagggcaatgttgaggccactggcgaggatttctcagttgaaccagctgacaccaggaggccatttcgtgccctacttgatgttgggttagtcagaactacaactggaaatcgtgtctttggtgctctcaaggatagtcatttagtctctttgaatttcaatgttatacatggagctcttgatggtggtttggatattcctcacagtgaaaagaggtttgctggctttggaaaggacaataagcagctcgatgctgaagttcaccggaaatatatttatggtggacatgttgcagcatacatgaggcatcataaaactgcgtcaatcagaaattgtgcttgtatattttgtattatggttcttgaatgtttagtttgcgtttcttcaccccagactttgatggaggatgaacctgagaaataccagtctcactttagtgagtacctcaagagagaaattgatgctgattgtatggaggcattgtacaagaaggttcatgctgctattcgtgcagatccaacaaccaagaaatcagagaaggagccactcaaggagcacaagaggtataacttgaagaagctaacctacgaggaaaggaaagagaagttggttgagcgattgaataccttcaactcagctgctgatgatgaagatgacgagtga

SEQ ID NO: 1252 - protein, 342 aa, Populus balsamifera subsp. trichocarpa
  misc_feature (1)..(342): Ceres ANNOT ID no. 1480607
  misc_feature (26)..(188): Pfam Name: Ribosomal_L18p Pfam Description: Ribosomal L18p/L5e family
  misc_feature: SWISSPROT Homolog: RL5_ARATH 60S ribosomal protein L5 with e-value of 9.9e-147 and BLAST sequence identity of 96.8
  misc_feature: SWISSPROT Homolog: RL5_CUCSA 60S ribosomal protein L5 with e-value of 7.7e-124 and BLAST sequence identity of 80.6
  misc_feature: SWISSPROT Homolog: RL5A_ORYSA 60S ribosomal protein L5-1 with e-value of 4.5e-119 and BLAST sequence identity of 77.3
  misc_feature: SWISSPROT Homolog: RL5B_ORYSA 60S ribosomal protein L5-2 with e-value of 6.8e-116 and BLAST sequence identity of 76.2
  misc_feature: SWISSPROT Homolog: RL5_STYCL 60S ribosomal protein L5 with e-value of 7.2e-89 and BLAST sequence identity of 60.3
  misc_feature 134317:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature (1)..(342): Functional Homolog of  Ceres CLONE ID no. 32753 at SEQ ID NO. 1291 with e-value of 3.49E-111 and BLAST sequence identity of 79.9
MAYAKAQKSKAYSKRFQVKFKRRREGKTDYRARIRLINQDKNKYNTPKYRFVVRFVSFSNKDIVAQITSASITGDTVLASAYAHELPRYGLEVGLTNYAAAYCTGLLLARRLLKMLEMDEEYEGNVEATGEDFSVEPADTRRPFRALLDVGLVRTTTGNRVFGALKDSHLVSLNFNVIHGALDGGLDIPHSEKRFAGFGKDNKQLDAEVHRKYIYGGHVAAYMRHHKTASIRNCACIFCIMVLECLVCVSSPQTLMEDEPEKYQSHFSEYLKREIDADCMEALYKKVHAAIRADPTTKKSEKEPLKEHKRYNLKKLTYEERKEKLVERLNTFNSAADDEDDE

SEQ ID NO: 1253 - DNA, 693 bp, Populus balsamifera subsp. trichocarpa
  misc_feature (1)..(693): Ceres ANNOT ID no. 1472242
  misc_feature 134451:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
atggccggtgatattgttgttgcagctgcctattcccatgagctaccccgctacggccttgaagtgggtctcacaaattatgcagcagcttactgtaccgggcttctcttagcccgtcgagttctgaaaaagcttgagatggatgaggagtatgaaggaaatgttgaggcaacgggagaagattattctgttgaaccagcagatagcagaaggcctttccgtgctctccttgatgttggtctcgtgaggacaacaactgggaatcgtgtttttggtgctcttaagggagctttggatggtggacttgatattcctcatagtgacaagaggtttgctggattcaacaaggatggaaaacagcttgatgctgaggttcaccgcaagtacatttatggcggtcatgttgctgcgtatatgaggaatctgatggaagatgagccagagaaatatcagtctcatttcagtgagtacattaagagaggcattgaacctgataacatggaggagctgtacaagaaggttcatgctgctatacgtgcagaccctactgcaaagaagagtgagaagcaacttccaaaggagcacaagagatacaacctgaagaagctgacctacgaggaaagaaaggccaagttggttgaaaggttgaaggctctcaattctgctgctgacgatgatgaagatgatgagtaa

SEQ ID NO: 1254 - protein, 230 aa, Populus balsamifera subsp. trichocarpa
  misc_feature (1)..(230): Ceres ANNOT ID no. 1472242
  misc_feature (1)..(104): Pfam Name: Ribosomal_L18p Pfam Description: Ribosomal L18p/L5e family
  misc_feature: SWISSPROT Homolog: RL5_ARATH 60S ribosomal protein L5 with e-value of 9.9e-147 and BLAST sequence identity of 96.8
  misc_feature: SWISSPROT Homolog: RL5_CUCSA 60S ribosomal protein L5 with e-value of 7.7e-124 and BLAST sequence identity of 80.6
  misc_feature: SWISSPROT Homolog: RL5A_ORYSA 60S ribosomal protein L5-1 with e-value of 4.5e-119 and BLAST sequence identity of 77.3
  misc_feature: SWISSPROT Homolog: RL5B_ORYSA 60S ribosomal protein L5-2 with e-value of 6.8e-116 and BLAST sequence identity of 76.2
  misc_feature: SWISSPROT Homolog: RL5_STYCL 60S ribosomal protein L5 with e-value of 7.2e-89 and BLAST sequence identity of 60.3
  misc_feature 134576:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Other Useful for making bigger plants
  misc_feature (1)..(230): Functional Homolog of  Ceres CLONE ID no. 32753 at SEQ ID NO. 1291 with e-value of 4.00E-94 and BLAST sequence identity of 80.1
MAGDIVVAAAYSHELPRYGLEVGLTNYAAAYCTGLLLARRVLKKLEMDEEYEGNVEATGEDYSVEPADSRRPFRALLDVGLVRTTTGNRVFGALKGALDGGLDIPHSDKRFAGFNKDGKQLDAEVHRKYIYGGHVAAYMRNLMEDEPEKYQSHFSEYIKRGIEPDNMEELYKKVHAAIRADPTAKKSEKQLPKEHKRYNLKKLTYEERKAKLVERLKALNSAADDDEDDE

SEQ ID NO: 1255 - protein, 230 aa, Arabidopsis thaliana
  misc_feature (1)..(230): Ceres CLONE ID no. 32791
  misc_feature (1)..(230): Also Known As Ceres CDNA ID no. 23556617
  misc_feature (1)..(230): Also Known As Ceres GEMINI ID 531A5
  misc_feature (74)..(173): Pfam Name: K-box Pfam Description: K-box region
  misc_feature (9)..(59): Pfam Name: SRF-TF Pfam Description: SRF-type transcription factor DNA-binding and dimerisation domain)
  misc_feature 134716:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: ROSETTE LEAVES - Curled 2 Useful for making ornamental plants with altered leaf shape
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: INFLORESCENCE - Early Flowering Useful for modulating flowering time
  misc_feature: Phenotype: INFLORESCENCE - Late Flowering Useful for modulating flowering time
  misc_feature: Phenotype: FLOWER - Male-sterile Useful for sterility, genetic confinement systems
  misc_feature: Phenotype: FLOWER - Reduced fertility Useful for sterility, genetic confinement systems
  misc_feature: Phenotype: FLOWER - Short Sepals Useful for making ornamental plants with modified flowers
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Weak Useful for making stronger plants
  misc_feature: Phenotype: SILIQUES - Other Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 1256 - DNA, 675 bp, Populus balsamifera subsp. trichocarpa
  misc_feature (1)..(675): Ceres ANNOT ID no. 1540248
  misc_feature 134948:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: ROSETTE LEAVES - Curled 2 Useful for making ornamental plants with altered leaf shape
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: INFLORESCENCE - Early Flowering Useful for modulating flowering time
  misc_feature: Phenotype: INFLORESCENCE - Late Flowering Useful for modulating flowering time
  misc_feature: Phenotype: FLOWER - Male-sterile Useful for sterility, genetic confinement systems
  misc_feature: Phenotype: FLOWER - Reduced fertility Useful for sterility, genetic confinement systems
  misc_feature: Phenotype: FLOWER - Short Sepals Useful for making ornamental plants with modified flowers
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Weak Useful for making stronger plants
  misc_feature: Phenotype: SILIQUES - Other Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgggaagaggaaagattgagatcaagaggatcgagaacactacgaatcgtcaggttactttctgcaagagaagaaatgggctgttgaagaaagcctatgaattatctgtcctttgtgatgctgaagtttccctcatcgtcttctctagccgtggccgtctctatgagtacgccaacaacaatataagatcaactatagataggtacaagaaggtcagttcagatagttcaaatactgcctctatcacagaaatcaatgcccagtattatcaacaagaatcagcaaagatgcgtcaacaaattcagttgctacagaattctaacaggcacttaatgggagaagccgtgagtaatctgtcggtgaaggagctaaagcagctggagaataggctcgaaagaggcatgactagaatcaggtcaaagaagcatgaattgctgctagctgaaattgagtatatgcagaaaagggagattgagctggaaaatgaaagtgcctgtcttcgaaccaagatagcggaagttgagaggcttcaacaagccaacatggtcaccggagaagagctgaatgcaatccaggcattagcagcctctcgcaatttctttgctcctcattttcttgagggtggaactgcatacccgcacacttataacaagaagattctccatcttgggtaa

SEQ ID NO: 1257 - protein, 224 aa, Populus balsamifera subsp. trichocarpa
  misc_feature (1)..(224): Ceres ANNOT ID no. 1540248
  misc_feature (74)..(173): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AGL11_ARATH Agamous-like MADS-box protein AGL11 with e-value of 2.9e-117 and BLAST sequence identity of 100.0
  misc_feature: SWISSPROT Homolog: AG_PANGI Floral homeotic protein AGAMOUS (GAG2) with e-value of 1.2e-70 and BLAST sequence identity of 64.5
  misc_feature: SWISSPROT Homolog: AG_LYCES Floral homeotic protein AGAMOUS (TAG1) with e-value of 4.7e-69 and BLAST sequence identity of 66.7
  misc_feature: SWISSPROT Homolog: AGL5_ARATH Agamous-like MADS-box protein AGL5 with e-value of 6.0e-69 and BLAST sequence identity of 62.2
  misc_feature: SWISSPROT Homolog: MADS3_ORYSA MADS-box transcription factor 3 (OsMADS3) (Protein AGAMOUS-like) (RMADS222) with e-value of 2.0e-68 and BLAST sequence identity of 65.6
  misc_feature 135210:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: ROSETTE LEAVES - Curled 2 Useful for making ornamental plants with altered leaf shape
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Curled 5 Useful for making ornamental plants with altered leaf shape
  misc_feature: Phenotype: INFLORESCENCE - Early Flowering Useful for modulating flowering time
  misc_feature: Phenotype: INFLORESCENCE - Late Flowering Useful for modulating flowering time
  misc_feature: Phenotype: FLOWER - Male-sterile Useful for sterility, genetic confinement systems
  misc_feature: Phenotype: FLOWER - Reduced fertility Useful for sterility, genetic confinement systems
  misc_feature: Phenotype: FLOWER - Short Sepals Useful for making ornamental plants with modified flowers
  misc_feature: Phenotype: FLOWER - Small Useful for making ornamental plants with modified flowers
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Weak Useful for making stronger plants
  misc_feature: Phenotype: SILIQUES - Other Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(224): Functional Homolog of  Ceres CLONE ID no. 32791 at SEQ ID NO. 1296 with e-value of 2.29E-82 and BLAST sequence identity of 75.7
MGRGKIEIKRIENTTNRQVTFCKRRNGLLKKAYELSVLCDAEVSLIVFSSRGRLYEYANNNIRSTIDRYKKVSSDSSNTASITEINAQYYQQESAKMRQQIQLLQNSNRHLMGEAVSNLSVKELKQLENRLERGMTRIRSKKHELLLAEIEYMQKREIELENESACLRTKIAEVERLQQANMVTGEELNAIQALAASRNFFAPHFLEGGTAYPHTYNKKILHLG

SEQ ID NO: 1258 - protein, 244 aa, Arabidopsis thaliana
  misc_feature (1)..(244): Ceres CLONE ID no. 32811
  misc_feature (90)..(119): Pfam Name: UVR Pfam Description: UvrB/uvrC motif
  misc_feature: Phenotype: WHOLE PLANT - High Anthocyanin Useful for modulating anthocyanin content
MALHGSGVFCKVSNMVEITSPFGGSMRLLHLPKSYPIHCNMVSASNTFGSAHLKLQNKEPCSRLRPCRVKREENNQTADVESISMDENTLKQDLETAVQEENYVEAAKIRDKLKELQEDNKASVLSANSRFYQSFRNGDLAAMQSLWSKSGNPCCVHPGAKGITGYDYVMESWELVWMNYEFPLLIELKDVEVHVRGEVGYVTCMEFVKTKGSSSWGAQFVSNVFERIDGQWFICIHHASPVDI

SEQ ID NO: 1259 - DNA, 768 bp, Populus balsamifera subsp. trichocarpa
  misc_feature (1)..(768): Ceres ANNOT ID no. 1475744
  misc_feature 135526:<222: Transcription Factor
  misc_feature: Phenotype: WHOLE PLANT - High Anthocyanin Useful for modulating anthocyanin content
atggctctacatggatctaccttttgctacaaagtaaatttcattgctacaggagactttaagagactgcaatgttcatggactgacagtttcaagagaacccacaatatctcttcaccttccttgaagaaaaatacatttttggctggaagacttcattttcataaaaagttgcacattggaggaggaacccagtcctatgcacagcctttccgcttattttcattaagagcgtgtcaagtaagaagtgaggattcagaggaagtgttaagtggcgaaagcattgtattggatgagcagaccttaatgcgtgagcttcaggttgccattgaagaagagaattatgcccaagctgcaaaaatcagggacggccttaaagtactccaggaagatagcaaggcttcagtactggcagcaaatgctcggttttataatgctttcaggaagggggatctggctgccatgcaatccctttgggcaaaagcggataatgtatgttgtgtgcaccctggtgcgagtgggattcaaggttacgacgatgttatggaaagctgggagcttgtatggatgaactatgatttcccactagagattgagttgaaaaatgttcgagtgcattttaggggagatgtaggttatgttacatgtgtagaatttgtgagaacaaaaggcagcagttggggggcacaatttgtcacaaatgtttttgagaagattgatggtcagtggttaatctccattcaccatgcctcacctgttgacctgtaa

SEQ ID NO: 1260 - protein, 255 aa, Populus balsamifera subsp. trichocarpa
  misc_feature (1)..(255): Ceres ANNOT ID no. 1475744
  misc_feature 135577:<222: Transcription Factor
  misc_feature: Phenotype: WHOLE PLANT - High Anthocyanin Useful for modulating anthocyanin content
  misc_feature (1)..(255): Functional Homolog of  Ceres CLONE ID no. 32811 at SEQ ID NO. 1299 with e-value of 9.40E-70 and BLAST sequence identity of 63.4
MALHGSTFCYKVNFIATGDFKRLQCSWTDSFKRTHNISSPSLKKNTFLAGRLHFHKKLHIGGGTQSYAQPFRLFSLRACQVRSEDSEEVLSGESIVLDEQTLMRELQVAIEEENYAQAAKIRDGLKVLQEDSKASVLAANARFYNAFRKGDLAAMQSLWAKADNVCCVHPGASGIQGYDDVMESWELVWMNYDFPLEIELKNVRVHFRGDVGYVTCVEFVRTKGSSWGAQFVTNVFEKIDGQWLISIHHASPVDL

SEQ ID NO: 1261 - DNA, 1038 bp, Populus balsamifera subsp. trichocarpa
  misc_feature (1)..(1038): Ceres ANNOT ID no. 1454107
  misc_feature 135658:<222: Transcription Factor
  misc_feature: Phenotype: WHOLE PLANT - High Anthocyanin Useful for modulating anthocyanin content
atgagcccattctatgattttcaaggcaaagcccatatgaaagtcgagatctatcatctttctcagaatggccttaacagatgcagaacaaccttgccctcctctgtttccattcccatctaccagaacattcaaaaccctaccttaactcttgccactattttaggttttgtcaaaaacccacccgagtcatggctctacatggatctagctcttgctacaaacttgcacgttgttgtagacatcattgtcttaaaaagttgcacattggaggaggaaccctgtctcttccatattgatgttccaacctgtattgtcctcgtctcttgttgcggcggcaaacgtttagacatattctcagatggattgattagccatttttattttatgttgcctgcattcctcctgtctaaattagtgctaggttggagcaggtctctaattgtatatttgtatagcacagaaccctttgcacagcctgcccgcttattgtcattaagagcatgtcaagtaagaagtgaagattcagaggaagtgtcaagtggtgaaagcattgtattggatgagcagaccttaatgcgtgagcttcaggttgccattgaagaagagaactatacccaagctgcaaaaatcagggacagccttaaggtactccaggaagatagcaaggcttcagtactggcagcaaatgctcgtttttataatgctttcaggaagggggatctggctgccatgcagtccctttgggaaaaagcagataatgtatgttgcgtgcacccaggtgctagtggggttcttggttatgatgatgtcatggaaagctgggaggttgtatggatgaactatgatttcccactagatatcgagttgaaaaatgttagagtgcatttcaggggagatgtaggttatgttacgtgtgtagaatttgtgagaacaaaaggtcgcagttggggggcacaatttgtaacaaatgtttttgagaagattgatggtcagtggttcatctccattcaccatgcctcacctgttgacttgtaa

SEQ ID NO: 1262 - protein, 278 aa, Populus balsamifera subsp. trichocarpa
  misc_feature (1)..(278): Ceres ANNOT ID no. 1454107
  misc_feature 135719:<222: Transcription Factor
  misc_feature: Phenotype: WHOLE PLANT - High Anthocyanin Useful for modulating anthocyanin content
  misc_feature (1)..(278): Functional Homolog of  Ceres CLONE ID no. 32811 at SEQ ID NO. 1299 with e-value of 3.20E-69 and BLAST sequence identity of 70.0
MDLALATNLHVVVDIIVLKSCTLEEEPCLFHIDVPTCIVLVSCCGGKRLDIFSDGLISHFYFMLPAFLLSKLVLGWSRSLIVYLYSTEPFAQPARLLSLRACQVRSEDSEEVSSGESIVLDEQTLMRELQVAIEEENYTQAAKIRDSLKVLQEDSKASVLAANARFYNAFRKGDLAAMQSLWEKADNVCCVHPGASGVLGYDDVMESWEVVWMNYDFPLDIELKNVRVHFRGDVGYVTCVEFVRTKGRSWGAQFVTNVFEKIDGQWFISIHHASPVDL

SEQ ID NO: 1263 - protein, 332 aa, Arabidopsis thaliana
  misc_feature (1)..(332): Ceres CLONE ID no. 33232
  misc_feature: Phenotype: INFLORESCENCE - Asecondary Branching Useful for making ornamental plants with modified flowers
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
MIALAASSLGNTPIASFNRHFRFRLHPRNPLIQAAVSPSSSSSSPTASSGFDLSSLESAINKKDSNGVKEALDKLSEEGWAKKWSSQPYLSRRTTSLRELTTLGIKNAETLAIPSVRNDAAFLFTVVGSTGFIAVLAGQLPGDWGFFVPYLVGSISLVVLAMGSVSPGLLQAAISGFSTFFPDYQERIAAHEAAHFLVAYLIGLPILGYSLDIGKEHVNLIDERLAKLIYSGKLDSKELDRLAAVAMAGLAAEGLKYDKVIGQSADLFSLQRFINRSQPKISNEQQQNLTRWAVLYSASLLKNNKTIHEALMAAMSKNASVLECIQTIETAS

SEQ ID NO: 1264 - DNA, 954 bp, Populus balsamifera subsp. trichocarpa
  misc_feature (1)..(954): Ceres ANNOT ID no. 1504045
  misc_feature 135933:<222: Transcription Factor
  misc_feature: Phenotype: INFLORESCENCE - Asecondary Branching Useful for making ornamental plants with modified flowers
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atggtttctctgtcaaatactactgcatcaacatacactgcatttcagtgctgtaatcatcaccacaagctgctgcaaataagagcttcttctgctgcacctggtgttgacctcaagacccttgagtctgcacttgctaagaaagacagcaatgctgttaaagaggcacttgatcaactaagggaggttggttgggctaagagatggagctctcagccatatgtctctcgccgtacgacatctctgcgggagctgacgagtcttggaattaagaatgcagagaacctggcaattccaagtgttagaaatgatgcagcttttcttttcacagtggtgggaacaacaggctttttgggagtccttgctggccaacttcctggggattggggtttctttgtgccatacttgattgggagcatttctctagttgtcctggctgtggggagtatttctcctggacttcttcaagctgctattagtggtttctctgcagtttttcctgactatcaggagaggatagctagacatgaagcagctcattttttaattggatacttgattggccttcctatcctggactactcattagatatcgggaaagagcatgtcaatctcattgatgaaaagctggaaaagctgatatatagtgggcagcttgatgctaaggagctagataggttggcggttgtagcaatggctggacttgccgcagagggtctgcaatatgacaaagtggttggccaatctgctgaccttttcactcttcagagatttataaatagaagcaaaccacagatcagcaaagaccagcaacagaatcttactagatgggctgttttatttggcggatctcttattaaaaataacaagtcactccatgaagccctaatgacagcaatgtcgaataaggcgactgtattagaatgcattcaagcgatcgagaaagctgcataa

SEQ ID NO: 1265 - protein, 317 aa, Populus balsamifera subsp. trichocarpa
  misc_feature (1)..(317): Ceres ANNOT ID no. 1504045
  misc_feature 136032:<222: Transcription Factor
  misc_feature: Phenotype: INFLORESCENCE - Asecondary Branching Useful for making ornamental plants with modified flowers
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(317): Functional Homolog of  Ceres CLONE ID no. 33232 at SEQ ID NO. 1304 with e-value of 6.60E-124 and BLAST sequence identity of 77.4
MVSLSNTTASTYTAFQCCNHHHKLLQIRASSAAPGVDLKTLESALAKKDSNAVKEALDQLREVGWAKRWSSQPYVSRRTTSLRELTSLGIKNAENLAIPSVRNDAAFLFTVVGTTGFLGVLAGQLPGDWGFFVPYLIGSISLVVLAVGSISPGLLQAAISGFSAVFPDYQERIARHEAAHFLIGYLIGLPILDYSLDIGKEHVNLIDEKLEKLIYSGQLDAKELDRLAVVAMAGLAAEGLQYDKVVGQSADLFTLQRFINRSKPQISKDQQQNLTRWAVLFGGSLIKNNKSLHEALMTAMSNKATVLECIQAIEKAA

SEQ ID NO: 1266 - DNA, 861 bp, Populus balsamifera subsp. trichocarpa
  misc_feature (1)..(861): Ceres ANNOT ID no. 1450983
  misc_feature 136167:<222: Transcription Factor
  misc_feature: Phenotype: INFLORESCENCE - Asecondary Branching Useful for making ornamental plants with modified flowers
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atggtttctctgtcaaatactactgcatcaacatacactgcatttcagtgctgtaatcatcaccacaagctgctgcaaataagagcttcttctgctgcacctggtgttgacctcaagacccttgagtctgcacttgctaagaaagacagcaatgctgttaaagaggcacttgatcaactaagggaggttggttgggctaagagatggagctctcagccatatgtctctcgccgtacgacatctctgcgggagctgacgagtcttggaattaagaatgcagagaacctggcaattccaagtgttagaaatgatgcagcttttcttttcacagtggtgggaacaacaggctttttgggagtccttgctggccaacttcctggggattggggtttctttgtgccatacttgattgggagcatttctctagttgtcctggctgtggggagtatttctcctggacttcttcaagctgctattagtggtttctctgcagtttttcctgactatcaggagaggatagctagacatgaagcagctcattttttaattggatacttgattggccttcctatcctggactactcattagatatcgggaaagagcatgtcaatctcattgatgaaaagctggaaaagctgatatatagtgggcagcttgatgctaaggagctagataggttggcggttgtagcaatggctggacttgccgcagagggtctgcaatatgacaaagtggttggccaatctgctgaccttttcactcttcagagatttataaatagaagcaaaccacagatcagcaaagaccagcaacagaatcttactagatgggcttttcattatggagtgatacatgactaa

SEQ ID NO: 1267 - protein, 286 aa, Populus balsamifera subsp. trichocarpa
  misc_feature (1)..(286): Ceres ANNOT ID no. 1450983
  misc_feature 136264:<222: Transcription Factor
  misc_feature: Phenotype: INFLORESCENCE - Asecondary Branching Useful for making ornamental plants with modified flowers
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - Yellow-Green Viable 3 Useful for making lethal plants for genetic confinement systems
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(286): Functional Homolog of  Ceres CLONE ID no. 33232 at SEQ ID NO. 1304 with e-value of 5.09E-110 and BLAST sequence identity of 78.4
MVSLSNTTASTYTAFQCCNHHHKLLQIRASSAAPGVDLKTLESALAKKDSNAVKEALDQLREVGWAKRWSSQPYVSRRTTSLRELTSLGIKNAENLAIPSVRNDAAFLFTVVGTTGFLGVLAGQLPGDWGFFVPYLIGSISLVVLAVGSISPGLLQAAISGFSAVFPDYQERIARHEAAHFLIGYLIGLPILDYSLDIGKEHVNLIDEKLEKLIYSGQLDAKELDRLAVVAMAGLAAEGLQYDKVVGQSADLFTLQRFINRSKPQISKDQQQNLTRWAFHYGVIHD

SEQ ID NO: 1268 - protein, 195 aa, Arabidopsis thaliana
  misc_feature (1)..(195): Ceres CLONE ID no. 33333
  misc_feature (1)..(195): Also Known As Ceres CDNA ID no. 23377150
  misc_feature (1)..(195): Also Known As Ceres GEMINI ID 553C11
  misc_feature (67)..(112): Pfam Name: Myb_DNA-binding Pfam Description: Myb-like DNA-binding domain
  misc_feature 136413:<222: Transcription Factor
  misc_feature: Phenotype: Activates expression of the gene endogenous to the PsROMT (SEQ ID NO 4161) regalutory region Useful for modulating Alkaloid Biosynthesis
MARSPCCEKNGLKKGPWTSEEDQKLVDYIQKHGYGNWRTLPKNAGLQRCGKSCRLRWTNYLRPDIKRGRFSFEEEETIIQLHSFLGNKWSAIAARLPGRTDNEIKNFWNTHIRKKLLRMGIDPVTHSPRLDLLDISSILASSLYNSSSHHMNMSRLMMDTNRRHHQQHPLVNPEILKLATSLFSQNQNQEPCGGS

SEQ ID NO: 1269 - DNA, 1038 bp, Populus balsamifera subsp. trichocarpa
  misc_feature (1)..(1038): Ceres ANNOT ID no. 1501772
  misc_feature 136477:<222: Transcription Factor
  misc_feature: Phenotype: Activates expression of the gene endogenous to the PsROMT (SEQ ID NO 4161) regalutory region Useful for modulating Alkaloid Biosynthesis
atgggtagagcaccttgttgtgacaaaaatgggctaaagaaagggccttggaccccggaagaggatcagaagctggttgattacatacaaaaacatggctatggcaactggaggacacttccaaagaatgctgggttgcaaaggtgcggaaagagttgtcgtcttcgttggaccaactatctgaggcctgatatcaagagaggtcggttttctttcgaagaagaggagacaataattcagctgcatagtatattgggaaacaagtggtctgccattgctgctcgattgcctggaagaacagacaacgagatcaagaactactggaacacacacattaggaagaggcttctaagaatgggaattgatccggtgactcatagtccaagacttgatcttcttgacctctcctcaatcctgagctcatctctttacaactcctctgatcaaatgaacatgtcaagaatgcttggtgtcccacctttagtgaacccaggacttctaaggctagccacatctctcttatcttctcaacgtgaccaaacccaaaacttcgtcatccaaaatggtcaagaagaaaaccatcttcccaacccacaagtccaacaaagccaatacgaatcgatgattcatcaagctaatatccagtttcaaaccccaggtcaagaaatgcctacttgcaccacattgactaccagcccctgtgttacattttctaacgaatggcaaaacaatggaatgggctccaatttagctgaagattattatgtgcctgctgtatcaagttacaacagcaacggctactatgggtctgaccttatggacccttcttccgagacctcgacttttatctccaacagcagcaaccagaactttggttttgcttcagttttatcaactccttcttcaagtcctacgccattgaactccaattcaacttacatcaatagcagcagcgctgaagatgagagggaaagctactgcagcaacatcttgaaattcgaaatcccagatattttggatgctattaacttcatgtaa

SEQ ID NO: 1270 - protein, 345 aa, Populus balsamifera subsp. trichocarpa
  misc_feature (1)..(345): Ceres ANNOT ID no. 1501772
  misc_feature (67)..(112): Pfam Name: Myb_DNA-binding Pfam Description: Myb-like DNA-binding domain
  misc_feature: SWISSPROT Homolog: ODO1_PETHY ODORANT1 protein (MYB-like protein ODO1) with e-value of 3.8e-51 and BLAST sequence identity of 60.5
  misc_feature: SWISSPROT Homolog: MYB38_MAIZE Myb-related protein Zm38 with e-value of 4.8e-51 and BLAST sequence identity of 66.2
  misc_feature: SWISSPROT Homolog: MYB4_ARATH Transcription repressor MYB4 (Myb-related protein 4) (AtMYB4) with e-value of 1.3e-50 and BLAST sequence identity of 71.9
  misc_feature: SWISSPROT Homolog: MYB1_HORVU Myb-related protein Hv1 with e-value of 2.7e-50 and BLAST sequence identity of 73.8
  misc_feature: SWISSPROT Homolog: MYB4_ORYSA Myb-related protein Myb4 (OsMyb4) (Transcription factor RLTR1) with e-value of 9.1e-50 and BLAST sequence identity of 77.6
  misc_feature 136582:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(345): Functional Homolog of  Ceres CLONE ID no. 33333 at SEQ ID NO. 1309 with e-value of 2.29E-82 and BLAST sequence identity of 86.6
MGRAPCCDKNGLKKGPWTPEEDQKLVDYIQKHGYGNWRTLPKNAGLQRCGKSCRLRWTNYLRPDIKRGRFSFEEEETIIQLHSILGNKWSAIAARLPGRTDNEIKNYWNTHIRKRLLRMGIDPVTHSPRLDLLDLSSILSSSLYNSSDQMNMSRMLGVPPLVNPGLLRLATSLLSSQRDQTQNFVIQNGQEENHLPNPQVQQSQYESMIHQANIQFQTPGQEMPTCTTLTTSPCVTFSNEWQNNGMGSNLAEDYYVPAVSSYNSNGYYGSDLMDPSSETSTFISNSSNQNFGFASVLSTPSSSPTPLNSNSTYINSSSAEDERESYCSNILKFEIPDILDAINFM

SEQ ID NO: 1271 - DNA, 1014 bp, Populus balsamifera subsp. trichocarpa
  misc_feature (1)..(1014): Ceres ANNOT ID no. 1519164
  misc_feature 136681:<222: Transcription Factor
  misc_feature: Phenotype: Activates expression of the gene endogenous to the PsROMT (SEQ ID NO 4161) regalutory region Useful for modulating Alkaloid Biosynthesis
atggggagggcaccttgctgtgaaaaaaaggggctaaagaaagggccgtggacaccagatgaggatcagaagctgattgattacatacaaaaacatggctatggcaactggagaacacttccaaagaatgctgggttgcagaggtgtggaaagagttgtcgtcttcgttggactaactatttgaggcctgatatcaagagaggtcgattttctttcgaggaagaagagacaataattcagctacatggtattttgggaaacaagtggtctgccattgctgctcgactgcctggaagaaccgacaacgaaatcaagaactactggaacacacacatcaggaaaaggcttctgagaatgggaattgatccagtgactcatagtccaaggcttgatcttttagacctctcctcaatcctcaactcgcctctttacgactccaggatgaacatgtcaagagttcttggggttcaacctctaggcgacccagaactcttaaggctagccacatctctcttatcttctcaacgtgaccaaacccaagattttgctatccaaaatggtcatcaagaaaaccatctttccagcccacaagtccatcaaacacagcaaatggaccccaacgtagaccaataccaattaagcactattaccagctttagctctccaaattctcagttaagcacacatgatcagtggcaaagcaacaggatgggctcgaatttatcacaagattattatctgcctgcagtatcaagttacaacagcgccgacaactgccatgggactgatcttgtagacccttcttctgaggcctcaacttttatttccaataacagcaaccaaacctttggttttgcttcagttttatcaactccttcctcaagtccagcgccattgaactccaattcaacatacatcaattgcagcagcactgaagatgagagggatagctattgcagcaacatcttgaaattcgaaatcccagatattttagatgtcagtaacttcatgtaa

SEQ ID NO: 1272 - protein, 337 aa, Populus balsamifera subsp. trichocarpa
  misc_feature (1)..(337): Ceres ANNOT ID no. 1519164
  misc_feature (14)..(61): Pfam Name: Myb_DNA-binding Pfam Description: Myb-like DNA-binding domain
  misc_feature: SWISSPROT Homolog: ODO1_PETHY ODORANT1 protein (MYB-like protein ODO1) with e-value of 3.8e-51 and BLAST sequence identity of 60.5
  misc_feature: SWISSPROT Homolog: MYB38_MAIZE Myb-related protein Zm38 with e-value of 4.8e-51 and BLAST sequence identity of 66.2
  misc_feature: SWISSPROT Homolog: MYB4_ARATH Transcription repressor MYB4 (Myb-related protein 4) (AtMYB4) with e-value of 1.3e-50 and BLAST sequence identity of 71.9
  misc_feature: SWISSPROT Homolog: MYB1_HORVU Myb-related protein Hv1 with e-value of 2.7e-50 and BLAST sequence identity of 73.8
  misc_feature: SWISSPROT Homolog: MYB4_ORYSA Myb-related protein Myb4 (OsMyb4) (Transcription factor RLTR1) with e-value of 9.1e-50 and BLAST sequence identity of 77.6
  misc_feature 136784:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(337): Functional Homolog of  Ceres CLONE ID no. 33333 at SEQ ID NO. 1309 with e-value of 1.50E-78 and BLAST sequence identity of 83.7
MGRAPCCEKKGLKKGPWTPDEDQKLIDYIQKHGYGNWRTLPKNAGLQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSRMNMSRVLGVQPLGDPELLRLATSLLSSQRDQTQDFAIQNGHQENHLSSPQVHQTQQMDPNVDQYQLSTITSFSSPNSQLSTHDQWQSNRMGSNLSQDYYLPAVSSYNSADNCHGTDLVDPSSEASTFISNNSNQTFGFASVLSTPSSSPAPLNSNSTYINCSSTEDERDSYCSNILKFEIPDILDVSNFM

SEQ ID NO: 1273 - DNA, 1095 bp, Populus balsamifera subsp. trichocarpa
  misc_feature (1)..(1095): Ceres ANNOT ID no. 1480076
  misc_feature 136883:<222: Transcription Factor
  misc_feature: Phenotype: Activates expression of the gene endogenous to the PsROMT (SEQ ID NO 4161) regalutory region Useful for modulating Alkaloid Biosynthesis
atgggaagagtaccttgctgtgacaaaaatggactcaagaaaggtccttggaccccagaagaagatcacaagctcatcagttttattcaacttcacggacctggcaactggcggtccctccccaaaaatgcagggcttcaaagatgtggaaagagctgtcgccttcgttggacaaattacctgagacctgatatcaagagaggaagattttcatttgaagaagaagagactataattcaacttcacagtgttttgggaaacaagtggtcagctatagcagctcgtttgccaggaagaactgacaatgaaatcaagaattactggaatactcatataagaaaaaggttgcttagaaatggaattgatcctgtgactcatgccccacgtcttgatcttcttgacctatcctccattataagttcagctttgtgcaacccatcaacacttctcaatctgtcaaccttggtgggcaacactcaagccctactaaatcctaatattttaagactagccaccactctatcatcattgaaacaagaaaattcggacatgtttttgcagaaactacaagaaaaccagcttttcaacccactgttacaaaaccaagatgtcccttcattattttcacaacctaggcagtttcataatctagctcaacaagttcctgcttgtactactgctactacatctactggcgggtttatagaccaaacaacacaagtcatgcaagcaaatgtagaagggttttcgtcgaatccgacgagcactttcaactgccaaaattccccagaaaacttcgtgccttcaagtttgaatgagagtttggtttcactgccaaacttttattgcaatggtactactacagatcctacagttcctgaacctggagagcactcaggattccaatcagcaaacaatggatatcagaacttcagcatcgactcagttatatcaacgcctttaatgagcccggatccattgaactcatcatcaacttatctcaacagcagcagtactgaggatgagagggagtgctacagcagcttgttgaagtttgaaattcctgagagtttgaacattgatgatttcctgtaa

SEQ ID NO: 1274 - protein, 364 aa, Populus balsamifera subsp. trichocarpa
  misc_feature (1)..(364): Ceres ANNOT ID no. 1480076
  misc_feature (14)..(61): Pfam Name: Myb_DNA-binding Pfam Description: Myb-like DNA-binding domain
  misc_feature: SWISSPROT Homolog: ODO1_PETHY ODORANT1 protein (MYB-like protein ODO1) with e-value of 3.8e-51 and BLAST sequence identity of 60.5
  misc_feature: SWISSPROT Homolog: MYB38_MAIZE Myb-related protein Zm38 with e-value of 4.8e-51 and BLAST sequence identity of 66.2
  misc_feature: SWISSPROT Homolog: MYB4_ARATH Transcription repressor MYB4 (Myb-related protein 4) (AtMYB4) with e-value of 1.3e-50 and BLAST sequence identity of 71.9
  misc_feature: SWISSPROT Homolog: MYB1_HORVU Myb-related protein Hv1 with e-value of 2.7e-50 and BLAST sequence identity of 73.8
  misc_feature: SWISSPROT Homolog: MYB4_ORYSA Myb-related protein Myb4 (OsMyb4) (Transcription factor RLTR1) with e-value of 9.1e-50 and BLAST sequence identity of 77.6
  misc_feature 136990:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(364): Functional Homolog of  Ceres CLONE ID no. 33333 at SEQ ID NO. 1309 with e-value of 4.89E-73 and BLAST sequence identity of 78.2
MGRVPCCDKNGLKKGPWTPEEDHKLISFIQLHGPGNWRSLPKNAGLQRCGKSCRLRWTNYLRPDIKRGRFSFEEEETIIQLHSVLGNKWSAIAARLPGRTDNEIKNYWNTHIRKRLLRNGIDPVTHAPRLDLLDLSSIISSALCNPSTLLNLSTLVGNTQALLNPNILRLATTLSSLKQENSDMFLQKLQENQLFNPLLQNQDVPSLFSQPRQFHNLAQQVPACTTATTSTGGFIDQTTQVMQANVEGFSSNPTSTFNCQNSPENFVPSSLNESLVSLPNFYCNGTTTDPTVPEPGEHSGFQSANNGYQNFSIDSVISTPLMSPDPLNSSSTYLNSSSTEDERECYSSLLKFEIPESLNIDDFL

SEQ ID NO: 1275 - DNA, 1089 bp, Populus balsamifera subsp. trichocarpa
  misc_feature (1)..(1089): Ceres ANNOT ID no. 1524008
  misc_feature 137092:<222: Transcription Factor
  misc_feature: Phenotype: Activates expression of the gene endogenous to the PsROMT (SEQ ID NO 4161) regalutory region Useful for modulating Alkaloid Biosynthesis
atgggaagagcaccttgctgtgacaaaaatggactcaagaaaggtccttggactcctgaagaagatcaaaagctcaccgcttatattcaacttcagggacctggaaactggcgttccctccccaaaaatgctgggctccaaaggtgtggaaagagctgtcgtcttcgttggacaaactacctgaggcctgatatcaagagaggaagattttcatttgaagaagaagagtctataattcaacttcacagtattttgggaaacaagtggtcagctatagcagctcgtttaccaggaagaactgacaatgaaatcaagaattattggaacactcatataaggaaaaggttgcttagaaatggaattgatccagtgactcatgcctcacgtcttgatcttcttgacctatcctctattctgagttcagctttgtgtaacccatcatcactactcactctgtcaaccttggtgggcaatactcaagccctactaaatcctgatatttttagactatccaccactctatcatcgttgaaacaagaaaattcagacctgtttttgcagcaactacaagaaaacgagctttgcagctcactgttacaaaaccaagctatccctacattatcgtcacaatctaaccagtttcagaatcaagctgaactaattcctgcttgcactactactacatctactggcacatttctaaaccaaacaacaccacttatgctagcaaatgtggaagggttttcaccgaatacaacaagtacttttagctgccaaaattcacaagaaaattccgtgcctttgaacgagggattggtttcacagccaaacttttattgcaatagtactactacaacaaatcctacagttcctgaacttgaagagtactcaggattccaatcagcaaacaacggctatcggaattttagcattggctcggttatttcaacgcgttttacgagcccggatccattgaattcaccatcaacatatgtcaacagcagcagtactgaggatgacagggagtgctacagcagcttgttgaagttcgaaattccagagagtttcgacattgatgatttcctgtaa

SEQ ID NO: 1276 - protein, 362 aa, Populus balsamifera subsp. trichocarpa
  misc_feature (1)..(362): Ceres ANNOT ID no. 1524008
  misc_feature (67)..(112): Pfam Name: Myb_DNA-binding Pfam Description: Myb-like DNA-binding domain
  misc_feature: SWISSPROT Homolog: ODO1_PETHY ODORANT1 protein (MYB-like protein ODO1) with e-value of 3.8e-51 and BLAST sequence identity of 60.5
  misc_feature: SWISSPROT Homolog: MYB38_MAIZE Myb-related protein Zm38 with e-value of 4.8e-51 and BLAST sequence identity of 66.2
  misc_feature: SWISSPROT Homolog: MYB4_ARATH Transcription repressor MYB4 (Myb-related protein 4) (AtMYB4) with e-value of 1.3e-50 and BLAST sequence identity of 71.9
  misc_feature: SWISSPROT Homolog: MYB1_HORVU Myb-related protein Hv1 with e-value of 2.7e-50 and BLAST sequence identity of 73.8
  misc_feature: SWISSPROT Homolog: MYB4_ORYSA Myb-related protein Myb4 (OsMyb4) (Transcription factor RLTR1) with e-value of 9.1e-50 and BLAST sequence identity of 77.6
  misc_feature 137199:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(362): Functional Homolog of  Ceres CLONE ID no. 33333 at SEQ ID NO. 1309 with e-value of 3.89E-71 and BLAST sequence identity of 77.0
MGRAPCCDKNGLKKGPWTPEEDQKLTAYIQLQGPGNWRSLPKNAGLQRCGKSCRLRWTNYLRPDIKRGRFSFEEEESIIQLHSILGNKWSAIAARLPGRTDNEIKNYWNTHIRKRLLRNGIDPVTHASRLDLLDLSSILSSALCNPSSLLTLSTLVGNTQALLNPDIFRLSTTLSSLKQENSDLFLQQLQENELCSSLLQNQAIPTLSSQSNQFQNQAELIPACTTTTSTGTFLNQTTPLMLANVEGFSPNTTSTFSCQNSQENSVPLNEGLVSQPNFYCNSTTTTNPTVPELEEYSGFQSANNGYRNFSIGSVISTRFTSPDPLNSPSTYVNSSSTEDDRECYSSLLKFEIPESFDIDDFL

SEQ ID NO: 1277 - DNA, 1056 bp, Populus balsamifera subsp. trichocarpa
  misc_feature (1)..(1056): Ceres ANNOT ID no. 1480159
  misc_feature 137301:<222: Transcription Factor
  misc_feature: Phenotype: Activates expression of the gene endogenous to the PsROMT (SEQ ID NO 4161) regalutory region Useful for modulating Alkaloid Biosynthesis
atgggaaaatctccttgttgtgagaaaaatggactaaagaaaggtccatggacagaagaggaagataaaaaattgattagctacattcagaaacatgggcatggaagatggcgactcctaccaaaaaatgcaggactcaaaagatgtggaaagagttgtcgtcttcgatggactaattacttgaggcccgacatcaagagaggaaagctctcatttgaagaagaagagacaataattcagctgcatagtgttttgggaaataagtggtctgcaattgctactcgcttgcctggacgaactgataacgaaatcaagaattattggaacacccacataaggaaacggctactgaggatgggaatcgatcctgtgactcataagccacacctagatcttcttcaactctactcggttctcaactcgactgtccacaactcatctcagcttaatatttcaagttcgcttggcattggacccattttgagcccagatctcttgaatctagccactccttacttgtcatgccaaggcaactatattagccaagatgtcagtccaaaacttgttcaagatagccaagttggaaacaaccatgttcaaaaccaatttcaatgcttccaaccaaacgagctccaaaaccaaatccaagcttgtacaaatacactaagtgctcaatttctgtatgaaacccagattagtgcagccaatttggaacaactttcttgcaaccccaccaactttagttgtcaaaattctctacgaagttcgtggcacgctaacggagagagtactcccgatatttgtgaaagtctcatgtcaaactacgtgtatcatgattctaataataaacccatcaccaacgatatttcctttgagacactacaaagtttgagtttcggctcgcttctgtctacaccttcatctagtacaactcccttgcgttcttcatcaacgacttatgtcaatgtcagcactgaagatgagaaggatagttactgcagcaatatgttggtgttcgacatgcccaacagcttggatgccagtaggctcatttag

SEQ ID NO: 1278 - protein, 351 aa, Populus balsamifera subsp. trichocarpa
  misc_feature (1)..(351): Ceres ANNOT ID no. 1480159
  misc_feature (14)..(61): Pfam Name: Myb_DNA-binding Pfam Description: Myb-like DNA-binding domain
  misc_feature: SWISSPROT Homolog: ODO1_PETHY ODORANT1 protein (MYB-like protein ODO1) with e-value of 3.8e-51 and BLAST sequence identity of 60.5
  misc_feature: SWISSPROT Homolog: MYB38_MAIZE Myb-related protein Zm38 with e-value of 4.8e-51 and BLAST sequence identity of 66.2
  misc_feature: SWISSPROT Homolog: MYB4_ARATH Transcription repressor MYB4 (Myb-related protein 4) (AtMYB4) with e-value of 1.3e-50 and BLAST sequence identity of 71.9
  misc_feature: SWISSPROT Homolog: MYB1_HORVU Myb-related protein Hv1 with e-value of 2.7e-50 and BLAST sequence identity of 73.8
  misc_feature: SWISSPROT Homolog: MYB4_ORYSA Myb-related protein Myb4 (OsMyb4) (Transcription factor RLTR1) with e-value of 9.1e-50 and BLAST sequence identity of 77.6
  misc_feature 137406:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(351): Functional Homolog of  Ceres CLONE ID no. 33333 at SEQ ID NO. 1309 with e-value of 1.89E-69 and BLAST sequence identity of 73.5
MGKSPCCEKNGLKKGPWTEEEDKKLISYIQKHGHGRWRLLPKNAGLKRCGKSCRLRWTNYLRPDIKRGKLSFEEEETIIQLHSVLGNKWSAIATRLPGRTDNEIKNYWNTHIRKRLLRMGIDPVTHKPHLDLLQLYSVLNSTVHNSSQLNISSSLGIGPILSPDLLNLATPYLSCQGNYISQDVSPKLVQDSQVGNNHVQNQFQCFQPNELQNQIQACTNTLSAQFLYETQISAANLEQLSCNPTNFSCQNSLRSSWHANGESTPDICESLMSNYVYHDSNNKPITNDISFETLQSLSFGSLLSTPSSSTTPLRSSSTTYVNVSTEDEKDSYCSNMLVFDMPNSLDASRLI

SEQ ID NO: 1279 - protein, 250 aa, Arabidopsis thaliana
  misc_feature (1)..(250): Ceres CLONE ID no. 33482
  misc_feature (6)..(114): Pfam Name: Motile_Sperm Pfam Description: MSP (Major sperm protein) domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature (176)..(176): Xaa is any aa, unknown, or other
MTTGDLVNIHPTELKFPFELKKQSSCSMQLTNKTTTQCVAFKVKTTNPRKYCVRPNTGVVLPGDSCNVTVTMQAQKEAPLDMQCKDKFLVQTVVVSDGTTSKEVLAEMFNKEAGRVIEDFKLRVVYIPANPPSPVPEGSEEGNSPMASLNDIASQSASLFDDVSKTFEETSEKSSXAWSMISKLTEEKTSATQQSQKLRLELEMLRKETKQEAVGWSFLALDAAGGSARLRDWLLIEPDINAMGLASSSF

SEQ ID NO: 1280 - DNA, 672 bp, Populus balsamifera subsp. trichocarpa
  misc_feature (1)..(672): Ceres ANNOT ID no. 1497019
  misc_feature 137593:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
atgagcactggagatcttcttaatattcacccaatagagcttaaattcccatttgaattgaagaagcagagttcatgttctatgcaattaactaacaagtcagataaatatgtggcttttaaggttaaaacaaccaatccgaggaaatactgcgttcgtcccaacagcggcattgtcatgcccggatccacttgcagcgttacagttaccatgcaagctcaaaaagaggcaccatcagatatgcaatgcaaggacaagttcctacttcagagtgttgttgcgcctgatggtacaactacaaaagggataacttctgaattgtttaataaggagggtgataaggttgtggaggagttcaaattgagggttgtatatatccctgcaaatcctccctctcctgtcccagaagagtctgatgaaggatcttctccccctaggccttctgtgcttgagaatggtaaccaggatagttcattacttgatgctacgtggtctctgatttcaaggttgactgaggagaaaacttctgccctgcagcaaaatcagaagcttcagcatgaactggaactgatgagaaaacaaattagcaaaaaacatgccgggggtttctctttattggttgtatttctggttggtttgtttggcatcttggttggctatatcttcaagtga

SEQ ID NO: 1281 - protein, 223 aa, Populus balsamifera subsp. trichocarpa
  misc_feature (1)..(223): Ceres ANNOT ID no. 1497019
  misc_feature (6)..(114): Pfam Name: Motile_Sperm Pfam Description: MSP (Major sperm protein) domain
  misc_feature: SWISSPROT Homolog: VAPA_HUMAN Vesicle-associated membrane protein-associated protein A with e-value of 5.2e-15 and BLAST sequence identity of 30.7
  misc_feature: SWISSPROT Homolog: VAPA_HUMAN VAMP-associated protein A (VAMP-A) (VAP-A) A 33 kDa Vamp-associated protein (VAP-33)
  misc_feature: SWISSPROT Homolog: VAPA_PONPY Vesicle-associated membrane protein-associated protein A (VAMP-associated protein A) (VAMP-A) (VAP-A) with e-value of 5.2e-15 and BLAST sequence identity of 30.7
  misc_feature: SWISSPROT Homolog: VAPB_HUMAN Vesicle-associated membrane protein-associated protein B/C (VAMP-associated protein B/C) (VAMP-B/VAMP-C) (VAP-B/VAP-C) with e-value of 1.4e-14 and BLAST sequence identity of 29.2
  misc_feature: SWISSPROT Homolog: VP33_APLCA Vesicle-associated membrane protein/synaptobrevin-binding protein (VAP-33) with e-value of 3.6e-14 and BLAST sequence identity of 28.2
  misc_feature: SWISSPROT Homolog: VAPB_MOUSE Vesicle-associated membrane protein-associated protein B with e-value of 4.7e-14 and BLAST sequence identity of 29.7
  misc_feature: SWISSPROT Homolog: VAPB_MOUSE VAMP-associated protein B VAMP-associated protein 33b VAMP-B (VAP-B)
  misc_feature 137710:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature (1)..(223): Functional Homolog of  Ceres CLONE ID no. 33482 at SEQ ID NO. 1320 with e-value of 5.00E-71 and BLAST sequence identity of 69.0
MSTGDLLNIHPIELKFPFELKKQSSCSMQLTNKSDKYVAFKVKTTNPRKYCVRPNSGIVMPGSTCSVTVTMQAQKEAPSDMQCKDKFLLQSVVAPDGTTTKGITSELFNKEGDKVVEEFKLRVVYIPANPPSPVPEESDEGSSPPRPSVLENGNQDSSLLDATWSLISRLTEEKTSALQQNQKLQHELELMRKQISKKHAGGFSLLVVFLVGLFGILVGYIFK

SEQ ID NO: 1282 - protein, 310 aa, Arabidopsis thaliana
  misc_feature (1)..(310): Ceres CLONE ID no. 33498
  misc_feature (1)..(310): Also Known As Ceres CDNA ID no. 23376628
  misc_feature (1)..(310): Also Known As Ceres GEMINI ID 534C6
  misc_feature (126)..(143): Pfam Name: zf-CCHC Pfam Description: Zinc knuckle
  misc_feature (9)..(80): Pfam Name: RRM_1 Pfam Description: RNA recognition motif. (a.k.a. RRM RBD, or RNP domain)
  misc_feature 137819:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MAAKEGSRIFVGGLSPEVTDRDLERAFSRFGDILDCQIMLERDTGRSRGFAFITFADRRAMDESIREMHGRDFGDRVISVNRAEPKLGRDDGESHGSRGGRDSGYSIAGKGSFGGGGGGGGRVGEDECFKCGRVGHWARDCPSAGGGRGGPVGGFSSRASAYGGSDGRVDRYADRDRYVDRERYIDDRYDGAARYGARDRFDSREAYIPRDRYASDRYAAPADRFAGGDRYSRGSDRYPPGSYDKARSFERDIAPSAGSDRYGGGRAGGPIRGGGEEGRGFRSRAGAPYERPSRSGGGGAYPSSSTFDRY

SEQ ID NO: 1283 - DNA, 840 bp, Populus balsamifera subsp. trichocarpa
  misc_feature (1)..(840): Ceres ANNOT ID no. 1511064
  misc_feature 137905:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgtctggaaaggaagagaatcgaatatttgttggaggtttgtcatgggacatcactgaacgacagctcgaaaatgcgtttgatcgatttggaaaaatcgtcgagtgtcaggtgatgttggaaagagatacgggccgtccgcgtggatttggatttattacatttgcggatcgtcgagccatggacgacgctatcagggagatgcatggacgggactttggtgaccgtgtcatctcggtgaacaaggcccaacctaaaatgggaggggatgattcagatcatggctacagaggaggctactcgactggcagcagaggaggctatgggggaggagacaggcctgctggacaagatgagtgcttcaagtgtgggcgttcagggcattgggctagagattgcccttcagctggtgcccgaggtggcggtggaggtttattatcttcacgttctaggtttggaggagctggagatcgtggggatcgttttggtggagatcgtgatcgatacatggatgatcgctatgatggaggacgttatggtgacagggatcgttttgaaagtagagacaagtatggggggcgtgatcgctatgctagtgacaggtacccaccacccaatggagatcgatttgctggagataggtacagtgggtcagatcgctatgcacagaatggctatggcaaagacaggggctatgatagggatggtggtccacgagggggcaatgataggtatggaagtggagggccatcacgcaatgataggagctacaagaacaggccaggaccttatgaccgccctagcaggggaggacgcccatcttcctttgagcgctactaa

SEQ ID NO: 1284 - protein, 279 aa, Populus balsamifera subsp. trichocarpa
  misc_feature (1)..(279): Ceres ANNOT ID no. 1511064
  misc_feature (118)..(135): Pfam Name: zf-CCHC Pfam Description: Zinc knuckle
  misc_feature (9)..(80): Pfam Name: RRM_1 Pfam Description: RNA recognition motif. (a.k.a. RRM RBD, or RNP domain)
  misc_feature: SWISSPROT Homolog: GRP2_SINAL Glycine-rich RNA-binding protein GRP2A with e-value of 1.5e-30 and BLAST sequence identity of 44.1
  misc_feature: SWISSPROT Homolog: GRP8_ARATH Glycine-rich RNA-binding protein 8 (CCR1 protein) with e-value of 4.6e-30 and BLAST sequence identity of 44.7
  misc_feature: SWISSPROT Homolog: GRP1_SINAL Glycine-rich RNA-binding protein GRP1A with e-value of 1.1e-28 and BLAST sequence identity of 43.8
  misc_feature: SWISSPROT Homolog: GRP10_BRANA Glycine-rich RNA-binding protein 10 with e-value of 3.8e-28 and BLAST sequence identity of 44.7
  misc_feature: SWISSPROT Homolog: GRP7_ARATH Glycine-rich RNA-binding protein 7 with e-value of 1.0e-27 and BLAST sequence identity of 43.1
  misc_feature 138010:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(279): Functional Homolog of  Ceres CLONE ID no. 33498 at SEQ ID NO. 1323 with e-value of 3.39E-88 and BLAST sequence identity of 67.6
MSGKEENRIFVGGLSWDITERQLENAFDRFGKIVECQVMLERDTGRPRGFGFITFADRRAMDDAIREMHGRDFGDRVISVNKAQPKMGGDDSDHGYRGGYSTGSRGGYGGGDRPAGQDECFKCGRSGHWARDCPSAGARGGGGGLLSSRSRFGGAGDRGDRFGGDRDRYMDDRYDGGRYGDRDRFESRDKYGGRDRYASDRYPPPNGDRFAGDRYSGSDRYAQNGYGKDRGYDRDGGPRGGNDRYGSGGPSRNDRSYKNRPGPYDRPSRGGRPSSFERY

SEQ ID NO: 1285 - DNA, 843 bp, Populus balsamifera subsp. trichocarpa
  misc_feature (1)..(843): Ceres ANNOT ID no. 1518490
  misc_feature 138098:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggccggaaaggaagagaatcggatatttgtcggaggtttgtcatgggacatcactgaacggcagctcgagaatgcgtttgatcgctttggaaaaatcgttgagagtcaggtgatgttggaaagagatacaggccgtccacgtggatttggatttattacatttgcagatcgtcgagccatggacgatgctattagggagatgcatgggcgggactttggtgaccgtgtcatctcagtgaacaaggcccaacctaaaataggaggagatgattcagaccatggctacaggggaggctactcaactggaagcaggggaggctatgggggaggagacagacctgctggacaagatgagtgcttcaagtgtgggcgttcagggcattgggctagagattgcccttcagctggtggccgaggtggtggtggaggtttaatctcttcgcgttctaggtttggaggggctggagaccgtggggatcgttttggaggagatcgtgatcgatacatagatgaccgctatgatgggggacgctatggtgataaggatcgttttgacagtagagacaacaagtatgggggccgtgatcgttatgctagcgacaggtacccaccaaatggagatcgattttctggggataggtatggtgggtcagatcgctatgcacaaaatggttatggcaaagacaaaggctatgatagggatgttggtccacgagggggcaatgataggtatggaagtggagggcctcaacgcaatgataggagcagctacagaaacaggccagcaccttatgaccgccccagcagaggtggacacccgtcttcttttgagcgctactaa

SEQ ID NO: 1286 - protein, 280 aa, Populus balsamifera subsp. trichocarpa
  misc_feature (1)..(280): Ceres ANNOT ID no. 1518490
  misc_feature (118)..(135): Pfam Name: zf-CCHC Pfam Description: Zinc knuckle
  misc_feature (9)..(80): Pfam Name: RRM_1 Pfam Description: RNA recognition motif. (a.k.a. RRM RBD, or RNP domain)
  misc_feature: SWISSPROT Homolog: GRP2_SINAL Glycine-rich RNA-binding protein GRP2A with e-value of 1.5e-30 and BLAST sequence identity of 44.1
  misc_feature: SWISSPROT Homolog: GRP8_ARATH Glycine-rich RNA-binding protein 8 (CCR1 protein) with e-value of 4.6e-30 and BLAST sequence identity of 44.7
  misc_feature: SWISSPROT Homolog: GRP1_SINAL Glycine-rich RNA-binding protein GRP1A with e-value of 1.1e-28 and BLAST sequence identity of 43.8
  misc_feature: SWISSPROT Homolog: GRP10_BRANA Glycine-rich RNA-binding protein 10 with e-value of 3.8e-28 and BLAST sequence identity of 44.7
  misc_feature: SWISSPROT Homolog: GRP7_ARATH Glycine-rich RNA-binding protein 7 with e-value of 1.0e-27 and BLAST sequence identity of 43.1
  misc_feature 138203:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(280): Functional Homolog of  Ceres CLONE ID no. 33498 at SEQ ID NO. 1323 with e-value of 2.40E-87 and BLAST sequence identity of 66.6
MAGKEENRIFVGGLSWDITERQLENAFDRFGKIVESQVMLERDTGRPRGFGFITFADRRAMDDAIREMHGRDFGDRVISVNKAQPKIGGDDSDHGYRGGYSTGSRGGYGGGDRPAGQDECFKCGRSGHWARDCPSAGGRGGGGGLISSRSRFGGAGDRGDRFGGDRDRYIDDRYDGGRYGDKDRFDSRDNKYGGRDRYASDRYPPNGDRFSGDRYGGSDRYAQNGYGKDKGYDRDVGPRGGNDRYGSGGPQRNDRSSYRNRPAPYDRPSRGGHPSSFERY

SEQ ID NO: 1287 - protein, 289 aa, Arabidopsis thaliana
  misc_feature (1)..(289): Ceres CLONE ID no. 33554
  misc_feature (230)..(284): Pfam Name: XET_C Pfam Description: Xyloglucan endo-transglycosylase XET) C-terminus
  misc_feature (28)..(209): Pfam Name: Glyco_hydro_16 Pfam Description: Glycosyl hydrolases family 16
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
MGPSSSLTTIVATVLLVTLFGSAYASNFFDEFDLTWGDHRGKIFNGGNMLSLSLDQVSGSGFKSKKEYLFGRIDMQLKLVAGNSAGTVTAYYLSSQGATHDEIDFEFLGNETGKPYVLHTNVFAQGKGDREQQFYLWFDPTKNFHTYSIVWRPQHIIFLVDNLPIRVFNNAEKLGVPFPKSQPMRIYSSLWNADDWATRGGLVKTDWSKAPFTAYYRGFNAAACTASSGCDPKFKSSFGDGKLQVATELNAYGRRRLRWVQKYFMIYNYCSDLKRFPRGFPPECKKSRV

SEQ ID NO: 1288 - DNA, 867 bp, Populus balsamifera subsp. trichocarpa
  misc_feature (1)..(867): Ceres ANNOT ID no. 1445599
  misc_feature 138397:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atggggctgttctgcaatggattctctctgtttctgatagtttgctccatggtggtggttgcttctggtagtttctatcaggattttgacttgacatggggcgaccaccgggcaaagatattcaacggaggacagctcctctccctgtctctagacaaggtttctgggtctggatttcagtccaagaaggaatacttgtttgggaggattgatatgcagctcaaacttgttgccggcaactctgctggcactgtaacagcctactacttgtcttctcaaggagcaacacatgacgagatcgacttcgagttcttggggaacctcagcggcgacccttacattttgcacactaatgtgttcactcaggggaagggaaacagagagcagcaattctatctctggtttgaccccacaagaaacttccacacttactccatcatctggagccaacaacacatcattttcttggtggataattttcccataagggtgttcaagaatgccgaatcaattggagttcctttccccaagagccagcccatgaggatttactccagcctctggaacgccgatgactgggctacaagaggcgggttggtgaagacggactggacgaaggcaccctttacagcttactacagaaacttcaaagctgatgcctgtacttggtcctatggcacttcttcctgtggttccaggtcttccagttctttctctgatcgtgcatggcataccaacgccctcgatgctccaagcagaagaagactgagatgggtccagaaatacttcatgatttacaactactgcgctgacctaaaacgcttccctcaaggtctccctcctgagtgcagacgctcaagattctga

SEQ ID NO: 1289 - protein, 288 aa, Populus balsamifera subsp. trichocarpa
  misc_feature (1)..(288): Ceres ANNOT ID no. 1445599
  misc_feature (230)..(283): Pfam Name: XET_C Pfam Description: Xyloglucan endo-transglycosylase XET) C-terminus
  misc_feature (25)..(206): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 138518:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(288): Functional Homolog of  Ceres CLONE ID no. 33554 at SEQ ID NO. 1328 with e-value of 1.20E-117 and BLAST sequence identity of 78.2
MGLFCNGFSLFLIVCSMVVVASGSFYQDFDLTWGDHRAKIFNGGQLLSLSLDKVSGSGFQSKKEYLFGRIDMQLKLVAGNSAGTVTAYYLSSQGATHDEIDFEFLGNLSGDPYILHTNVFTQGKGNREQQFYLWFDPTRNFHTYSIIWSQQHIIFLVDNFPIRVFKNAESIGVPFPKSQPMRIYSSLWNADDWATRGGLVKTDWTKAPFTAYYRNFKADACTWSYGTSSCGSRSSSSFSDRAWHTNALDAPSRRRLRWVQKYFMIYNYCADLKRFPQGLPPECRRSRF

SEQ ID NO: 1290 - DNA, 807 bp, Populus balsamifera subsp. trichocarpa
  misc_feature (1)..(807): Ceres ANNOT ID no. 1471882
  misc_feature 138622:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atggcggtggttgcttcaggcaacttctatcaggattttgacttaacatggggtgaccgacgtgcaaagatattcaacggaggacagcttctgtctttgtctctagacaaggtttctgggtctggatttcagtccaagaaggagtacttgttcgggaggattgatatgcagctcaaacttgtcgctggcaactctgctggcactgtaacagcctactatttgtcttcgcaaggaccaacgcatgacgagatcgacttcgagttcttgggaaaccttagtggcgacccttatattttgcacactaacgtattcactcaggggaagggaaacagagagcagcaattctatctctggtttgaccccacgaggaacttccacacttactccatcatctggaatcctcagcacatcatcttcttggtggacagtattcccatcagggtgttcaaaaatgctgaatcaattggagttccatttcccaagagccaacccatgaggatttactctagcctctggaatgctgatgactgggctacaagaggtggattggtcaaaactgactggactaaggcgcccttcaccgcatactatagaaacttcaaggccaatgcctgtacttggtcttacggtacttcttcttgtggttccaagccttccagcgctttctctgacggtgcatggaaaaccaatgagcttgatgctccaagtagaagaagactgagatgggttcagaaatatttcatgatttacaactactgcactgacctgagacgcttccctcagggtccccctcctgagtgcaaatag

SEQ ID NO: 1291 - protein, 268 aa, Populus balsamifera subsp. trichocarpa
  misc_feature (1)..(268): Ceres ANNOT ID no. 1471882
  misc_feature (214)..(267): Pfam Name: XET_C Pfam Description: Xyloglucan endo-transglycosylase XET) C-terminus
  misc_feature (9)..(190): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 138741:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(268): Functional Homolog of  Ceres CLONE ID no. 33554 at SEQ ID NO. 1328 with e-value of 6.49E-117 and BLAST sequence identity of 80.7
MAVVASGNFYQDFDLTWGDRRAKIFNGGQLLSLSLDKVSGSGFQSKKEYLFGRIDMQLKLVAGNSAGTVTAYYLSSQGPTHDEIDFEFLGNLSGDPYILHTNVFTQGKGNREQQFYLWFDPTRNFHTYSIIWNPQHIIFLVDSIPIRVFKNAESIGVPFPKSQPMRIYSSLWNADDWATRGGLVKTDWTKAPFTAYYRNFKANACTWSYGTSSCGSKPSSAFSDGAWKTNELDAPSRRRLRWVQKYFMIYNYCTDLRRFPQGPPPECK

SEQ ID NO: 1292 - DNA, 885 bp, Populus balsamifera subsp. trichocarpa
  misc_feature (1)..(885): Ceres ANNOT ID no. 1452398
  misc_feature 138839:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtcattctcttgtcctagtaaacttccctcgacgcttctgtttgcttcattacttgcttgtctactgggagcctccatgggtggcaatttcttccaagattttgacatcacctggggcgatcaacgtgctaagatactaaatggtggccaacttctcacactatctcttgacaaggattctggttctggcttccgatccaagaatgagtacttgtttggccgaatcgacatgcaaatcaagctagtatcgggcaactcggctggcactgtcaccacatactatctatcttctcaagggccgacccacgacgagattgacttcgagtttctaggcaatgtaactggagaaccatatactctccataccaatgtgttctcccaagggaaaggcaacaaagaacagcagttttatctctggtttgatcccacaaaggctttccacacctactctattgtgtggaaccaacaacgaataattttcttggtggacaacatccccataagagtattccacaactcggaatcaatcggagtgccgttcccgacgaagcaacccatgaggatatattcgagtctctggaatgctgatgattgggcaacgagaggggggcttgtgaagactgactggacacaagctcctttcactgcttcttacagaaatttcaaagccagtgcttgtgtttcgtcacctggatcatcttgcacctccacctcccccaattccttgcaggacagtacctggcaagttcaagctcttgatgcctccggccgcaacaggcttcgatgggtgcagcagaagtacatgatttacaactactgcactgacttgaaacgattccctcagggtatcccagctgaatgcaagcgatcaagattcctttga

SEQ ID NO: 1293 - protein, 294 aa, Populus balsamifera subsp. trichocarpa
  misc_feature (1)..(294): Ceres ANNOT ID no. 1452398
  misc_feature (235)..(288): Pfam Name: XET_C Pfam Description: Xyloglucan endo-transglycosylase XET) C-terminus
  misc_feature (31)..(212): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 138960:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(294): Functional Homolog of  Ceres CLONE ID no. 33554 at SEQ ID NO. 1328 with e-value of 3.49E-111 and BLAST sequence identity of 70.5
MSFSCPSKLPSTLLFASLLACLLGASMGGNFFQDFDITWGDQRAKILNGGQLLTLSLDKDSGSGFRSKNEYLFGRIDMQIKLVSGNSAGTVTTYYLSSQGPTHDEIDFEFLGNVTGEPYTLHTNVFSQGKGNKEQQFYLWFDPTKAFHTYSIVWNQQRIIFLVDNIPIRVFHNSESIGVPFPTKQPMRIYSSLWNADDWATRGGLVKTDWTQAPFTASYRNFKASACVSSPGSSCTSTSPNSLQDSTWQVQALDASGRNRLRWVQQKYMIYNYCTDLKRFPQGIPAECKRSRFL

SEQ ID NO: 1294 - DNA, 885 bp, Populus balsamifera subsp. trichocarpa
  misc_feature (1)..(885): Ceres ANNOT ID no. 1443041
  misc_feature 139064:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtcgttcgttcgttcgagaaagctttcttcaatgcttttgtttactctgttatttgcctgtctgatgggagcctccaagggtggcaatttcttccaagattttgacatcacctggggcgatcaacgtgctaagatactaaacggtggccaacttctcacactctctctcgacaaggcttctggttctggctttcaatccaagaatgaatacttatttggccaaatcgacatgcaaatcaagctagtagcaggcaactcggctggtactgtcactgcatactatctatcttctcaagggtcgacccacgatgagattgactttgagtttttggggaatgcaactggagagccatatattctccataccaatgtgttctcccaggggaaaggcaacagagaacaacaattctatctctggtttgatcccactaaggctttccacacctactccattgtgtggaaccaacaacgcattattttcttagtggacaacatcccaataagagtgttccataatctggaatcaatcggtgtgccattcccgaacaagcaagccatgaggatacattcaagtctctggaatgctgatgattgggcaacaagaggggggcttgtaaagactgactggacacaagctcctttcactgcttcttacagaaatttcaaagccaatgcttgtatttggtcatctacatcaccttgtacctccacctctcccaattctgtgcaagacaatgcctggcaagttcaagcacttgatgccccggggcgcaacagacttcgatgggtgcaacaaaagtacatgatttacaactactgcactgacttgaagcggttccctcagggtctcccacctgaatgcaagcgatcaagatttctttga

SEQ ID NO: 1295 - protein, 283 aa, Populus balsamifera subsp. trichocarpa
  misc_feature (1)..(283): Ceres ANNOT ID no. 1443041
  misc_feature (20)..(201): Pfam Name: Glyco_hydro_16 Pfam Description: Glycosyl hydrolases family 16
  misc_feature (224)..(277): Pfam Name: XET_C Pfam Description: Xyloglucan endo-transglycosylase XET) C-terminus
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 139185:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(283): Functional Homolog of  Ceres CLONE ID no. 33554 at SEQ ID NO. 1328 with e-value of 5.09E-110 and BLAST sequence identity of 71.2
MLLFTLLFACLMGASKGGNFFQDFDITWGDQRAKILNGGQLLTLSLDKASGSGFQSKNEYLFGQIDMQIKLVAGNSAGTVTAYYLSSQGSTHDEIDFEFLGNATGEPYILHTNVFSQGKGNREQQFYLWFDPTKAFHTYSIVWNQQRIIFLVDNIPIRVFHNLESIGVPFPNKQAMRIHSSLWNADDWATRGGLVKTDWTQAPFTASYRNFKANACIWSSTSPCTSTSPNSVQDNAWQVQALDAPGRNRLRWVQQKYMIYNYCTDLKRFPQGLPPECKRSRFL

SEQ ID NO: 1296 - DNA, 885 bp, Populus balsamifera subsp. trichocarpa
  misc_feature (1)..(885): Ceres ANNOT ID no. 1452397
  misc_feature 139286:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtctttctcttgttcgagtagactttcttccatgcctttgtttgctctgttaattgcttgtctagtgggagcctccatgggtggcaatttcttccaagattttgacatcacctggggcgatcaacgtgctaagatactaaatggtggccaacttctcacactatctcttgacaaggattctggttctggcttccgatccaagaatgagtacttgtttggccgaatcgacatgcaaatcaagctagtatcgggcaactcggctggcactgtcaccacatactatctatcttctcaagggccgacccacgacgagattgacttcgagtttctaggcaatttaactggagaaccatatactctccataccaatgtgttctcccaagggaaaggcaacaaagaacagcagttttatctctggtttgatcccacaaaggctttccacacctactctattgtgtggaaccaacaacaaataattttcttggtggacaacatccccataagagtattccacaactcggaatcaatcggagtgccgttcccgacgaagcaacccatgaggatatattcgagtctctggaatgctgatgattgggcaacgagaggggggcttgtgaagactgactggacacaagctcctttcactgcttcttacagaaatttcaaagccagtgcttgtgtttcgtcacctggatcatcttgcacctccacctcccccaattccttgcaggacagtacctggcaagttcaaggtcttgatgcctccggccgcaacaggcttcgatgggtgcagcagaagtacatgatttacaactactgcactgacttgaaacgattccctcagggtatcccagctgaatgcaagcgatcaagattcctttga

SEQ ID NO: 1297 - protein, 294 aa, Populus balsamifera subsp. trichocarpa
  misc_feature (1)..(294): Ceres ANNOT ID no. 1452397
  misc_feature (235)..(288): Pfam Name: XET_C Pfam Description: Xyloglucan endo-transglycosylase XET) C-terminus
  misc_feature (31)..(212): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 139407:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(294): Functional Homolog of  Ceres CLONE ID no. 33554 at SEQ ID NO. 1328 with e-value of 5.09E-110 and BLAST sequence identity of 70.7
MSFSCSSRLSSMPLFALLIACLVGASMGGNFFQDFDITWGDQRAKILNGGQLLTLSLDKDSGSGFRSKNEYLFGRIDMQIKLVSGNSAGTVTTYYLSSQGPTHDEIDFEFLGNLTGEPYTLHTNVFSQGKGNKEQQFYLWFDPTKAFHTYSIVWNQQQIIFLVDNIPIRVFHNSESIGVPFPTKQPMRIYSSLWNADDWATRGGLVKTDWTQAPFTASYRNFKASACVSSPGSSCTSTSPNSLQDSTWQVQGLDASGRNRLRWVQQKYMIYNYCTDLKRFPQGIPAECKRSRFL

SEQ ID NO: 1298 - DNA, 864 bp, Populus balsamifera subsp. trichocarpa
  misc_feature (1)..(864): Ceres ANNOT ID no. 1505498
  misc_feature 139511:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtcattctcttgtcctagtaaacttccctcgacgcttctgtttgcttcattacttgcttgtctactgggagcctccatgggtggcaatttcttccaagattttgacatcacctggggcgatcaacgtgctaagatactaaatggtggccaacttctcacactatctcttgacaaggattctggttctggcttccgatccaagaatgagtacttgtttggccgaatcgacatgcaaatcaagctagtatcgggcaactcggctggcactgtcaccacatactatctatcttctcaagggccgacccacgacgagattgacttcgagtttctaggcaatgtaactggagaaccatatactctccataccaatgtgttctcccaagggaaaggcaacaaagaacagcagttttatctctggtttgatcccacaaaggctttccacacctactctattgttttcttggtggacaacatccccataagagtattccacaactcggaatcaatcggagtgccgttcccgacgaagcaacccatgaggatatattcgagtctctggaatgctgatgattgggcaacgagaggggggcttgtgaagactgactggacacaagctcctttcactgcttcttacagaaatttcaaagccagtgcttgtgtttcgtcacctggatcatcttgcacctccacctcccccaattccttgcaggacagtacctggcaagttcaagctcttgatgcctccggccgcaacaggcttcgatgggtgcagcagaagtacatgatttacaactactgcactgacttgaaacgattccctcagggtatcccagctgaatgcaagcgatcaagattcctttga

SEQ ID NO: 1299 - protein, 287 aa, Populus balsamifera subsp. trichocarpa
  misc_feature (1)..(287): Ceres ANNOT ID no. 1505498
  misc_feature (228)..(281): Pfam Name: XET_C Pfam Description: Xyloglucan endo-transglycosylase XET) C-terminus
  misc_feature (31)..(205): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 139632:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(287): Functional Homolog of  Ceres CLONE ID no. 33554 at SEQ ID NO. 1328 with e-value of 1.60E-106 and BLAST sequence identity of 70.8
MSFSCPSKLPSTLLFASLLACLLGASMGGNFFQDFDITWGDQRAKILNGGQLLTLSLDKDSGSGFRSKNEYLFGRIDMQIKLVSGNSAGTVTTYYLSSQGPTHDEIDFEFLGNVTGEPYTLHTNVFSQGKGNKEQQFYLWFDPTKAFHTYSIVFLVDNIPIRVFHNSESIGVPFPTKQPMRIYSSLWNADDWATRGGLVKTDWTQAPFTASYRNFKASACVSSPGSSCTSTSPNSLQDSTWQVQALDASGRNRLRWVQQKYMIYNYCTDLKRFPQGIPAECKRSRFL

SEQ ID NO: 1300 - DNA, 864 bp, Populus balsamifera subsp. trichocarpa
  misc_feature (1)..(864): Ceres ANNOT ID no. 1505497
  misc_feature 139733:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtctttctcttgttcgagtagactttcttccatgcctttgtttgctctgttaattgcttgtctagtgggagcctccatgggtggcaatttcttccaagattttgacatcacctggggcgatcaacgtgctaagatactaaatggtggccaacttctcacactatctcttgacaaggattctggttctggcttccgatccaagaatgagtacttgtttggccgaatcgacatgcaaatcaagctagtatcgggcaactcggctggcactgtcaccacatactatctatcttctcaagggccgacccacgacgagattgacttcgagtttctaggcaatttaactggagaaccatatactctccataccaatgtgttctcccaagggaaaggcaacaaagaacagcagttttatctctggtttgatcccacaaaggctttccacacctactctattgttttcttggtggacaacatccccataagagtattccacaactcggaatcaatcggagtgccgttcccgacgaagcaacccatgaggatatattcgagtctctggaatgctgatgattgggcaacgagaggggggcttgtgaagactgactggacacaagctcctttcactgcttcttacagaaatttcaaagccagtgcttgtgtttcgtcacctggatcatcttgcacctccacctcccccaattccttgcaggacagtacctggcaagttcaaggtcttgatgcctccggccgcaacaggcttcgatgggtgcagcagaagtacatgatttacaactactgcactgacttgaaacgattccctcagggtatcccagctgaatgcaagcgatcaagattcctttga

SEQ ID NO: 1301 - protein, 287 aa, Populus balsamifera subsp. trichocarpa
  misc_feature (1)..(287): Ceres ANNOT ID no. 1505497
  misc_feature (228)..(281): Pfam Name: XET_C Pfam Description: Xyloglucan endo-transglycosylase XET) C-terminus
  misc_feature (31)..(205): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 139854:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(287): Functional Homolog of  Ceres CLONE ID no. 33554 at SEQ ID NO. 1328 with e-value of 2.29E-105 and BLAST sequence identity of 71.1
MSFSCSSRLSSMPLFALLIACLVGASMGGNFFQDFDITWGDQRAKILNGGQLLTLSLDKDSGSGFRSKNEYLFGRIDMQIKLVSGNSAGTVTTYYLSSQGPTHDEIDFEFLGNLTGEPYTLHTNVFSQGKGNKEQQFYLWFDPTKAFHTYSIVFLVDNIPIRVFHNSESIGVPFPTKQPMRIYSSLWNADDWATRGGLVKTDWTQAPFTASYRNFKASACVSSPGSSCTSTSPNSLQDSTWQVQGLDASGRNRLRWVQQKYMIYNYCTDLKRFPQGIPAECKRSRFL

SEQ ID NO: 1302 - DNA, 819 bp, Populus balsamifera subsp. trichocarpa
  misc_feature (1)..(819): Ceres ANNOT ID no. 1443040
  misc_feature 139955:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtcattctcttgtcccagatcctcaaaaggtggcaatttcttccaagattttgacatcacctggggcgatcaacgtgctaagatactaaacggtggccaacttctcacactatctcttgacactgcttctggttctggcttccaatccaagaatgaatacttatttggccgaatcgacatgcaaatcaagctaataccaggcaactcggctggtactgtcactacatactatctatcgtctcaggggccgacccacgatgagatcgactttgagtttttgggcaatgcaactggagagccatatgttctccataccaatgtgttttcccaggggaaaggcgacagagaacaacaattctatctctggtttgatcccagtaaggcttttcacacctactccattgtgtggaacaaacaactcattattttcttagtggacaacatcccaataagagtgttccaaaacctggaatcaattggtgtggcattcccgaacaagcaagccatgaggatatattcaagtctttggaatgctgatgactgggcaacaagaggggggcttgtaaagactgattggacacaagctcctttcattgcttcttacagaaatttcaaagccaatgcttgtgtttggtcacctggatcaccttgtacctccacctctcccaattctgtgcaagacaatgcctggcaagttcaagcacttgatgccccggggcgcaacagacttcgatgggtgcagcagaagtacatgatttacaactactgcactgacttgaaacggttccctcagggtctcccacctgaatgcaagtga

SEQ ID NO: 1303 - protein, 272 aa, Populus balsamifera subsp. trichocarpa
  misc_feature (1)..(272): Ceres ANNOT ID no. 1443040
  misc_feature (14)..(195): Pfam Name: Glyco_hydro_16 Pfam Description: Glycosyl hydrolases family 16
  misc_feature (218)..(271): Pfam Name: XET_C Pfam Description: Xyloglucan endo-transglycosylase XET) C-terminus
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 140074:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(272): Functional Homolog of  Ceres CLONE ID no. 33554 at SEQ ID NO. 1328 with e-value of 6.19E-105 and BLAST sequence identity of 73.0
MSFSCPRSSKGGNFFQDFDITWGDQRAKILNGGQLLTLSLDTASGSGFQSKNEYLFGRIDMQIKLIPGNSAGTVTTYYLSSQGPTHDEIDFEFLGNATGEPYVLHTNVFSQGKGDREQQFYLWFDPSKAFHTYSIVWNKQLIIFLVDNIPIRVFQNLESIGVAFPNKQAMRIYSSLWNADDWATRGGLVKTDWTQAPFIASYRNFKANACVWSPGSPCTSTSPNSVQDNAWQVQALDAPGRNRLRWVQQKYMIYNYCTDLKRFPQGLPPECK

SEQ ID NO: 1304 - DNA, 807 bp, Populus balsamifera subsp. trichocarpa
  misc_feature (1)..(807): Ceres ANNOT ID no. 1495964
  misc_feature 140175:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgtcattctcttgtcccagatcctcaaaaggtggcaatttcttccaagattttgacatcacctggggcgatcaacgtgctaagatactaaacggtggccaacttctcacactatctcttgacactgcttctggttctggcttccaatccaagaatgaatacttatttggccgaatcgacatgcaaatcaagctaataccaggcaactcggctggtactgtcactacatactatgggccgacccacgatgagatcgactttgagtttttgggcaatgcaactggagagccatatgttctccataccaatgtgttttcccaggggaaaggcgacagagaacaacaattctatctctggtttgatcccagtaaggcttttcacacctactccattgtgtggaacaaacaactcattattttcttagtggacaacatcccaataagagtgttccaaaacctggaatcaattggtgtggcattcccgaacaagcaagccatgaggatatattcaagtctttggaatgctgatgactgggcaacaagaggggggcttgtaaagactgattggacacaagctcctttcattgcttcttacagaaatttcaaagccaatgcttgtgtttggtcacctggatcaccttgtacctccacctctcccaattctgtgcaagacaatgcctggcaagttcaagcacttgatgccccggggcgcaacagacttcgatgggtgcagcagaagtacatgatttacaactactgcactgacttgaaacggttccctcagggtctcccacctgaatgcaagtga

SEQ ID NO: 1305 - protein, 268 aa, Populus balsamifera subsp. trichocarpa
  misc_feature (1)..(268): Ceres ANNOT ID no. 1495964
  misc_feature (14)..(191): Pfam Name: Glyco_hydro_16 Pfam Description: Glycosyl hydrolases family 16
  misc_feature (214)..(267): Pfam Name: XET_C Pfam Description: Xyloglucan endo-transglycosylase XET) C-terminus
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 140294:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(268): Functional Homolog of  Ceres CLONE ID no. 33554 at SEQ ID NO. 1328 with e-value of 1.50E-101 and BLAST sequence identity of 72.5
MSFSCPRSSKGGNFFQDFDITWGDQRAKILNGGQLLTLSLDTASGSGFQSKNEYLFGRIDMQIKLIPGNSAGTVTTYYGPTHDEIDFEFLGNATGEPYVLHTNVFSQGKGDREQQFYLWFDPSKAFHTYSIVWNKQLIIFLVDNIPIRVFQNLESIGVAFPNKQAMRIYSSLWNADDWATRGGLVKTDWTQAPFIASYRNFKANACVWSPGSPCTSTSPNSVQDNAWQVQALDAPGRNRLRWVQQKYMIYNYCTDLKRFPQGLPPECK

SEQ ID NO: 1306 - DNA, 807 bp, Populus balsamifera subsp. trichocarpa
  misc_feature (1)..(807): Ceres ANNOT ID no. 1498580
  misc_feature 140392:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atggggctgttctgcaatggattctctctgtttctgatagtttgctccatggtggtggttgcttctggtagtttctatcaggattttgacttgacatggggcgaccaccgggcaaagatattcaacggaggacagctcctctccctgtctctagacaaggtttctgggtctggatttcagtccaagaaggaatacttgtttgggaggattgatatgcagctcaaacttgttgccggcaactctgctggcactgtaacagcctactacttgtcttctcaaggagcaacacatgacgagatcgacttcgagttcttggggaacctcagcggcgacccttacattttgcacactaatgtgttcactcaggggaagggaaacagagagcagcaattctatctctgtttcttggtggataattttcccataagggtgttcaagaatgccgaatcaattggagttcctttccccaagagccagcccatgaggatttactccagcctctggaacgccgatgactgggctacaagaggcgggttggtgaagacggactggacgaaggcaccctttacagcttactacagaaacttcaaagctgatgcctgtacttggtcctatggcacttcttcctgtggttccaggtcttccagttctttctctgatcgtgcatggcataccaacgccctcgatgctccaagcagaagaagactgagatgggtccagaaatacttcatgatttacaactactgcgctgacctaaaacgcttccctcaaggtctccctcctgagtgcagacgctcaagattctga

SEQ ID NO: 1307 - protein, 268 aa, Populus balsamifera subsp. trichocarpa
  misc_feature (1)..(268): Ceres ANNOT ID no. 1498580
  misc_feature (210)..(263): Pfam Name: XET_C Pfam Description: Xyloglucan endo-transglycosylase XET) C-terminus
  misc_feature (25)..(186): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 140511:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(268): Functional Homolog of  Ceres CLONE ID no. 33554 at SEQ ID NO. 1328 with e-value of 6.60E-101 and BLAST sequence identity of 77.7
MGLFCNGFSLFLIVCSMVVVASGSFYQDFDLTWGDHRAKIFNGGQLLSLSLDKVSGSGFQSKKEYLFGRIDMQLKLVAGNSAGTVTAYYLSSQGATHDEIDFEFLGNLSGDPYILHTNVFTQGKGNREQQFYLCFLVDNFPIRVFKNAESIGVPFPKSQPMRIYSSLWNADDWATRGGLVKTDWTKAPFTAYYRNFKADACTWSYGTSSCGSRSSSSFSDRAWHTNALDAPSRRRLRWVQKYFMIYNYCADLKRFPQGLPPECRRSRF

SEQ ID NO: 1308 - DNA, 819 bp, Populus balsamifera subsp. trichocarpa
  misc_feature (1)..(819): Ceres ANNOT ID no. 1466060
  misc_feature 140609:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atggctgcttcagctggtaatttcaatcaagaagttgacctaacatggggtggtgatcgtgctaagatactcagtggaggaagcgttctgtctcttacacttgataaggtctccggctctggctttcaatccaagagcgagtatctcttcggaaggatagatatgcagatcaagcttgttggtggtaactctgctggttctgtcactgcttactatttatcctcagaagggccataccatgatgaaattgattttgagttcttagggaaccttagcggagaaccctatactgttcacactaatgtgtacactcaagggaaaggggatagggaacaacagttccacctttggtttgatccaacaaaagattttcacttgtattctgttgtatggaaccaccaacgtatcattttcttagtggatgacacgcctataagagtgtacgaaaatcaagaatccattggagttcccttcccgaagaaccaaccgatgaaactttactccagcctatggaatgctgatcaatgggcgacaagaggtggactagtgaaagcagattggtctaaggcacctttcacagcatactacaggaatttcaaagccaacgcgtgcttatggtcttcaggatcgtcttcttgttcattgaagactactagctccagcacaaacaatgcttggcagactcaaggtctggattcgactagtcgtagaagccttagatgggtgcaaaaatactacatgatttacaattattgcacggattataagagatttcctatgggtcgcccgcgtgagtgcaggctttctaagcatttttag

SEQ ID NO: 1309 - protein, 272 aa, Populus balsamifera subsp. trichocarpa
  misc_feature (1)..(272): Ceres ANNOT ID no. 1466060
  misc_feature (213)..(266): Pfam Name: XET_C Pfam Description: Xyloglucan endo-transglycosylase XET) C-terminus
  misc_feature (8)..(189): Pfam Name: Glyco_hydro_16 Pfam Description: Glycosyl hydrolases family 16
  misc_feature: SWISSPROT Homolog: XTH15_ARATH Probable xyloglucan endotransglucosylase/hydrolase protein 15 precursor (EC 2.4.1.207) (At-XTH15) (XTH-15) with e-value of 4.4e-160 and BLAST sequence identity of 100.0
  misc_feature: SWISSPROT Homolog: XTH16_ARATH Probable xyloglucan endotransglucosylase/hydrolase protein 16 precursor (EC 2.4.1.207) (At-XTH16) (XTH-16) with e-value of 1.1e-138 and BLAST sequence identity of 86.3
  misc_feature: SWISSPROT Homolog: BRU1_SOYBN Brassinosteroid-regulated protein BRU1 precursor with e-value of 4.3e-114 and BLAST sequence identity of 73.4
  misc_feature: SWISSPROT Homolog: XTH25_ARATH Probable xyloglucan endotransglucosylase/hydrolase protein 25 precursor (EC 2.4.1.207) (At-XTH25) (XTH-25) with e-value of 3.9e-97 and BLAST sequence identity of 63.5
  misc_feature: SWISSPROT Homolog: XTH23_ARATH Probable xyloglucan endotransglucosylase/hydrolase protein 23 precursor (EC 2.4.1.207) (At-XTH23) (XTH-23) with e-value of 7.3e-96 and BLAST sequence identity of 63.5
  misc_feature 140728:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(272): Functional Homolog of  Ceres CLONE ID no. 33554 at SEQ ID NO. 1328 with e-value of 1.40E-100 and BLAST sequence identity of 69.5
MAASAGNFNQEVDLTWGGDRAKILSGGSVLSLTLDKVSGSGFQSKSEYLFGRIDMQIKLVGGNSAGSVTAYYLSSEGPYHDEIDFEFLGNLSGEPYTVHTNVYTQGKGDREQQFHLWFDPTKDFHLYSVVWNHQRIIFLVDDTPIRVYENQESIGVPFPKNQPMKLYSSLWNADQWATRGGLVKADWSKAPFTAYYRNFKANACLWSSGSSSCSLKTTSSSTNNAWQTQGLDSTSRRSLRWVQKYYMIYNYCTDYKRFPMGRPRECRLSKHF

SEQ ID NO: 1310 - protein, 524 aa, Arabidopsis thaliana
  misc_feature (1)..(524): Ceres CLONE ID no. 33559
  misc_feature (36)..(515): Pfam Name: Glyco_hydro_1 Pfam Description: Glycosyl hydrolase family 1
  misc_feature: Utility: Cold Germination Useful for making plants with increased tolerance to cold stress
  misc_feature: Utility: Cold Growth Useful for making plants with increased tolerance to cold stress
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
MVLQKLPLIGLLLLLTIVASPANADGPVCPPSNKLSRASFPEGFLFGTATAAYQVEGAINETCRGPALWDIYCRRYPERCNNDNGDVAVDFFHRYKEDIQLMKNLNTDAFRMSIAWPRIFPHGRKEKGVSQAGVQFYHDLIDELIKNGITPFVTVFHWDTPQDLEDEYGGFLSERIVKDFREYADFVFQEYGGKVKHWITFNEPWVFSHAGYDVGKKAPGRCSSYVNAKCQDGRSGYEAYLVTHNLLISHAEAVEAYRKCEKCKGGKIGIAHSPAWFEAHDLADSQDGASIDRALDFILGWHLDTTTFGDYPQIMKDIVGHRLPKFTTEQKAKLKASTDFVGLNYYTSVFSNHLEKPDPSKPRWMQDSLITWESKNAQNYAIGSKPLTAALNVYSRGFRSLLKYIKDKYANPEIMIMENGYGEELGASDSVAVGTADHNRKYYLQRHLLSMQEAVCIDKVNVTGYFVWSLLDNFEWQDGYKNRFGLYYVDFKNNLTRYEKESGKYYKDFLSQGVRPSALKKDEL

SEQ ID NO: 1311 - DNA, 1560 bp, Populus balsamifera subsp. trichocarpa
  misc_feature (1)..(1560): Ceres ANNOT ID no. 1481146
  misc_feature: Utility: Cold Germination Useful for making plants with increased tolerance to cold stress
  misc_feature: Utility: Cold Growth Useful for making plants with increased tolerance to cold stress
  misc_feature 141022:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgggaagcattgatgacttcagccgttattctttcccagatgattttgttttcggaacatcctcatcagcttaccagtatgaaggtgaaacaaacaaacatggtagaggaccagctatatgggacactttcactgaggaacatacagagagaataaatgatcatagcaacggaaatgtagctgttgatttctaccatcgctataaggaagatgtgcaaagaatgaaagaaatgggaatggatgctttcagattctccatttcttggtctagagtatttccacatggcaggttaagtgctggagtaaacgaagaaggcatcaagttttacaacgatctcattgatgacctccttaagaatggtttgcagccttacgttactctctttcactgggatactccacaagctttagaagataaatatggtggtttcttaagtcctaacattgtaaatgatttccgagactttgtcgacctttgtttccaaaagtttggagaccgagtgaagaagtggattactttgaacgagccatggatgttcagtgttcaaggttatgacatgggcacgatggcaccgggtaggatttctgtcgttgtaaatgatccccaccgatccttaaacactggtgccactgaagtgtatacggttagccatcatttgttgctcgctcatgctgcggcagtgaaactatacaaggaaaaatatcagtcatgtcaaggtggacagattgggataacacttgtttctcattggtttgaaccttactcaaacagtgaagatgatcaaaatgcaaccaaaagaagcatcgacttcatgcttggttggttcatggatcctttaactaatggtgactatccacgtaacatgcatgattttgttggtggaagattgcccaagttcactgccgaggaatctaagatgttgaagggatcgtatgattttattggaattaattactacacaacatattatgctcaaaatatcgatgcaaattatcagagtgttggattcatgtcagatgctcgtgctaattggacaggagagagaaatggaatcccaataggtccacaggctggtgtaaaatggctttatatttatcccgaaggcatcagcaggcttttgaattacaccaaagatctatacgggaacccaacaatttacattactgagaatggggttgatgacgaaaataacaatgcttcatcactaaaggaagctcttaatgatcccataagagaaaaatcttacaaagaccaccttaagaatgtcttgagatccatcaatgagcatggtgttgatgttaagggattttttgcttggtctttaatggacaatttcgaatggggaagtggttatgctgtgaggttcggcctctactatgttgattacaaaaatgatttgaaacgatatcctaaaaaatcagtcaagtggttcaagcagtttcttagaagagactcccacagtcctattccacatacgtatcctctgattacttctaatgaaacgtcgaagattgaagatagtttggttcgggatgctaaaaggccaagaaatgcctga

SEQ ID NO: 1312 - protein, 519 aa, Populus balsamifera subsp. trichocarpa
  misc_feature (1)..(519): Ceres ANNOT ID no. 1481146
  misc_feature (8)..(487): Pfam Name: Glyco_hydro_1 Pfam Description: Glycosyl hydrolase family 1
  misc_feature: SWISSPROT Homolog: BGL1_ARATH Beta-glucosidase homolog precursor (EC 3.2.1.-) with e-value of 4.1e-205 and BLAST sequence identity of 67.9
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 2.5e-102 and BLAST sequence identity of 41.7
  misc_feature: SWISSPROT Homolog: MYRO_BRANA Myrosinase precursor (EC 3.2.1.147) (Sinigrinase) (Thioglucosidase) with e-value of 6.6e-102 and BLAST sequence identity of 39.6
  misc_feature: SWISSPROT Homolog: MYR3_SINAL Myrosinase MB3 precursor (EC 3.2.1.147) (Sinigrinase) (Thioglucosidase) with e-value of 4.2e-100 and BLAST sequence identity of 40.4
  misc_feature: SWISSPROT Homolog: MYRO_ARATH Myrosinase precursor (EC 3.2.1.147) (Sinigrinase) (Thioglucosidase) with e-value of 5.5e-98 and BLAST sequence identity of 40.0
  misc_feature: Utility: Cold Germination Useful for making plants with increased tolerance to cold stress
  misc_feature: Utility: Cold Growth Useful for making plants with increased tolerance to cold stress
  misc_feature 141201:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(519): Functional Homolog of  Ceres CLONE ID no. 33559 at SEQ ID NO. 1351 with e-value of 8.19E-126 and BLAST sequence identity of 49.3
MGSIDDFSRYSFPDDFVFGTSSSAYQYEGETNKHGRGPAIWDTFTEEHTERINDHSNGNVAVDFYHRYKEDVQRMKEMGMDAFRFSISWSRVFPHGRLSAGVNEEGIKFYNDLIDDLLKNGLQPYVTLFHWDTPQALEDKYGGFLSPNIVNDFRDFVDLCFQKFGDRVKKWITLNEPWMFSVQGYDMGTMAPGRISVVVNDPHRSLNTGATEVYTVSHHLLLAHAAAVKLYKEKYQSCQGGQIGITLVSHWFEPYSNSEDDQNATKRSIDFMLGWFMDPLTNGDYPRNMHDFVGGRLPKFTAEESKMLKGSYDFIGINYYTTYYAQNIDANYQSVGFMSDARANWTGERNGIPIGPQAGVKWLYIYPEGISRLLNYTKDLYGNPTIYITENGVDDENNNASSLKEALNDPIREKSYKDHLKNVLRSINEHGVDVKGFFAWSLMDNFEWGSGYAVRFGLYYVDYKNDLKRYPKKSVKWFKQFLRRDSHSPIPHTYPLITSNETSKIEDSLVRDAKRPRNA

SEQ ID NO: 1313 - DNA, 1560 bp, Populus balsamifera subsp. trichocarpa
  misc_feature (1)..(1560): Ceres ANNOT ID no. 1481150
  misc_feature: Utility: Cold Germination Useful for making plants with increased tolerance to cold stress
  misc_feature: Utility: Cold Growth Useful for making plants with increased tolerance to cold stress
  misc_feature 141387:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgggaagcattgatgacttcagccgttattctttcccagatgattttgttttcggaacatcctcatcagcttaccagtatgaaggtgaaacaaacaaacatggtagaggaccagctatatgggacactttcactgaggaacatacagagagaataaatgatcatagcaacggaaatgtagctgttgatttctaccatcgttataaggaagatgtgcaaagaatgaaagagatgggaatggatgctttcagattctccatttcttggtctagagtattaccacatggcaggttaagtgctggagtaaacgaagaaggcatcaagttttacaacgatctcattgatgacctccttaagaatggtttgcagccttacgttactctctttcactgggatactccacaagctttagaagataaatatggtggtttcttaagtcctaacattgtaaatgatttccgagactttgtcgacctttgtttccaaaagtttggagaccgagtgaagaagtggattactttgaacgagccatggatgttcagtgttcaaggttatgacatgggcacgatggcaccgggtaggatttctgtcgttgtaaatgatccccaccgatccttaaacactggtgccactgaagtgtatacggttagccatcatttgttgctcgctcatgctgcggcagtgaaactatacaaggaaaaatatcagtcatgtcaaggtggacagattgggataacacttgtttctcattggtttgaaccttactcaaacagtgaagatgatcaaaatgcaaccaaaagaagcctcgacttcatgcttggttggttcatggatcctttaactaatggtgactatccacgtaacatgcatgattttgttggtggaagattgcccaagttcactgccgaggaatctaagatgttgaagggatcgtatgattttattggaattaattactacacaacatattatgctcaaaatatcgatgcaaattatcagagtgttggattcatgtcagatgctcgtgctaattggacaggagagagaaatggaatcccaataggtccacaggctggtgtaaaatggctttatatttatcccgaaggcatcagcaggcttttgaattacaccaaagatctatacgggaacccaacaatttacattactgagaatggggttgatgacgaaaataacaatgcttcatcactaaaggaagctcttaatgatcccataagagaaaaatcttacaaagaccaccttaagaatgtcttgagatccatcaatgagcatggtgttgatgttaagggattttttgcttggtctttaatggacaatttcgaatggggaagtggttatgctgtgaggttcggcctctactatgttgattacaaaaatgatttgaaacgatatcctaaaaaatcagtcaagtggttcaagcagtttcttagaagagactcccacagtcctattccacatacgtatcctctgattacttctaatgaaacgtcgaagattgaagatagtttggttcgggatgctaaaaggccaagaaatgcctga

SEQ ID NO: 1314 - protein, 519 aa, Populus balsamifera subsp. trichocarpa
  misc_feature (1)..(519): Ceres ANNOT ID no. 1481150
  misc_feature (8)..(487): Pfam Name: Glyco_hydro_1 Pfam Description: Glycosyl hydrolase family 1
  misc_feature: SWISSPROT Homolog: BGL1_ARATH Beta-glucosidase homolog precursor (EC 3.2.1.-) with e-value of 4.1e-205 and BLAST sequence identity of 67.9
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 2.5e-102 and BLAST sequence identity of 41.7
  misc_feature: SWISSPROT Homolog: MYRO_BRANA Myrosinase precursor (EC 3.2.1.147) (Sinigrinase) (Thioglucosidase) with e-value of 6.6e-102 and BLAST sequence identity of 39.6
  misc_feature: SWISSPROT Homolog: MYR3_SINAL Myrosinase MB3 precursor (EC 3.2.1.147) (Sinigrinase) (Thioglucosidase) with e-value of 4.2e-100 and BLAST sequence identity of 40.4
  misc_feature: SWISSPROT Homolog: MYRO_ARATH Myrosinase precursor (EC 3.2.1.147) (Sinigrinase) (Thioglucosidase) with e-value of 5.5e-98 and BLAST sequence identity of 40.0
  misc_feature: Utility: Cold Germination Useful for making plants with increased tolerance to cold stress
  misc_feature: Utility: Cold Growth Useful for making plants with increased tolerance to cold stress
  misc_feature 141566:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(519): Functional Homolog of  Ceres CLONE ID no. 33559 at SEQ ID NO. 1351 with e-value of 2.20E-125 and BLAST sequence identity of 49.3
MGSIDDFSRYSFPDDFVFGTSSSAYQYEGETNKHGRGPAIWDTFTEEHTERINDHSNGNVAVDFYHRYKEDVQRMKEMGMDAFRFSISWSRVLPHGRLSAGVNEEGIKFYNDLIDDLLKNGLQPYVTLFHWDTPQALEDKYGGFLSPNIVNDFRDFVDLCFQKFGDRVKKWITLNEPWMFSVQGYDMGTMAPGRISVVVNDPHRSLNTGATEVYTVSHHLLLAHAAAVKLYKEKYQSCQGGQIGITLVSHWFEPYSNSEDDQNATKRSLDFMLGWFMDPLTNGDYPRNMHDFVGGRLPKFTAEESKMLKGSYDFIGINYYTTYYAQNIDANYQSVGFMSDARANWTGERNGIPIGPQAGVKWLYIYPEGISRLLNYTKDLYGNPTIYITENGVDDENNNASSLKEALNDPIREKSYKDHLKNVLRSINEHGVDVKGFFAWSLMDNFEWGSGYAVRFGLYYVDYKNDLKRYPKKSVKWFKQFLRRDSHSPIPHTYPLITSNETSKIEDSLVRDAKRPRNA

SEQ ID NO: 1315 - DNA, 1560 bp, Populus balsamifera subsp. trichocarpa
  misc_feature (1)..(1560): Ceres ANNOT ID no. 1481138
  misc_feature: Utility: Cold Germination Useful for making plants with increased tolerance to cold stress
  misc_feature: Utility: Cold Growth Useful for making plants with increased tolerance to cold stress
  misc_feature 141752:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgggaagcattgatgacttcagccgttattctttcccagatgattttgttttcggaacatcctcatcagcttaccagtatgaaggtgaaacaaacaaacatggtagaggaccagctatatgggacactttcactgaggaacatacagagagaataaatgatcatagcaacggaaatgtagctgttgatttctaccatcgctataaggaagatgtgcaaagaatgaaagaaatgggaatggatgctttcagattctccatttcttggtctagagtattaccacatggcaggttaagtgctggagtaaacgaagaaggcatcaagttttacaacgatctcattgatgacctccttaagaatggtttgcatccttacgttactctctttcactgggatactccacaagctttagaagataaatatggtggtttcttaagtcctaacattgtaaatgatttccgagactttgtcgacctttgtttccaaaagtttggagaccgagtgaagaagtggattactttgaacgagccatggatgttcagtgttcaaggttatgacatgggcacgatggcaccgggtaggatttctgtcgttgtaaatgatccccaccgatccttaaacactggtgccactgaagtgtatacggttagccatcatttgttgcttgctcatgctgcggcagtgaaactatacaaggaaaaatatcagtcatgtcaaggtggacagattgggataacacttgtttctcattggtttgaaccttactcaaacagtgaagatgatcaaaatgcaaccaaaagaagccttgacttcatgcttggttggttcatggatcctttaactaatggtgactatccacgtaacatgcatgattttgttggtggaagattgcccaagttcactgccgaggaatctaagatgctgaagggatcgtatgattttattggaattaattactacacaacatattatgctcaaaatatcgatgcaaattatcagagtgttggattcatgtcagatgctcgtgctaattggacaggagagagaaatggaatcccaataggtccacaggctggtgtaaaatggctttatatttatcccgaaggcatcagcaggcttttgaattacaccaaagatctatacgggaacccaacaatttacattactgagaatggggttgatgacgaaaataacaatgcttcatcactaaaggaagctcttaatgatcccataagagaaaaatcttacaaagaccaccttaagaatgtcttgagatccatcaatgagcatggtgttgatgttaagggattttttgcttggtctttaatggacaatttcgaatggggaagtggttatgctgtgaggttcggcctctactatgttgattacaaaaatgatttgaaacgatatcctaaaaaatcagtcaagtggttcaagcagtttcttagaagagactcccacagtcctattccacatacgtatcctctgattacttctaatgaaacgtcgaagattgaagatagtttggttcgggatgctaaaaggccaagaaatgcctga

SEQ ID NO: 1316 - protein, 519 aa, Populus balsamifera subsp. trichocarpa
  misc_feature (1)..(519): Ceres ANNOT ID no. 1481138
  misc_feature (8)..(487): Pfam Name: Glyco_hydro_1 Pfam Description: Glycosyl hydrolase family 1
  misc_feature: SWISSPROT Homolog: BGL1_ARATH Beta-glucosidase homolog precursor (EC 3.2.1.-) with e-value of 4.1e-205 and BLAST sequence identity of 67.9
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 2.5e-102 and BLAST sequence identity of 41.7
  misc_feature: SWISSPROT Homolog: MYRO_BRANA Myrosinase precursor (EC 3.2.1.147) (Sinigrinase) (Thioglucosidase) with e-value of 6.6e-102 and BLAST sequence identity of 39.6
  misc_feature: SWISSPROT Homolog: MYR3_SINAL Myrosinase MB3 precursor (EC 3.2.1.147) (Sinigrinase) (Thioglucosidase) with e-value of 4.2e-100 and BLAST sequence identity of 40.4
  misc_feature: SWISSPROT Homolog: MYRO_ARATH Myrosinase precursor (EC 3.2.1.147) (Sinigrinase) (Thioglucosidase) with e-value of 5.5e-98 and BLAST sequence identity of 40.0
  misc_feature: Utility: Cold Germination Useful for making plants with increased tolerance to cold stress
  misc_feature: Utility: Cold Growth Useful for making plants with increased tolerance to cold stress
  misc_feature 141931:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(519): Functional Homolog of  Ceres CLONE ID no. 33559 at SEQ ID NO. 1351 with e-value of 2.79E-125 and BLAST sequence identity of 49.3
MGSIDDFSRYSFPDDFVFGTSSSAYQYEGETNKHGRGPAIWDTFTEEHTERINDHSNGNVAVDFYHRYKEDVQRMKEMGMDAFRFSISWSRVLPHGRLSAGVNEEGIKFYNDLIDDLLKNGLHPYVTLFHWDTPQALEDKYGGFLSPNIVNDFRDFVDLCFQKFGDRVKKWITLNEPWMFSVQGYDMGTMAPGRISVVVNDPHRSLNTGATEVYTVSHHLLLAHAAAVKLYKEKYQSCQGGQIGITLVSHWFEPYSNSEDDQNATKRSLDFMLGWFMDPLTNGDYPRNMHDFVGGRLPKFTAEESKMLKGSYDFIGINYYTTYYAQNIDANYQSVGFMSDARANWTGERNGIPIGPQAGVKWLYIYPEGISRLLNYTKDLYGNPTIYITENGVDDENNNASSLKEALNDPIREKSYKDHLKNVLRSINEHGVDVKGFFAWSLMDNFEWGSGYAVRFGLYYVDYKNDLKRYPKKSVKWFKQFLRRDSHSPIPHTYPLITSNETSKIEDSLVRDAKRPRNA

SEQ ID NO: 1317 - DNA, 1560 bp, Populus balsamifera subsp. trichocarpa
  misc_feature (1)..(1560): Ceres ANNOT ID no. 1485824
  misc_feature: Utility: Cold Germination Useful for making plants with increased tolerance to cold stress
  misc_feature: Utility: Cold Growth Useful for making plants with increased tolerance to cold stress
  misc_feature 142117:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgggaagcattgatgacttcagccgtaattctttcccagatgattttgtattcggaacatcctcatcagcttaccagtatgaaggtgaaacaaacaaacatggtagaggaccagctatatgggacactttcactgtggaacatacagagagaataaatgatcatagcaacggaaatgtagctgttgatttctatcatcgctataaggaagatgtgcaaagaatgaaagaaatgggaatggatgctttcagattctccatttcttggtctagagtattaccacatggcaggttaagtgctggagtaaacgaagaaggcatcaaattttataacgatctcattgatgacctccttaagaatggtttgcagccttacgttactctctttcactgggatactccacaagctttggaagataaatatggtggtttcttaagtcctaacattgtaaatgatttccgagactttgtcgacctttgtttccaaaattttggagaccgggtgaagaagtggattactttgaacgagccatggatgttcagtgttcaaggttatgacatgggcacgatggcacccggtaggatttctgtcgttgtaaatgatccacaccgatccttaaacactggtgccactgaagtgtatacggttagccatcatttgttgcttgctcatgctgcggcagtgaaactatacaaggaaaaatatcagtcatgtcaaggtggacagattgggataacacttgtttctcattggtttgaaccttactcaaacagtgaagcagatcaaaatgcaaccaaaagaagcctcgacttcatgcttggttggttcatggatcctttaactaatggtgactatccacgtaacatgcatgattttgttggtggaagattgcccgagttcactgccgaggaatctaagatgttgaagggatcgtatgattttattggaattaattactacacaacatattatgctcaaaatatcgatgcaaattatcagagtgttggattcatgtcagatgctcgtgctaattggacaggagagagaaatggaatcccgataggtccacaggctggtgtaaaatggctttatatttatcccgaaggcatcagcaggcttttgaattacaccaaagatctatacgggagcccaacaatttacattactgagaatggggttgatgacgtaaataacaatgcttcatcactaaaggaagctcttaatgatcccataagagaaaaatcttacaaagaccacctcaagaatgttttgagatccatcaatgagcatggtgttgatgttaagggattttttgcttggtctttaatggacaatttcgaatggggaagtggttatgctgtgaggttcggcctctactatgttgattacaaaaatgatttgaaacgatatcctaaacaatcagtcaagtggttcaagcagtttcttagaagagactcccacagtcctattccacatacgtatcctctgattacttctaatgaaacgtcgaaaattgaagatagtttggttcgggatgctaaaaggccaagaaatgcctga

SEQ ID NO: 1318 - protein, 519 aa, Populus balsamifera subsp. trichocarpa
  misc_feature (1)..(519): Ceres ANNOT ID no. 1485824
  misc_feature (8)..(487): Pfam Name: Glyco_hydro_1 Pfam Description: Glycosyl hydrolase family 1
  misc_feature: SWISSPROT Homolog: BGL1_ARATH Beta-glucosidase homolog precursor (EC 3.2.1.-) with e-value of 4.1e-205 and BLAST sequence identity of 67.9
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 2.5e-102 and BLAST sequence identity of 41.7
  misc_feature: SWISSPROT Homolog: MYRO_BRANA Myrosinase precursor (EC 3.2.1.147) (Sinigrinase) (Thioglucosidase) with e-value of 6.6e-102 and BLAST sequence identity of 39.6
  misc_feature: SWISSPROT Homolog: MYR3_SINAL Myrosinase MB3 precursor (EC 3.2.1.147) (Sinigrinase) (Thioglucosidase) with e-value of 4.2e-100 and BLAST sequence identity of 40.4
  misc_feature: SWISSPROT Homolog: MYRO_ARATH Myrosinase precursor (EC 3.2.1.147) (Sinigrinase) (Thioglucosidase) with e-value of 5.5e-98 and BLAST sequence identity of 40.0
  misc_feature: Utility: Cold Germination Useful for making plants with increased tolerance to cold stress
  misc_feature: Utility: Cold Growth Useful for making plants with increased tolerance to cold stress
  misc_feature 142296:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(519): Functional Homolog of  Ceres CLONE ID no. 33559 at SEQ ID NO. 1351 with e-value of 1.79E-123 and BLAST sequence identity of 48.7
MGSIDDFSRNSFPDDFVFGTSSSAYQYEGETNKHGRGPAIWDTFTVEHTERINDHSNGNVAVDFYHRYKEDVQRMKEMGMDAFRFSISWSRVLPHGRLSAGVNEEGIKFYNDLIDDLLKNGLQPYVTLFHWDTPQALEDKYGGFLSPNIVNDFRDFVDLCFQNFGDRVKKWITLNEPWMFSVQGYDMGTMAPGRISVVVNDPHRSLNTGATEVYTVSHHLLLAHAAAVKLYKEKYQSCQGGQIGITLVSHWFEPYSNSEADQNATKRSLDFMLGWFMDPLTNGDYPRNMHDFVGGRLPEFTAEESKMLKGSYDFIGINYYTTYYAQNIDANYQSVGFMSDARANWTGERNGIPIGPQAGVKWLYIYPEGISRLLNYTKDLYGSPTIYITENGVDDVNNNASSLKEALNDPIREKSYKDHLKNVLRSINEHGVDVKGFFAWSLMDNFEWGSGYAVRFGLYYVDYKNDLKRYPKQSVKWFKQFLRRDSHSPIPHTYPLITSNETSKIEDSLVRDAKRPRNA

SEQ ID NO: 1319 - DNA, 1521 bp, Populus balsamifera subsp. trichocarpa
  misc_feature (1)..(1521): Ceres ANNOT ID no. 1534622
  misc_feature: Utility: Cold Germination Useful for making plants with increased tolerance to cold stress
  misc_feature: Utility: Cold Growth Useful for making plants with increased tolerance to cold stress
  misc_feature 142482:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgggaagcattgatgacttcagccgttattctttcccagatgattttgttttcggaacatcctcatcagcttaccagtatgaaggtgaaacaaacaaacatggtagaggaccagctatatgggacactttcactgaggaacatacagagagaataaatgatcatagcaacggaaatgtagctgttgatttctaccatcgctataaggaagatgtgcaaagaatgaaagaaatgggaatggatgctttcagattctccatttcttggtctagagtattaccacatggcaggttaagtgctggagtaaacgaagaaggcatcaagttttacaacgatctcattgatgacctccttaagaatggtttgcatccttacgttactctctttcactgggatactccacaagctttagaagataaatatggtggtttcttaagtcctaacattgtaaatgatttccgagactttgtcgacctttgtttccaaaagtttggagaccgagtgaagaagtggattactttgaacgagccatggatgttcagtgttcaaggttatgacatgggcacgatggcaccgggtaggatttctgtcgttgtaaatgatccccaccgatccttaaacactggtgccactgaagtgtatacggttagccatcatttgttgcttgctcatgctgcggcagtgaaactatacaaggaaaaatatcagtcatgtcaaggtggacagattgggataacacttgtttctcattggtttgaaccttactcaaacagtgaagatgatcaaaatgcaaccaaaagaagccttgacttcatgcttggttggttcatggatcctttaactaatggtgactatccacgtaacatgcatgattttgttggtggaagattgcccaagttcactgccgaggaatctaagatgctgaagggatcgtatgattttattggaattaattactacacaacatattatgctcaaaatatcgatgcaaattatcagagagagagaaatggaatcccaataggtccacaggctggtgtaaaatggctttatatttatcccgaaggcatcagcaggcttttgaattacaccaaagatctatacgggaacccaacaatttacattactgagaatggggttgatgacgaaaataacaatgcttcatcactaaaggaagctcttaatgatcccataagagaaaaatcttacaaagaccaccttaagaatgtcttgagatccatcaatgagcatggtgttgatgttaagggattttttgcttggtctttaatggacaatttcgaatggggaagtggttatgctgtgaggttcggcctctactatgttgattacaaaaatgatttgaaacgatatcctaaaaaatcagtcaagtggttcaagcagtttcttagaagagactcccacagtcctattccacatacgtatcctctgattacttctaatgaaacgtcgaagattgaagatagtttggttcgggatgctaaaaggccaagaaatgcctga

SEQ ID NO: 1320 - protein, 506 aa, Populus balsamifera subsp. trichocarpa
  misc_feature (1)..(506): Ceres ANNOT ID no. 1534622
  misc_feature (8)..(474): Pfam Name: Glyco_hydro_1 Pfam Description: Glycosyl hydrolase family 1
  misc_feature: SWISSPROT Homolog: BGL1_ARATH Beta-glucosidase homolog precursor (EC 3.2.1.-) with e-value of 4.1e-205 and BLAST sequence identity of 67.9
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 2.5e-102 and BLAST sequence identity of 41.7
  misc_feature: SWISSPROT Homolog: MYRO_BRANA Myrosinase precursor (EC 3.2.1.147) (Sinigrinase) (Thioglucosidase) with e-value of 6.6e-102 and BLAST sequence identity of 39.6
  misc_feature: SWISSPROT Homolog: MYR3_SINAL Myrosinase MB3 precursor (EC 3.2.1.147) (Sinigrinase) (Thioglucosidase) with e-value of 4.2e-100 and BLAST sequence identity of 40.4
  misc_feature: SWISSPROT Homolog: MYRO_ARATH Myrosinase precursor (EC 3.2.1.147) (Sinigrinase) (Thioglucosidase) with e-value of 5.5e-98 and BLAST sequence identity of 40.0
  misc_feature: Utility: Cold Germination Useful for making plants with increased tolerance to cold stress
  misc_feature: Utility: Cold Growth Useful for making plants with increased tolerance to cold stress
  misc_feature 142659:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(506): Functional Homolog of  Ceres CLONE ID no. 33559 at SEQ ID NO. 1351 with e-value of 8.70E-122 and BLAST sequence identity of 50.5
MGSIDDFSRYSFPDDFVFGTSSSAYQYEGETNKHGRGPAIWDTFTEEHTERINDHSNGNVAVDFYHRYKEDVQRMKEMGMDAFRFSISWSRVLPHGRLSAGVNEEGIKFYNDLIDDLLKNGLHPYVTLFHWDTPQALEDKYGGFLSPNIVNDFRDFVDLCFQKFGDRVKKWITLNEPWMFSVQGYDMGTMAPGRISVVVNDPHRSLNTGATEVYTVSHHLLLAHAAAVKLYKEKYQSCQGGQIGITLVSHWFEPYSNSEDDQNATKRSLDFMLGWFMDPLTNGDYPRNMHDFVGGRLPKFTAEESKMLKGSYDFIGINYYTTYYAQNIDANYQRERNGIPIGPQAGVKWLYIYPEGISRLLNYTKDLYGNPTIYITENGVDDENNNASSLKEALNDPIREKSYKDHLKNVLRSINEHGVDVKGFFAWSLMDNFEWGSGYAVRFGLYYVDYKNDLKRYPKKSVKWFKQFLRRDSHSPIPHTYPLITSNETSKIEDSLVRDAKRPRNA

SEQ ID NO: 1321 - protein, 282 aa, Arabidopsis thaliana
  misc_feature (1)..(282): Ceres CLONE ID no. 33802
  misc_feature (142)..(224): Pfam Name: ABC_tran Pfam Description: ABC transporter
  misc_feature (40)..(60): Pfam Name: NACHT Pfam Description: NACHT domain
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (264)..(264): Xaa is any aa, unknown, or other
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLLEFFKEECEQRGATIVYATHIFDGLETWASHLAYINGGELKLSAKLDEIKDLKTSPNLLSVVEAWLRSETKVEKKTKXKPVVTSPFMSSRQMAYYR

SEQ ID NO: 1322 - DNA, 903 bp, Populus balsamifera subsp. trichocarpa
  misc_feature (1)..(903): Ceres ANNOT ID no. 1495637
  misc_feature 142937:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcagagaaagcttctcaatcaatagaaaaggaaggaggagaaaatgagaaggcaaacagtatcagtatatgcggaatgcaattcgcatacgcaggacagcatccactcttctacgatttcaatctcaacatctctcccggatctcgttgccttctcgtcggcgctaacggatctgggaagactactttgctgaaaataatggcagggaagcatatggtaggagggaaagatgtggtgcgggtgataaatggttcggcttttcatgatacgcaattggtttgtagtggtgacttggcttatttaggaggttcttggagtaaaactgttggatctgctggagagattccactacagggagacttctctgcggaacatatgatatttggagttgaagggactgatcctgttagaagagaaaagttgattgacctgcttgacattgatctgcaatggcgaatgcacaaggtatctgatgggcagcggcgaagagtccagatttgcatgggtcttctccatccatttaaggttcttttacttgatgaagttacagtcgatctagatgttgttgccaggatggatttgcttgagttcttcaaggaagagtgtgatcagagaggagctacaattgtatatgctactcatatttttgatgggttagagacttgggcaactcatctagcttacatacaagacggtgagctgaggagggctgagaagctaacggaggttcatgagttgaaaagctcagccaatctgctttctgttgttgagtcttggctccgtcatgaaaccaagagtgagaaaaagaaacccaccaaccctcctgcccaaaatcaaaagacctctccacttggtagttctcctttcatgtcatctagacacatggcatactaccgttga

SEQ ID NO: 1323 - protein, 300 aa, Populus balsamifera subsp. trichocarpa
  misc_feature (1)..(300): Ceres ANNOT ID no. 1495637
  misc_feature (151)..(233): Pfam Name: ABC_tran Pfam Description: ABC transporter
  misc_feature (49)..(66): Pfam Name: NACHT Pfam Description: NACHT domain
  misc_feature: SWISSPROT Homolog: YFC8_YEAST Probable ATP-dependent transporter YFL028C with e-value of 8.9e-43 and BLAST sequence identity of 41.2
  misc_feature: SWISSPROT Homolog: CBIO1_STRP3 Cobalt import ATP-binding protein cbiO 1 with e-value of 3.9e-17 and BLAST sequence identity of 31.3
  misc_feature: SWISSPROT Homolog: CBIO1_STRP1 Cobalt import ATP-binding protein cbiO 1 with e-value of 8.2e-17 and BLAST sequence identity of 31.3
  misc_feature: SWISSPROT Homolog: CBIO1_STRP6 Cobalt import ATP-binding protein cbiO 1 with e-value of 8.2e-17 and BLAST sequence identity of 31.3
  misc_feature: SWISSPROT Homolog: CBIO1_STRP8 Cobalt import ATP-binding protein cbiO 1 with e-value of 8.2e-17 and BLAST sequence identity of 31.3
  misc_feature 143055:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(300): Functional Homolog of  Ceres CLONE ID no. 33802 at SEQ ID NO. 1362 with e-value of 5.89E-116 and BLAST sequence identity of 81.1
MAEKASQSIEKEGGENEKANSISICGMQFAYAGQHPLFYDFNLNISPGSRCLLVGANGSGKTTLLKIMAGKHMVGGKDVVRVINGSAFHDTQLVCSGDLAYLGGSWSKTVGSAGEIPLQGDFSAEHMIFGVEGTDPVRREKLIDLLDIDLQWRMHKVSDGQRRRVQICMGLLHPFKVLLLDEVTVDLDVVARMDLLEFFKEECDQRGATIVYATHIFDGLETWATHLAYIQDGELRRAEKLTEVHELKSSANLLSVVESWLRHETKSEKKKPTNPPAQNQKTSPLGSSPFMSSRHMAYYR

SEQ ID NO: 1324 - DNA, 909 bp, Populus balsamifera subsp. trichocarpa
  misc_feature (1)..(909): Ceres ANNOT ID no. 1452709
  misc_feature 143159:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcggagaaagcttctcaatcagaaggaggaggaggaggaggaggagaaaatgagaaggcaaacagtatcagtatatgcggaatgcaattcgcatacccaggacagcatccactcttctacgaattcaatctcaacatctctcctggatctcgttgccttctcgttggcgctaacggatctgggaagacaactttgctgaaaataatggcagggaagcatatggtaggaggaagagatgtggtgcgagtgataaatggttcggcttttcatgatactcaattggtttgtagtggtgacttggcttatttaggcggttcgtggagtaaaactgttggatctgctggggagattccactacagggagacttctctgcagaacatatgatatttggagtggaagggactgatcctgttagaagagaaaagttaattgagctgcttgacattgatttgaaatggcgtatgcacaaggtgtctgatgggcagcggcgacgagtccagatttgcatgggtcttcttcatccatttaaggttcttttgctagatgaagttacagtcgatctagatgttgttgccaggatggatttgcttgagttcttcaaggaagaatgtgatcagagaggagctacaattgtatatgctactcatatttttgatgggttagagacgtgggcaacacatctagcatacatacaagatggtgagctgaagagggttaagaagttaaccgaggttcatgagttgaaaaactcagccactctgctttctgttgttgagtcttggctccgttctgaaaccaagaatgagaaaaagaaacccactaaccctcctgcccaaaatcaaaagacctctccttttggtagttctcctttcatgtcttctagacacatggcatactaccgctga

SEQ ID NO: 1325 - protein, 302 aa, Populus balsamifera subsp. trichocarpa
  misc_feature (1)..(302): Ceres ANNOT ID no. 1452709
  misc_feature (51)..(68): Pfam Name: NACHT Pfam Description: NACHT domain
  misc_feature: SWISSPROT Homolog: YFC8_YEAST Probable ATP-dependent transporter YFL028C with e-value of 8.9e-43 and BLAST sequence identity of 41.2
  misc_feature: SWISSPROT Homolog: CBIO1_STRP3 Cobalt import ATP-binding protein cbiO 1 with e-value of 3.9e-17 and BLAST sequence identity of 31.3
  misc_feature: SWISSPROT Homolog: CBIO1_STRP1 Cobalt import ATP-binding protein cbiO 1 with e-value of 8.2e-17 and BLAST sequence identity of 31.3
  misc_feature: SWISSPROT Homolog: CBIO1_STRP6 Cobalt import ATP-binding protein cbiO 1 with e-value of 8.2e-17 and BLAST sequence identity of 31.3
  misc_feature: SWISSPROT Homolog: CBIO1_STRP8 Cobalt import ATP-binding protein cbiO 1 with e-value of 8.2e-17 and BLAST sequence identity of 31.3
  misc_feature 143271:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(302): Functional Homolog of  Ceres CLONE ID no. 33802 at SEQ ID NO. 1362 with e-value of 6.09E-114 and BLAST sequence identity of 80.0
MAEKASQSEGGGGGGGENEKANSISICGMQFAYPGQHPLFYEFNLNISPGSRCLLVGANGSGKTTLLKIMAGKHMVGGRDVVRVINGSAFHDTQLVCSGDLAYLGGSWSKTVGSAGEIPLQGDFSAEHMIFGVEGTDPVRREKLIELLDIDLKWRMHKVSDGQRRRVQICMGLLHPFKVLLLDEVTVDLDVVARMDLLEFFKEECDQRGATIVYATHIFDGLETWATHLAYIQDGELKRVKKLTEVHELKNSATLLSVVESWLRSETKNEKKKPTNPPAQNQKTSPFGSSPFMSSRHMAYYR

SEQ ID NO: 1326 - DNA, 843 bp, Populus balsamifera subsp. trichocarpa
  misc_feature (1)..(843): Ceres ANNOT ID no. 1442724
  misc_feature 143375:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcagagaaagcttctcaatcaatagaaaaggaaggaggagaaaatgagaaggcaaacagtatcagtatatgcggaatgcaattcgcatacgcaggacagcatccactcttctacgatttcaatctcaacatctctcccggatctcgttgccttctcgtcggcgctaacggatctgggaagactactttgctgaaaataatggcagggaagcatatggtaggagggaaagatgtggtgcgggtgataaatggttcggcttttcatgatacgcaattggtttgtagtggtgacttggcttatttaggaggttcttggagtaaaactgttggatctgctggagagattccactacagggagacttctctgcggaacatatgatatttggagttgaagggactgatcctgttagaagagaaaagttgattgacctgcttgacattgatctgcaatggcgaatgcacaaggttcttttacttgatgaagttacagtcgatctagatgttgttgccaggatggatttgcttgagttcttcaaggaagagtgtgatcagagaggagctacaattgtatatgctactcatatttttgatgggttagagacttgggcaactcatctagcttacatacaagacggtgagctgaggagggctgagaagctaacggaggttcatgagttgaaaagctcagccaatctgctttctgttgttgagtcttggctccgtcatgaaaccaagagtgagaaaaagaaacccaccaaccctcctgcccaaaatcaaaagacctctccacttggtagttctcctttcatgtcatctagacacatggcatactaccgttga

SEQ ID NO: 1327 - protein, 280 aa, Populus balsamifera subsp. trichocarpa
  misc_feature (1)..(280): Ceres ANNOT ID no. 1442724
  misc_feature (49)..(66): Pfam Name: NACHT Pfam Description: NACHT domain
  misc_feature: SWISSPROT Homolog: YFC8_YEAST Probable ATP-dependent transporter YFL028C with e-value of 8.9e-43 and BLAST sequence identity of 41.2
  misc_feature: SWISSPROT Homolog: CBIO1_STRP3 Cobalt import ATP-binding protein cbiO 1 with e-value of 3.9e-17 and BLAST sequence identity of 31.3
  misc_feature: SWISSPROT Homolog: CBIO1_STRP1 Cobalt import ATP-binding protein cbiO 1 with e-value of 8.2e-17 and BLAST sequence identity of 31.3
  misc_feature: SWISSPROT Homolog: CBIO1_STRP6 Cobalt import ATP-binding protein cbiO 1 with e-value of 8.2e-17 and BLAST sequence identity of 31.3
  misc_feature: SWISSPROT Homolog: CBIO1_STRP8 Cobalt import ATP-binding protein cbiO 1 with e-value of 8.2e-17 and BLAST sequence identity of 31.3
  misc_feature 143485:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(280): Functional Homolog of  Ceres CLONE ID no. 33802 at SEQ ID NO. 1362 with e-value of 1.19E-99 and BLAST sequence identity of 79.6
MAEKASQSIEKEGGENEKANSISICGMQFAYAGQHPLFYDFNLNISPGSRCLLVGANGSGKTTLLKIMAGKHMVGGKDVVRVINGSAFHDTQLVCSGDLAYLGGSWSKTVGSAGEIPLQGDFSAEHMIFGVEGTDPVRREKLIDLLDIDLQWRMHKVLLLDEVTVDLDVVARMDLLEFFKEECDQRGATIVYATHIFDGLETWATHLAYIQDGELRRAEKLTEVHELKSSANLLSVVESWLRHETKSEKKKPTNPPAQNQKTSPLGSSPFMSSRHMAYYR

SEQ ID NO: 1328 - protein, 111 aa, Arabidopsis thaliana
  misc_feature (1)..(111): Ceres CLONE ID no. 34035
  misc_feature (6)..(111): Pfam Name: DUF423 Pfam Description: Protein of unknown function (DUF423)
  misc_feature: Utility: pH (high) Useful for making plants tolerant to high pH or low phosphate
  misc_feature: Phenotype: WHOLE PLANT - pH (high) Useful for making plants tolerant to high pH or low phosphate
MDPRMWHKVAAISGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 1329 - DNA, 336 bp, Populus balsamifera subsp. trichocarpa
  misc_feature (1)..(336): Ceres ANNOT ID no. 1525523
  misc_feature: Utility: pH (high) Useful for making plants tolerant to high pH or low phosphate
  misc_feature 143647:<222: Transcription Factor
  misc_feature: Phenotype: WHOLE PLANT - pH (high) Useful for making plants tolerant to high pH or low phosphate
atggatccttctatgtggcacagaatagctgctgtctccggggtagcagctctcggattggggacctatggtgctcatgtcttcaagcctgaaaatcccacttacaaagaggtatggcaaacagcgtcattataccatttggttcacactgcagcccttcttgctgctcctatcaccaaacaccccaacatttttggaggccttttgactactgggattcttgctttctctggaacgtgttatactgtggctcttcttgaggacagaaagtattctactctggctccatttggtggctttgcatttattggtgcttgggcaagcttgcttttctaa

SEQ ID NO: 1330 - protein, 111 aa, Populus balsamifera subsp. trichocarpa
  misc_feature (1)..(111): Ceres ANNOT ID no. 1525523
  misc_feature (6)..(111): Pfam Name: DUF423 Pfam Description: Protein of unknown function (DUF423)
  misc_feature: SWISSPROT Homolog: YGDD_ECO57 Inner membrane protein ygdD with e-value of 3.9e-10 and BLAST sequence identity of 35.2
  misc_feature: SWISSPROT Homolog: YGDD_ECOL6 Inner membrane protein ygdD with e-value of 3.9e-10 and BLAST sequence identity of 35.2
  misc_feature: SWISSPROT Homolog: YGDD_ECOLI Inner membrane protein ygdD with e-value of 3.9e-10 and BLAST sequence identity of 35.2
  misc_feature: SWISSPROT Homolog: YGDD_SHIFL Inner membrane protein ygdD with e-value of 3.9e-10 and BLAST sequence identity of 35.2
  misc_feature: SWISSPROT Homolog: YWDK_BACSU Hypothetical protein ywdK with e-value of 1.7e-09 and BLAST sequence identity of 34.7
  misc_feature: Utility: pH (high) Useful for making plants tolerant to high pH or low phosphate
  misc_feature 143731:<222: Transcription Factor
  misc_feature: Phenotype: WHOLE PLANT - pH (high) Useful for making plants tolerant to high pH or low phosphate
  misc_feature (1)..(111): Functional Homolog of  Ceres CLONE ID no. 34035 at SEQ ID NO. 1369 with e-value of 4.80E-50 and BLAST sequence identity of 83.7
MDPSMWHRIAAVSGVAALGLGTYGAHVFKPENPTYKEVWQTASLYHLVHTAALLAAPITKHPNIFGGLLTTGILAFSGTCYTVALLEDRKYSTLAPFGGFAFIGAWASLLF

SEQ ID NO: 1331 - DNA, 300 bp, Populus balsamifera subsp. trichocarpa
  misc_feature (1)..(300): Ceres ANNOT ID no. 1472113
  misc_feature: Utility: pH (high) Useful for making plants tolerant to high pH or low phosphate
  misc_feature 143791:<222: Transcription Factor
  misc_feature: Phenotype: WHOLE PLANT - pH (high) Useful for making plants tolerant to high pH or low phosphate
atggatccttctatgtggcacagaatagctgctgtctccggggtagcagctctcggattggggacctatggtgctcatgtcttcaagcctgaaaatcccacttacaaagaggtatggcaaacagcgtcattataccatttggttcacactgcagcccttcttgctgctcctatcaccaaacaccccaacatttttggaggccttttgactactgggattcttgctttctctggaacctcgggtagcatttgtctcgaaaaaggaaaacaccttatgatagctccattctcgcggctctag

SEQ ID NO: 1332 - protein, 99 aa, Populus balsamifera subsp. trichocarpa
  misc_feature (1)..(99): Ceres ANNOT ID no. 1472113
  misc_feature (6)..(99): Pfam Name: DUF423 Pfam Description: Protein of unknown function (DUF423)
  misc_feature: SWISSPROT Homolog: YGDD_ECO57 Inner membrane protein ygdD with e-value of 3.9e-10 and BLAST sequence identity of 35.2
  misc_feature: SWISSPROT Homolog: YGDD_ECOL6 Inner membrane protein ygdD with e-value of 3.9e-10 and BLAST sequence identity of 35.2
  misc_feature: SWISSPROT Homolog: YGDD_ECOLI Inner membrane protein ygdD with e-value of 3.9e-10 and BLAST sequence identity of 35.2
  misc_feature: SWISSPROT Homolog: YGDD_SHIFL Inner membrane protein ygdD with e-value of 3.9e-10 and BLAST sequence identity of 35.2
  misc_feature: SWISSPROT Homolog: YWDK_BACSU Hypothetical protein ywdK with e-value of 1.7e-09 and BLAST sequence identity of 34.7
  misc_feature: Utility: pH (high) Useful for making plants tolerant to high pH or low phosphate
  misc_feature 143875:<222: Transcription Factor
  misc_feature: Phenotype: WHOLE PLANT - pH (high) Useful for making plants tolerant to high pH or low phosphate
  misc_feature (1)..(99): Functional Homolog of  Ceres CLONE ID no. 34035 at SEQ ID NO. 1369 with e-value of 2.90E-36 and BLAST sequence identity of 75.0
MDPSMWHRIAAVSGVAALGLGTYGAHVFKPENPTYKEVWQTASLYHLVHTAALLAAPITKHPNIFGGLLTTGILAFSGTSGSICLEKGKHLMIAPFSRL

SEQ ID NO: 1333 - protein, 128 aa, Arabidopsis thaliana
  misc_feature (1)..(128): Ceres CLONE ID no. 34060
  misc_feature (1)..(128): Also Known As Ceres CDNA ID no. 23368585
  misc_feature (1)..(128): Also Known As Ceres GEMINI ID 535B6
  misc_feature (11)..(116): Pfam Name: KE2 Pfam Description: KE2 family protein
  misc_feature 143949:<222: Transcription Factor
  misc_feature: Phenotype: Activates expression of the gene endogenous to the AtDXPR (SEQ ID NO 4143) regalutory region Useful for modulating Terpenoid Biosynthesis
MADEATRAAFMEIQASMIELTGKLKQVQNQMRNKEGDRKRAFLTLEELRPLPEETNTYKSIGRTFVLEPKTVLEGEQEQKLKDSEAAVASLQTSKEYLEKQVAEVENNLRELLQQEPGIAQQIMSMSM

SEQ ID NO: 1334 - DNA, 738 bp, Populus balsamifera subsp. trichocarpa
  misc_feature (1)..(738): Ceres ANNOT ID no. 1507094
  misc_feature 144001:<222: Transcription Factor
  misc_feature: Phenotype: Activates expression of the gene endogenous to the AtDXPR (SEQ ID NO 4143) regalutory region Useful for modulating Terpenoid Biosynthesis
atggcagacgaagccaacagaactgctttcttagagcttcaaggtcgcatgattgagaccacttctaaattcaagcaggtccagaaccagatacgaaccaaggagggagaaaagaagcgtgctttcttaaccttggaagagctgcggcaagttcctgatgatacaaatacatacaaatctatagggagaacgtttgttttggagccaaagtcagtattgatgagtgagcaggagcagaaactcaaggatagcgagactgcaatatcctcactacagacatcaaaggaatacttggaaaagcatatgtcagaggttgagaacaacctgagggaacttttgcagcaagatccagctcttgctcgtcagataatgtccatgagtgtaatttgggaattaggattggtcgacggccagttcgatagaacaattaagctccccttggtagtctgcattctgcatttgattactcatgtactcaagcttgttgaagaactgtcaatgaagggcagacataagattgttcttgaaaaatcttccactggtcaagttaaaggcaaatctaaacaccttgcagatttggtaatgaccgtgagacaaatgcgcatgaacatagcagcgaaggcctcatttgaatcacaatggttttttcaggttccagtagtgagaaagactggaggccttgcaggcactgtcctcgacatggatgacctgtcaagccatgagatagctaatgggtaa

SEQ ID NO: 1335 - protein, 245 aa, Populus balsamifera subsp. trichocarpa
  misc_feature (1)..(245): Ceres ANNOT ID no. 1507094
  misc_feature (11)..(116): Pfam Name: KE2 Pfam Description: KE2 family protein
  misc_feature: SWISSPROT Homolog: PFD1_BOVIN Prefoldin subunit 1 with e-value of 2.0e-15 and BLAST sequence identity of 36.0
  misc_feature: SWISSPROT Homolog: PFD1_HUMAN Prefoldin subunit 1 with e-value of 2.0e-15 and BLAST sequence identity of 36.0
  misc_feature: SWISSPROT Homolog: PFD1_MOUSE Prefoldin subunit 1 with e-value of 2.0e-15 and BLAST sequence identity of 36.0
  misc_feature: SWISSPROT Homolog: PFD1_PONPY Prefoldin subunit 1 with e-value of 2.0e-15 and BLAST sequence identity of 36.0
  misc_feature: SWISSPROT Homolog: PFD1_BRARE Prefoldin subunit 1 with e-value of 1.2e-13 and BLAST sequence identity of 33.3
  misc_feature 144093:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(245): Functional Homolog of  Ceres CLONE ID no. 34060 at SEQ ID NO. 1374 with e-value of 6.29E-48 and BLAST sequence identity of 75.7
MADEANRTAFLELQGRMIETTSKFKQVQNQIRTKEGEKKRAFLTLEELRQVPDDTNTYKSIGRTFVLEPKSVLMSEQEQKLKDSETAISSLQTSKEYLEKHMSEVENNLRELLQQDPALARQIMSMSVIWELGLVDGQFDRTIKLPLVVCILHLITHVLKLVEELSMKGRHKIVLEKSSTGQVKGKSKHLADLVMTVRQMRMNIAAKASFESQWFFQVPVVRKTGGLAGTVLDMDDLSSHEIANG

SEQ ID NO: 1336 - DNA, 408 bp, Populus balsamifera subsp. trichocarpa
  misc_feature (1)..(408): Ceres ANNOT ID no. 1535523
  misc_feature 144174:<222: Transcription Factor
  misc_feature: Phenotype: Activates expression of the gene endogenous to the AtDXPR (SEQ ID NO 4143) regalutory region Useful for modulating Terpenoid Biosynthesis
atggcagacgaagccaacagaaccgcaagtcctttctattctcactcccctctctttccacctgcttttatagagctacaagaccgcatgattgagaccacttccaaattcaagcaggtccagaaccagatacgaaccaaggagggagaaaagaagcgtgctttcctaaccttagaggagctgcggcaagttcttgatgatacaaatacatacaaatctataggcatgtttgccttggagccaaagtcagttttaatgagtgaacaagagcagaaactcaaagatagggagaccacctcaagggaatacttggaaaaacagatgtcagaggttgagaacaacctgagggaacttttgcagcaagatacaggtcttgctcgtcagatattgtccatgagtgtaatgtaa

SEQ ID NO: 1337 - protein, 135 aa, Populus balsamifera subsp. trichocarpa
  misc_feature (1)..(135): Ceres ANNOT ID no. 1535523
  misc_feature (24)..(122): Pfam Name: KE2 Pfam Description: KE2 family protein
  misc_feature: SWISSPROT Homolog: PFD1_BOVIN Prefoldin subunit 1 with e-value of 2.0e-15 and BLAST sequence identity of 36.0
  misc_feature: SWISSPROT Homolog: PFD1_HUMAN Prefoldin subunit 1 with e-value of 2.0e-15 and BLAST sequence identity of 36.0
  misc_feature: SWISSPROT Homolog: PFD1_MOUSE Prefoldin subunit 1 with e-value of 2.0e-15 and BLAST sequence identity of 36.0
  misc_feature: SWISSPROT Homolog: PFD1_PONPY Prefoldin subunit 1 with e-value of 2.0e-15 and BLAST sequence identity of 36.0
  misc_feature: SWISSPROT Homolog: PFD1_BRARE Prefoldin subunit 1 with e-value of 1.2e-13 and BLAST sequence identity of 33.3
  misc_feature 144254:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(135): Functional Homolog of  Ceres CLONE ID no. 34060 at SEQ ID NO. 1374 with e-value of 7.59E-36 and BLAST sequence identity of 71.6
MADEANRTASPFYSHSPLFPPAFIELQDRMIETTSKFKQVQNQIRTKEGEKKRAFLTLEELRQVLDDTNTYKSIGMFALEPKSVLMSEQEQKLKDRETTSREYLEKQMSEVENNLRELLQQDTGLARQILSMSVM

SEQ ID NO: 1338 - protein, 424 aa, Arabidopsis thaliana
  misc_feature (1)..(424): Ceres CLONE ID no. 34151
  misc_feature (63)..(239): Pfam Name: CBS Pfam Description: CBS domain pair
  misc_feature: Phenotype: INFLORESCENCE - Late Flowering Useful for modulating flowering time
  misc_feature: Phenotype: FLOWER - Reduced fertility Useful for sterility, genetic confinement systems
MATVPEIKIMRSESLGHRSDVSSPEAKLGMRVEDLWDEQKPQLSPNEKLNACFESIPVSAFPLSSDSQDIEIRSDTSLAEAVQTLSKFKVLSAPVVDVDAPEDASWIDRYIGIVEFPGIVVWLLHQLEPPSPRSPAVAASNGFSHDFTTDVLDNGDSAVTSGNFFEVLTSSELYENTKVRDISGTFRWAPFLALQKENSFLTMLLLLSKYKMKSIPVVDLGVAKIENIITQSGVIHMLAECAGLLWFEDWGIKTLSEVGLPIMSKDHIIKIYEDEPVLQAFKLMRRKRIGGIPVIERNSEKPVGNISLRDVQFLLTAPEIYHDYRSITTKNFLVSVREHLEKCGDTSAPIMSGVIACTKNHTLKELILMLDAEKIHRIYVVDEFGNLEGLITLRDIIARLVHEPSGYFGDFFDGVMPLPENYRV

SEQ ID NO: 1339 - DNA, 1281 bp, Populus balsamifera subsp. trichocarpa
  misc_feature (1)..(1281): Ceres ANNOT ID no. 1473827
  misc_feature 144430:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
atgcagcttatgagaaaggaaaatgctattgttcatgaagttatgcaagatagtccaaaaagtccagaggcaaggctgggaatgaaagtagaggatttatgggatgttcaagaaccacagttaagtccaactgagaaacttaacgcttgctttgagagtatccctgtctctgctttccctcctgctccttcttctcaagtgatcgagataaaatcagacaccagtctagcagaggctgttcaaatactttcagaacacaagattcttagtgcccctgtggtggatgttgatgctcctgaggatgctagctggattgacagatacattgggattgttgagtttgctgggattgtagtctggattttgcatcagtcggaacctccatcacccaggagtacaaccccgggatcagctcttgaagtagctgttaatagagtgaccaatgcagctggtttcgggatcttaggccctgaagatgctcaagcaacttctggaaatttttttgaggcactgacttcttctgaattctacaagaacacaaaggttcgagacattgcagggtcattccgttgggcaccatttcttgccttacagaaatcaaactcctttttgaccatgcttctgctgctttcaaattacaaaatgaagagcgttccagtggttgatctgggtgaggcgaagattgacaacatcgtcactcagtcttctgttattcacatgttagcagaatgtgctgggcttcaatggtttgaaagttggggaaccaagaaactttctgaaattggtcttcccctgatgacccgtgatcatgtagtcaaggtgtacgaggaagaaccagtgctccaggcatttaagctgatgaggaaaaagagagttggagcaatacctattgttgatagtagcggtataaaggttgttggcaacataagtataagagatgtccagttccttttaactgcaccagagatctaccacgattatagatctatcacagcgaagaacttcttgacggcagttagaagctacttgaagaagcatcaaggaacctcaccttttgtgagtggcatggtggtatgcacaaaaaaccactctgttaaagaattgattatgaagcttgactctgagaaaatccaccgtgtatatgttgtggatgatgctgggaatctggaaggggtgatcacattgagagacataatctcaaggcttgtacatgagccctatggctactttggtgatttctttgatggagtgctgccattacctttgaacagtagagtataa

SEQ ID NO: 1340 - protein, 426 aa, Populus balsamifera subsp. trichocarpa
  misc_feature (1)..(426): Ceres ANNOT ID no. 1473827
  misc_feature (61)..(242): Pfam Name: CBS Pfam Description: CBS domain pair
  misc_feature: SWISSPROT Homolog: KING1_ARATH SNF1-related protein kinase regulatory gamma subunit 1 (AKING1) with e-value of 4.9e-225 and BLAST sequence identity of 99.5
  misc_feature: SWISSPROT Homolog: AAKG3_MOUSE A 5'-AMP-activated protein kinase, gamma-3 subunit AMPK gamma3 with e-value of 1.2e-09 and BLAST sequence identity of 25.8
  misc_feature: SWISSPROT Homolog: AAKG3_HUMAN A 5'-AMP-activated protein kinase, gamma-3 subunit AMPK gamma3 with e-value of 1.6e-09 and BLAST sequence identity of 25.3
  misc_feature: SWISSPROT Homolog: AAKG3_PIG A 5'-AMP-activated protein kinase, gamma-3 subunit AMPK gamma3 with e-value of 1.9e-09 and BLAST sequence identity of 25.3
  misc_feature: SWISSPROT Homolog: AAKG2_MOUSE A 5'-AMP-activated protein kinase, gamma-2 subunit AMPK gamma2 with e-value of 8.0e-09 and BLAST sequence identity of 25.8
  misc_feature 144552:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature (1)..(426): Functional Homolog of  Ceres CLONE ID no. 34151 at SEQ ID NO. 1379 with e-value of 3.29E-161 and BLAST sequence identity of 72.9
MQLMRKENAIVHEVMQDSPKSPEARLGMKVEDLWDVQEPQLSPTEKLNACFESIPVSAFPPAPSSQVIEIKSDTSLAEAVQILSEHKILSAPVVDVDAPEDASWIDRYIGIVEFAGIVVWILHQSEPPSPRSTTPGSALEVAVNRVTNAAGFGILGPEDAQATSGNFFEALTSSEFYKNTKVRDIAGSFRWAPFLALQKSNSFLTMLLLLSNYKMKSVPVVDLGEAKIDNIVTQSSVIHMLAECAGLQWFESWGTKKLSEIGLPLMTRDHVVKVYEEEPVLQAFKLMRKKRVGAIPIVDSSGIKVVGNISIRDVQFLLTAPEIYHDYRSITAKNFLTAVRSYLKKHQGTSPFVSGMVVCTKNHSVKELIMKLDSEKIHRVYVVDDAGNLEGVITLRDIISRLVHEPYGYFGDFFDGVLPLPLNSRV

SEQ ID NO: 1341 - DNA, 1290 bp, Populus balsamifera subsp. trichocarpa
  misc_feature (1)..(1290): Ceres ANNOT ID no. 1468614
  misc_feature 144673:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
atggcaagcatgcagcttatgagaagggaaagtgcttttgttcatgaggttacgcaagacagtccaaaaagtccagaagcaaggctgggaatgaaagtagaggatctatgggatgttcaagaaccacagttaactccaactgagaaacttaacgcttgctttgagggtatccctgtctctgccttccctcccgctccttcttctcaagtgatcgagataaaatcagacaccagtctagcagaggctgttcgtatacttgcagaacacaagattcttagtgctcctgtggtggatgttgatgctcctgaggatgctagttggattgacagatatattggagttgttgagtttgctgggattatagtgtggattttacatcagtcggaacctccatcacccagaagtccaacctcgggatcagctcttgaagcggctgttaatagagtgaccaatgctgctagtctcggaaccttaggtcctgaagatgctgcagcaacttctggaaatttttttgaggctctgacttcttccgaattctacaagaacacaaaggttcgagacattgcagggtcattccgttgggcaccgtttctcgctttacagaaatcaaactcctttctgaccatgcttctgttgctttcgagttacaagatgaagagcattccagtggttgatctgggtgaggcgaagattgacaacatcatcacccagtcttctgttattcacatgttagcggaatgtgctgggcttcaatggtttgaaagttggggaacaaggaaactttctgaaattggtcttcccttgatggcccctgatcgtatagtcaaggtgtacgaggaagaaccagtgctccaggcatttaagctgatgaggaaaaaaaaaattggtggaatacctattgttgatagtagcggtggaaaggtagtaggcaacataagtataagagatgtccatttccttttaactgcaccagagatctaccacgattatagatccatcacggcaaagaacttctcgactgcagttaacggctacttggagacgcatcaagaaatctcaccttttgtgcgtggcatggtgatatgcacaaaaaactactccattaaagaattgatcatgaagcttgattctgagaaaatccaccgggtatatgtcgtggatgatgctgggaatctggaaggggtgatcacactgagggatatactatcaaggcttgtacacgagccccgtggctactttggtgatttctttgacggagtgctgccattaccttcgaatagtagagtttaa

SEQ ID NO: 1342 - protein, 426 aa, Populus balsamifera subsp. trichocarpa
  misc_feature (1)..(426): Ceres ANNOT ID no. 1468614
  misc_feature (61)..(242): Pfam Name: CBS Pfam Description: CBS domain pair
  misc_feature: SWISSPROT Homolog: KING1_ARATH SNF1-related protein kinase regulatory gamma subunit 1 AKIN gamma1 (AKING1) with e-value of 4.9e-225 and BLAST sequence identity of 99.5
  misc_feature: SWISSPROT Homolog: AAKG3_MOUSE A 5'-AMP-activated protein kinase, gamma-3 subunit AMPK gamma3 with e-value of 1.2e-09 and BLAST sequence identity of 25.8
  misc_feature: SWISSPROT Homolog: AAKG3_HUMAN A 5'-AMP-activated protein kinase, gamma-3 subunit AMPK gamma3 with e-value of 1.6e-09 and BLAST sequence identity of 25.3
  misc_feature: SWISSPROT Homolog: AAKG3_PIG A 5'-AMP-activated protein kinase, gamma-3 subunit (AMPK gamma3) with e-value of 1.9e-09 and BLAST sequence identity of 25.3
  misc_feature: SWISSPROT Homolog: AAKG2_MOUSE A 5'-AMP-activated protein kinase, gamma-2 subunit AMPK gamma2 with e-value of 8.0e-09 and BLAST sequence identity of 25.8
  misc_feature 144795:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature (1)..(426): Functional Homolog of  Ceres CLONE ID no. 34151 at SEQ ID NO. 1379 with e-value of 7.29E-157 and BLAST sequence identity of 70.7
MQLMRRESAFVHEVTQDSPKSPEARLGMKVEDLWDVQEPQLTPTEKLNACFEGIPVSAFPPAPSSQVIEIKSDTSLAEAVRILAEHKILSAPVVDVDAPEDASWIDRYIGVVEFAGIIVWILHQSEPPSPRSPTSGSALEAAVNRVTNAASLGTLGPEDAAATSGNFFEALTSSEFYKNTKVRDIAGSFRWAPFLALQKSNSFLTMLLLLSSYKMKSIPVVDLGEAKIDNIITQSSVIHMLAECAGLQWFESWGTRKLSEIGLPLMAPDRIVKVYEEEPVLQAFKLMRKKKIGGIPIVDSSGGKVVGNISIRDVHFLLTAPEIYHDYRSITAKNFSTAVNGYLETHQEISPFVRGMVICTKNYSIKELIMKLDSEKIHRVYVVDDAGNLEGVITLRDILSRLVHEPRGYFGDFFDGVLPLPSNSRV

SEQ ID NO: 1343 - protein, 282 aa, Arabidopsis thaliana
  misc_feature (1)..(282): Ceres CLONE ID no. 34167
  misc_feature (1)..(282): Also Known As Ceres CDNA ID no. 23385560
  misc_feature (1)..(282): Also Known As Ceres GEMINI ID 531B5
  misc_feature (1)..(98): Pfam Name: HD-ZIP_N Pfam Description: HD-ZIP protein N terminus
  misc_feature (135)..(189): Pfam Name: Homeobox Pfam Description: Homeobox domain
  misc_feature (190)..(234): Pfam Name: HALZ Pfam Description: Homeobox associated leucine zipper
  misc_feature 144948:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 1344 - DNA, 909 bp, Populus balsamifera subsp. trichocarpa
  misc_feature (1)..(909): Ceres ANNOT ID no. 1538733
  misc_feature 145063:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
atgatggctgggaaggaagatttgggtttgagtttaagtcttagtgttcctcaaaatcaacattctctgcagttgaatctcatgccttcactggttccatcgactgcttcttcttctctctctgggttccatcctcaaaaaccctcatggaatgtgaccttcccttcttcagatccaaactctaattcataccgggccgagacaagatcgttgcttcgaggaatcgacgtgaacaggttaccatcaacggctgattgtgaagaggaagcgggggtttcatctccaaacagcacgatatcgagtattagtgggaagagaagtgaaagagaaggtattaatggagatgagcatgagatggagagagcttcttctcatggaatcagtgatgaagaagatggtgaaacctcaagaaagaagctcaggctgtctaaagatcaggccgctattcttgaagagagcttcaaagaacacaacactctcaacccgaagcaaaagatggctttggctaagcagttaggactcagacctagacaagtggaggtgtggtttcagaacaggagggcaagaaccaagctgaagcaaaccgaggttgactgtgagttcttgaagagatgctgcgagaacttgacagaagagaacaggaggttgcaaaaggaggttcaggagcttagagctctcaaactttcaccacagttctacatgcaaatgaccccaccaaccaccctcaccatgtgcccatcatgtgagcgtgttgcagccccccccaccgcatcatccaccgttgatgccaggccccatccccatatcggtcctacccgtcataggcccgtccccatgaacccatgggctccggctgctccagtcacacgtggaccaacaccgtttgatgccatccgtcctcgatcgtaa

SEQ ID NO: 1345 - protein, 302 aa, Populus balsamifera subsp. trichocarpa
  misc_feature (1)..(302): Ceres ANNOT ID no. 1538733
  misc_feature (1)..(112): Pfam Name: HD-ZIP_N Pfam Description: HD-ZIP protein N terminus
  misc_feature (138)..(192): Pfam Name: Homeobox Pfam Description: Homeobox domain
  misc_feature (193)..(237): Pfam Name: HALZ Pfam Description: Homeobox associated leucine zipper
  misc_feature: SWISSPROT Homolog: HAT1_ARATH Homeobox-leucine zipper protein HAT1 (HD-ZIP protein 1) with e-value of 2.6e-148 and BLAST sequence identity of 99.6
  misc_feature: SWISSPROT Homolog: HAT2_ARATH Homeobox-leucine zipper protein HAT2 (HD-ZIP protein 2) with e-value of 2.3e-108 and BLAST sequence identity of 76.4
  misc_feature: SWISSPROT Homolog: ATHB4_ARATH Homeobox-leucine zipper protein ATHB-4 (HD-ZIP protein ATHB-4) with e-value of 1.4e-64 and BLAST sequence identity of 60.5
  misc_feature: SWISSPROT Homolog: HAT3_ARATH Homeobox-leucine zipper protein HAT3 (HD-ZIP protein 3) with e-value of 1.7e-64 and BLAST sequence identity of 59.3
  misc_feature: SWISSPROT Homolog: HAT4_ARATH Homeobox-leucine zipper protein HAT4 (HD-ZIP protein 4) (HD-ZIP protein ATHB-2) with e-value of 9.6e-62 and BLAST sequence identity of 50.0
  misc_feature 145214:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature (1)..(302): Functional Homolog of  Ceres CLONE ID no. 34167 at SEQ ID NO. 1384 with e-value of 2.39E-80 and BLAST sequence identity of 70.0
MMAGKEDLGLSLSLSVPQNQHSLQLNLMPSLVPSTASSSLSGFHPQKPSWNVTFPSSDPNSNSYRAETRSLLRGIDVNRLPSTADCEEEAGVSSPNSTISSISGKRSEREGINGDEHEMERASSHGISDEEDGETSRKKLRLSKDQAAILEESFKEHNTLNPKQKMALAKQLGLRPRQVEVWFQNRRARTKLKQTEVDCEFLKRCCENLTEENRRLQKEVQELRALKLSPQFYMQMTPPTTLTMCPSCERVAAPPTASSTVDARPHPHIGPTRHRPVPMNPWAPAAPVTRGPTPFDAIRPRS

SEQ ID NO: 1346 - DNA, 915 bp, Populus balsamifera subsp. trichocarpa
  misc_feature (1)..(915): Ceres ANNOT ID no. 1499810
  misc_feature 145340:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
atgatggctgagaaggaagatctgggtttgagtttaagtctcagtgttcctcaaaatcagcattctctgcagtttaatctcatgccttcactggttccatctactgctgcttcttctctttctgggttcaatcctcaaaaaccctcatggaatgcgaccttccctccttcagatcaaaactctgatccataccgcgccgagaccagatcgttccttcgaggaatcgacgtgaacaggttaccatctacagctgattgtgaagaggaggcaggtgtatcgtctccaaatagcacgatatcgagtataagtggaaagagaagcgaaagagaagggattaacggagaggagcatgagatggagagagattattctcgtggaatcagtgatgaagaggatggtgatacctcgagaaagaagctcaggctctctaaagatcaggcagctattcttgaagaaagttttaaagaacacaacactctcaacccaaagcagaagatggccttggctaaacagctaggactccgacctagacaagtggaggtgtggtttcagaaccgaagggcaaggacaaagctgaagcaaactgaggttgactgtgagttcttgaagaggtgctgtgagaacctaacggcggagaacaggaggttgcaaaaggaagttcaggagctcagagcactgaaactttccccgcagttctacatgcaaatgaccccaccaaccaccctcaccatgtgcccatcatgtgagcgtgtagcggtcccaccgtccgcatcatccaccgttgatgctaggtcccatccccatatgggccccactcctcctcatcacaggcccatccccatcaacccatgggccccagccgcaccaatcacacgtggaccgactccgtttgatgtactacgtcctagatcgtaa

SEQ ID NO: 1347 - protein, 304 aa, Populus balsamifera subsp. trichocarpa
  misc_feature (1)..(304): Ceres ANNOT ID no. 1499810
  misc_feature (1)..(112): Pfam Name: HD-ZIP_N Pfam Description: HD-ZIP protein N terminus
  misc_feature (138)..(192): Pfam Name: Homeobox Pfam Description: Homeobox domain
  misc_feature (193)..(237): Pfam Name: HALZ Pfam Description: Homeobox associated leucine zipper
  misc_feature: SWISSPROT Homolog: HAT1_ARATH Homeobox-leucine zipper protein HAT1 (HD-ZIP protein 1) with e-value of 2.6e-148 and BLAST sequence identity of 99.6
  misc_feature: SWISSPROT Homolog: HAT2_ARATH Homeobox-leucine zipper protein HAT2 (HD-ZIP protein 2) with e-value of 2.3e-108 and BLAST sequence identity of 76.4
  misc_feature: SWISSPROT Homolog: ATHB4_ARATH Homeobox-leucine zipper protein ATHB-4 (HD-ZIP protein ATHB-4) with e-value of 1.4e-64 and BLAST sequence identity of 60.5
  misc_feature: SWISSPROT Homolog: HAT3_ARATH Homeobox-leucine zipper protein HAT3 (HD-ZIP protein 3) with e-value of 1.7e-64 and BLAST sequence identity of 59.3
  misc_feature: SWISSPROT Homolog: HAT4_ARATH Homeobox-leucine zipper protein HAT4 (HD-ZIP protein 4) (HD-ZIP protein ATHB-2) with e-value of 9.6e-62 and BLAST sequence identity of 50.0
  misc_feature 145491:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature (1)..(304): Functional Homolog of  Ceres CLONE ID no. 34167 at SEQ ID NO. 1384 with e-value of 3.99E-78 and BLAST sequence identity of 69.2
MMAEKEDLGLSLSLSVPQNQHSLQFNLMPSLVPSTAASSLSGFNPQKPSWNATFPPSDQNSDPYRAETRSFLRGIDVNRLPSTADCEEEAGVSSPNSTISSISGKRSEREGINGEEHEMERDYSRGISDEEDGDTSRKKLRLSKDQAAILEESFKEHNTLNPKQKMALAKQLGLRPRQVEVWFQNRRARTKLKQTEVDCEFLKRCCENLTAENRRLQKEVQELRALKLSPQFYMQMTPPTTLTMCPSCERVAVPPSASSTVDARSHPHMGPTPPHHRPIPINPWAPAAPITRGPTPFDVLRPRS

SEQ ID NO: 1348 - DNA, 954 bp, Populus balsamifera subsp. trichocarpa
  misc_feature (1)..(954): Ceres ANNOT ID no. 1485323
  misc_feature 145620:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
atggctgggaaggaagatttgggtttgagtttaagtcttagtgttcctcaaaatcaacattctctgcagttgaatctcatgccttcactggttccatcgactgcttcttcttctctctctgggttccatcctcaaaaaccctcatggaatgtgaccttcccttcttcagatccaaactctaattcataccgggccgagacaagatcgttgcttcgaggaatcgacgtgaacaggttaccatcaacggctgattgtgaagaggaagcgggggtttcatctccaaacagcacgatatcgagtattagtgggaagagaagtgaaagagaaggtattaatggagatgagcatgagatggagagagcttcttctcatggaatcagtgatgaagaagatggtgaaacctcaagaaagaagctcaggctgtctaaagatcaggccgctattcttgaagagagcttcaaagaacacaacactctcaacccgggtattttggtaattgacactgacaatcggttgttccggttccggcagaagcaaaagatggctttggctaagcagttaggactcagacctagacaagtggaggtgtggtttcagaacaggagggcaagaaccaagctgaagcaaaccgaggttgactgtgagttcttgaagagatgctgcgagaacttgacagaagagaacaggaggttgcaaaaggaggttcaggagcttagagctctcaaactttcaccacagttctacatgcaaatgaccccaccaaccaccctcaccatgtgcccatcatgtgagcgtgttgcagccccccccaccgcatcatccaccgttgatgccaggccccatccccatatcggtcctacccgtcataggcccgtccccatgaacccatgggctccggctgctccagtcacacgtggaccaacaccgtttgatgccatccgtcctcgatcgtaa

SEQ ID NO: 1349 - protein, 317 aa, Populus balsamifera subsp. trichocarpa
  misc_feature (1)..(317): Ceres ANNOT ID no. 1485323
  misc_feature (1)..(111): Pfam Name: HD-ZIP_N Pfam Description: HD-ZIP protein N terminus
  misc_feature (137)..(161): Pfam Name: Homeobox Pfam Description: Homeobox domain
  misc_feature (208)..(252): Pfam Name: HALZ Pfam Description: Homeobox associated leucine zipper
  misc_feature: SWISSPROT Homolog: HAT1_ARATH Homeobox-leucine zipper protein HAT1 (HD-ZIP protein 1) with e-value of 2.6e-148 and BLAST sequence identity of 99.6
  misc_feature: SWISSPROT Homolog: HAT2_ARATH Homeobox-leucine zipper protein HAT2 (HD-ZIP protein 2) with e-value of 2.3e-108 and BLAST sequence identity of 76.4
  misc_feature: SWISSPROT Homolog: ATHB4_ARATH Homeobox-leucine zipper protein ATHB-4 (HD-ZIP protein ATHB-4) with e-value of 1.4e-64 and BLAST sequence identity of 60.5
  misc_feature: SWISSPROT Homolog: HAT3_ARATH Homeobox-leucine zipper protein HAT3 (HD-ZIP protein 3) with e-value of 1.7e-64 and BLAST sequence identity of 59.3
  misc_feature: SWISSPROT Homolog: HAT4_ARATH Homeobox-leucine zipper protein HAT4 (HD-ZIP protein 4) (HD-ZIP protein ATHB-2) with e-value of 9.6e-62 and BLAST sequence identity of 50.0
  misc_feature 145771:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature (1)..(317): Functional Homolog of  Ceres CLONE ID no. 34167 at SEQ ID NO. 1384 with e-value of 1.10E-75 and BLAST sequence identity of 69.8
MAGKEDLGLSLSLSVPQNQHSLQLNLMPSLVPSTASSSLSGFHPQKPSWNVTFPSSDPNSNSYRAETRSLLRGIDVNRLPSTADCEEEAGVSSPNSTISSISGKRSEREGINGDEHEMERASSHGISDEEDGETSRKKLRLSKDQAAILEESFKEHNTLNPGILVIDTDNRLFRFRQKQKMALAKQLGLRPRQVEVWFQNRRARTKLKQTEVDCEFLKRCCENLTEENRRLQKEVQELRALKLSPQFYMQMTPPTTLTMCPSCERVAAPPTASSTVDARPHPHIGPTRHRPVPMNPWAPAAPVTRGPTPFDAIRPRS

SEQ ID NO: 1350 - protein, 227 aa, Arabidopsis thaliana
  misc_feature (1)..(227): Ceres CLONE ID no. 34210
  misc_feature (45)..(206): Pfam Name: CDP-OH_P_transf Pfam Description: CDP-alcohol phosphatidyltransferase
  misc_feature: Phenotype: FLOWER - Reduced fertility Useful for sterility, genetic confinement systems
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 1351 - DNA, 693 bp, Populus balsamifera subsp. trichocarpa; identical to SEQ ID NO: 1076
  misc_feature (1)..(693): Ceres ANNOT ID no. 1503622
  misc_feature 145973:<222: Transcription Factor
  misc_feature: Phenotype: FLOWER - Reduced fertility Useful for sterility, genetic confinement systems

SEQ ID NO: 1352 - protein, 230 aa, Populus balsamifera subsp. trichocarpa; identical to SEQ ID NO: 1077
  misc_feature (1)..(230): Ceres ANNOT ID no. 1503622
  misc_feature (48)..(169): Pfam Name: CDP-OH_P_transf Pfam Description: CDP-alcohol phosphatidyltransferase
  misc_feature: SWISSPROT Homolog: PIS1_ARATH CDP-diacylglycerol--inositol 3-phosphatidyltransferase 1 with e-value of 1.7e-119 and BLAST sequence identity of 99.6
  misc_feature: SWISSPROT Homolog: PIS1_ARATH EC 2.7.8.11 (Phosphatidylinositol synthase 1) PtdIns synthase 1 (PI synthase 1) (AtPIS1)
  misc_feature: SWISSPROT Homolog: PIS2_ARATH Probable CDP-diacylglycerol--inositol 3- phosphatidyltransferase 2 with e-value of 1.3e-103 and BLAST sequence identity of 87.2
  misc_feature: SWISSPROT Homolog: PIS2_ARATH EC 2.7.8.11 (Phosphatidylinositol synthase 2) (PtdIns synthase 2) (PI synthase 2) (AtPIS2)
  misc_feature: SWISSPROT Homolog: YAT8_SCHPO Hypothetical protein C1D4.08 in chromosome I with e-value of 1.7e-30 and BLAST sequence identity of 37.4
  misc_feature: SWISSPROT Homolog: PIS_YEAST CDP-diacylglycerol-inositol 3-phosphatidyltransferase(EC 2.7.8.11) (Phosphatidylinositol synthase) (PTDINS synthase) (PI synthase) with e-value of 1.2e-29 and BLAST sequence identity of 42.1
  misc_feature: SWISSPROT Homolog: CDIPT_RAT CDP-diacylglycerol-inositol 3-phosphatidyltransferase(EC 2.7.8.11) (Phosphatidylinositol synthase) (PtdIns synthase) (PI synthase) with e-value of 1.1e-26 and BLAST sequence identity of 36.4
  misc_feature 146082:<222: Transcription Factor
  misc_feature: Phenotype: FLOWER - Reduced fertility Useful for sterility, genetic confinement systems
  misc_feature (1)..(230): Functional Homolog of  Ceres CLONE ID no. 34210 at SEQ ID NO. 1391 with e-value of 3.69E-91 and BLAST sequence identity of 74.0

SEQ ID NO: 1353 - DNA, 702 bp, Populus balsamifera subsp. trichocarpa; identical to SEQ ID NO: 1078
  misc_feature (1)..(702): Ceres ANNOT ID no. 1450565
  misc_feature 146160:<222: Transcription Factor
  misc_feature: Phenotype: FLOWER - Reduced fertility Useful for sterility, genetic confinement systems

SEQ ID NO: 1354 - protein, 233 aa, Populus balsamifera subsp. trichocarpa; identical to SEQ ID NO: 1079
  misc_feature (1)..(233): Ceres ANNOT ID no. 1450565
  misc_feature (48)..(197): Pfam Name: CDP-OH_P_transf Pfam Description: CDP-alcohol phosphatidyltransferase
  misc_feature: SWISSPROT Homolog: PIS1_ARATH CDP-diacylglycerol--inositol 3-phosphatidyltransferase 1 with e-value of 1.7e-119 and BLAST sequence identity of 99.6
  misc_feature: SWISSPROT Homolog: PIS1_ARATH EC 2.7.8.11 (Phosphatidylinositol synthase 1) PtdIns synthase 1 (PI synthase 1) (AtPIS1)
  misc_feature: SWISSPROT Homolog: PIS2_ARATH Probable CDP-diacylglycerol--inositol 3- phosphatidyltransferase 2 with e-value of 1.3e-103 and BLAST sequence identity of 87.2
  misc_feature: SWISSPROT Homolog: PIS2_ARATH EC 2.7.8.11 (Phosphatidylinositol synthase 2) (PtdIns synthase 2) (PI synthase 2) (AtPIS2)
  misc_feature: SWISSPROT Homolog: YAT8_SCHPO Hypothetical protein C1D4.08 in chromosome I with e-value of 1.7e-30 and BLAST sequence identity of 37.4
  misc_feature: SWISSPROT Homolog: PIS_YEAST CDP-diacylglycerol-inositol 3-phosphatidyltransferase(EC 2.7.8.11) (Phosphatidylinositol synthase) (PTDINS synthase) (PI synthase) with e-value of 1.2e-29 and BLAST sequence identity of 42.1
  misc_feature: SWISSPROT Homolog: CDIPT_RAT CDP-diacylglycerol-inositol 3-phosphatidyltransferase(EC 2.7.8.11) (Phosphatidylinositol synthase) (PtdIns synthase) (PI synthase) with e-value of 1.1e-26 and BLAST sequence identity of 36.4
  misc_feature 146269:<222: Transcription Factor
  misc_feature: Phenotype: FLOWER - Reduced fertility Useful for sterility, genetic confinement systems
  misc_feature (1)..(233): Functional Homolog of  Ceres CLONE ID no. 34210 at SEQ ID NO. 1391 with e-value of 3.50E-79 and BLAST sequence identity of 73.6

SEQ ID NO: 1355 - protein, 154 aa, Arabidopsis thaliana
  misc_feature (1)..(154): Ceres CLONE ID no. 34358
  misc_feature (7)..(106): Pfam Name: Auxin_inducible Pfam Description: Auxin responsive protein
  misc_feature: Utility: ABA Useful for making plants with enhanced tolerance to drought
  misc_feature: Phenotype: WHOLE PLANT - ABA Useful for making plants with enhanced tolerance to drought
MAGGLGKCSKIRHIVRLRQMLRRWRDQARMSSSFSRCVPSDLPSGHVAVYVGSSCRRFVVRATYLNHPVLRNLLVQAEEEFGFVNQGPLVIPCEESVFEESIRFISRSDSTRSRRFTCPDDFQKNCHVVGIRSKPDLWIESRPLLHGVTEKAVW

SEQ ID NO: 1356 - DNA, 450 bp, Populus balsamifera subsp. trichocarpa
  misc_feature (1)..(450): Ceres ANNOT ID no. 1452837
  misc_feature: Utility: ABA Useful for making plants with enhanced tolerance to drought
  misc_feature 146417:<222: Transcription Factor
  misc_feature: Phenotype: WHOLE PLANT - ABA Useful for making plants with enhanced tolerance to drought
atggcagctgggcaagcaaaatgcaccaaaatccgccacatagtgaggcttcgccaaatgctaagacgttggcgcaacaaggcacgcatgtcagccaatcgcataccatcagacgttccagcaggacatgtggcagtctgtgtagggactagttgccggagatttgtggtgcgagcgacgtacttgaaccaccccatctttaaaaagctcctggtacaagccgaggaagagtttggcttttctaaccaaggcccattagtgatcccgtgcgatgaggccgtttttgaggaagtgattcgatacatttcacggtctgagaatggaaagtccggccggtttgtgaaccttgaggatttgcagagatactgccacgttggtgttaaaaatgctaagcttgatttttggaccgattcaagacctttgcttcatgctgacaagacattctggtaa

SEQ ID NO: 1357 - protein, 149 aa, Populus balsamifera subsp. trichocarpa
  misc_feature (1)..(149): Ceres ANNOT ID no. 1452837
  misc_feature (11)..(103): Pfam Name: Auxin_inducible Pfam Description: Auxin responsive protein
  misc_feature: SWISSPROT Homolog: AX6B_SOYBN Auxin-induced protein 6B with e-value of 5.3e-13 and BLAST sequence identity of 43.2
  misc_feature: SWISSPROT Homolog: AX15A_SOYBN Auxin-induced protein 15A with e-value of 6.8e-13 and BLAST sequence identity of 52.5
  misc_feature: SWISSPROT Homolog: AXX15_SOYBN Auxin-induced protein X15 with e-value of 8.7e-13 and BLAST sequence identity of 51.7
  misc_feature: SWISSPROT Homolog: ARG7_PHAAU Indole-3-acetic acid-induced protein ARG7 with e-value of 2.3e-12 and BLAST sequence identity of 50.0
  misc_feature: SWISSPROT Homolog: A10A5_SOYBN Auxin-induced protein 10A5 with e-value of 6.1e-12 and BLAST sequence identity of 52.5
  misc_feature: Utility: ABA Useful for making plants with enhanced tolerance to drought
  misc_feature 146505:<222: Transcription Factor
  misc_feature: Phenotype: WHOLE PLANT - ABA Useful for making plants with enhanced tolerance to drought
  misc_feature (1)..(149): Functional Homolog of  Ceres CLONE ID no. 34358 at SEQ ID NO. 1396 with e-value of 6.80E-51 and BLAST sequence identity of 69.5
MAAGQAKCTKIRHIVRLRQMLRRWRNKARMSANRIPSDVPAGHVAVCVGTSCRRFVVRATYLNHPIFKKLLVQAEEEFGFSNQGPLVIPCDEAVFEEVIRYISRSENGKSGRFVNLEDLQRYCHVGVKNAKLDFWTDSRPLLHADKTFW

SEQ ID NO: 1358 - DNA, 450 bp, Populus balsamifera subsp. trichocarpa
  misc_feature (1)..(450): Ceres ANNOT ID no. 1442590
  misc_feature: Utility: ABA Useful for making plants with enhanced tolerance to drought
  misc_feature 146574:<222: Transcription Factor
  misc_feature: Phenotype: WHOLE PLANT - ABA Useful for making plants with enhanced tolerance to drought
atgtcagctgggctagcaaaatgcgccaaaatccgccacatagtgaggcttcgtcaaatgctaaggcgttggcgcaacaaggcacgaatgtcagccaatcgcataccatcggatgttccagcaggacacgtagcggtctgtgtagggactggttgcaggagatttgtggttcgcgcgacgtacctgaaccaccccatctttaaaaagctcctagtgcaagccgaagaagagtttgggttctctaaccaaggcccattaacgatcccatgcgatgagaccctttttgaggaaatgattcggtgcatttcacggtcggagaatggaaaatcagacctgtttgtgaatcttgaggatttgcagagatactgccacgttggtgttaaaaatgctaagcttgatttttggaccgattcaagacccctgcttcattctgataactcattctggtga

SEQ ID NO: 1359 - protein, 149 aa, Populus balsamifera subsp. trichocarpa
  misc_feature (1)..(149): Ceres ANNOT ID no. 1442590
  misc_feature (11)..(103): Pfam Name: Auxin_inducible Pfam Description: Auxin responsive protein
  misc_feature: SWISSPROT Homolog: AX6B_SOYBN Auxin-induced protein 6B with e-value of 5.3e-13 and BLAST sequence identity of 43.2
  misc_feature: SWISSPROT Homolog: AX15A_SOYBN Auxin-induced protein 15A with e-value of 6.8e-13 and BLAST sequence identity of 52.5
  misc_feature: SWISSPROT Homolog: AXX15_SOYBN Auxin-induced protein X15 with e-value of 8.7e-13 and BLAST sequence identity of 51.7
  misc_feature: SWISSPROT Homolog: ARG7_PHAAU Indole-3-acetic acid-induced protein ARG7 with e-value of 2.3e-12 and BLAST sequence identity of 50.0
  misc_feature: SWISSPROT Homolog: A10A5_SOYBN Auxin-induced protein 10A5 with e-value of 6.1e-12 and BLAST sequence identity of 52.5
  misc_feature: Utility: ABA Useful for making plants with enhanced tolerance to drought
  misc_feature 146662:<222: Transcription Factor
  misc_feature: Phenotype: WHOLE PLANT - ABA Useful for making plants with enhanced tolerance to drought
  misc_feature (1)..(149): Functional Homolog of  Ceres CLONE ID no. 34358 at SEQ ID NO. 1396 with e-value of 1.50E-48 and BLAST sequence identity of 66.2
MSAGLAKCAKIRHIVRLRQMLRRWRNKARMSANRIPSDVPAGHVAVCVGTGCRRFVVRATYLNHPIFKKLLVQAEEEFGFSNQGPLTIPCDETLFEEMIRCISRSENGKSDLFVNLEDLQRYCHVGVKNAKLDFWTDSRPLLHSDNSFW

SEQ ID NO: 1360 - DNA, 438 bp, Populus balsamifera subsp. trichocarpa
  misc_feature (1)..(438): Ceres ANNOT ID no. 1450457
  misc_feature: Utility: ABA Useful for making plants with enhanced tolerance to drought
  misc_feature 146731:<222: Transcription Factor
  misc_feature: Phenotype: WHOLE PLANT - ABA Useful for making plants with enhanced tolerance to drought
atgtccaagtgcaacaaaatccggcacattgtaagaatccagcaaatgcttaaacggtggcgtaggaaggcaagagtgactggaggagcaacgagttcacgcaccgctgcaccatctgatgtcccagcgggccacgtggcagtctgtgttggagccagctgcaagaggtttgttgtacgtgcgacgtaccttaaccatcccattttcaaaaacttgctcgtggaagccgaggaagtgtacggtttcaaaaccgctgggccgttagctatcccatgcgacgaggctgtctttgaagagattctccgggtcgtatcgagatcggaccccagcaaaatgggtcgtttttttaatcttgaggatcttaagagatgctgccacgtgggcatgaggaaaaatattaagcttttgggtgaatcaagaccgttgcttcatggttag

SEQ ID NO: 1361 - protein, 145 aa, Populus balsamifera subsp. trichocarpa
  misc_feature (1)..(145): Ceres ANNOT ID no. 1450457
  misc_feature (7)..(105): Pfam Name: Auxin_inducible Pfam Description: Auxin responsive protein
  misc_feature: SWISSPROT Homolog: AX6B_SOYBN Auxin-induced protein 6B with e-value of 5.3e-13 and BLAST sequence identity of 43.2
  misc_feature: SWISSPROT Homolog: AX15A_SOYBN Auxin-induced protein 15A with e-value of 6.8e-13 and BLAST sequence identity of 52.5
  misc_feature: SWISSPROT Homolog: AXX15_SOYBN Auxin-induced protein X15 with e-value of 8.7e-13 and BLAST sequence identity of 51.7
  misc_feature: SWISSPROT Homolog: ARG7_PHAAU Indole-3-acetic acid-induced protein ARG7 with e-value of 2.3e-12 and BLAST sequence identity of 50.0
  misc_feature: SWISSPROT Homolog: A10A5_SOYBN Auxin-induced protein 10A5 with e-value of 6.1e-12 and BLAST sequence identity of 52.5
  misc_feature: Utility: ABA Useful for making plants with enhanced tolerance to drought
  misc_feature 146819:<222: Transcription Factor
  misc_feature: Phenotype: WHOLE PLANT - ABA Useful for making plants with enhanced tolerance to drought
  misc_feature (1)..(145): Functional Homolog of  Ceres CLONE ID no. 34358 at SEQ ID NO. 1396 with e-value of 4.30E-42 and BLAST sequence identity of 60.5
MSKCNKIRHIVRIQQMLKRWRRKARVTGGATSSRTAAPSDVPAGHVAVCVGASCKRFVVRATYLNHPIFKNLLVEAEEVYGFKTAGPLAIPCDEAVFEEILRVVSRSDPSKMGRFFNLEDLKRCCHVGMRKNIKLLGESRPLLHG

SEQ ID NO: 1362 - DNA, 441 bp, Populus balsamifera subsp. trichocarpa
  misc_feature (1)..(441): Ceres ANNOT ID no. 1460721
  misc_feature: Utility: ABA Useful for making plants with enhanced tolerance to drought
  misc_feature 146888:<222: Transcription Factor
  misc_feature: Phenotype: WHOLE PLANT - ABA Useful for making plants with enhanced tolerance to drought
atgtccaagtgcaacaaaatccggcacattgtgagaatccagcaaatgcttaaacggtggcgtaggaaggcaagagtcacagcaggagcaacaagttcacgtactgctgctgccccatctgatgtcccagttggccacgtggcaatctgtgtaggagccagttgcaaaaggtttgttgtacgagcgacgtaccttaaccatcccatcttcaaaaacttgctcgtcgaagccgaggaagtgtacggcttcaaaaacaccgggccgttaactatcccgtgtgacgaggctgtcttcgaagagatcatccgggtcgtgtcgatatccgacccgatccaatcgggtcggtttttaaaccttgatgaaattaagagatgctgccacgtgggattgagggggaatattgagcttttgggtgaatcaacgccgttgcttcatggttag

SEQ ID NO: 1363 - protein, 146 aa, Populus balsamifera subsp. trichocarpa
  misc_feature (1)..(146): Ceres ANNOT ID no. 1460721
  misc_feature (7)..(106): Pfam Name: Auxin_inducible Pfam Description: Auxin responsive protein
  misc_feature: SWISSPROT Homolog: AX6B_SOYBN Auxin-induced protein 6B with e-value of 5.3e-13 and BLAST sequence identity of 43.2
  misc_feature: SWISSPROT Homolog: AX15A_SOYBN Auxin-induced protein 15A with e-value of 6.8e-13 and BLAST sequence identity of 52.5
  misc_feature: SWISSPROT Homolog: AXX15_SOYBN Auxin-induced protein X15 with e-value of 8.7e-13 and BLAST sequence identity of 51.7
  misc_feature: SWISSPROT Homolog: ARG7_PHAAU Indole-3-acetic acid-induced protein ARG7 with e-value of 2.3e-12 and BLAST sequence identity of 50.0
  misc_feature: SWISSPROT Homolog: A10A5_SOYBN Auxin-induced protein 10A5 with e-value of 6.1e-12 and BLAST sequence identity of 52.5
  misc_feature: Utility: ABA Useful for making plants with enhanced tolerance to drought
  misc_feature 146976:<222: Transcription Factor
  misc_feature: Phenotype: WHOLE PLANT - ABA Useful for making plants with enhanced tolerance to drought
  misc_feature (1)..(146): Functional Homolog of  Ceres CLONE ID no. 34358 at SEQ ID NO. 1396 with e-value of 6.90E-42 and BLAST sequence identity of 60.5
MSKCNKIRHIVRIQQMLKRWRRKARVTAGATSSRTAAAPSDVPVGHVAICVGASCKRFVVRATYLNHPIFKNLLVEAEEVYGFKNTGPLTIPCDEAVFEEIIRVVSISDPIQSGRFLNLDEIKRCCHVGLRGNIELLGESTPLLHG

SEQ ID NO: 1364 - protein, 337 aa, Arabidopsis thaliana
  misc_feature (1)..(337): Ceres CLONE ID no. 34385
  misc_feature (1)..(337): Also Known As Ceres CDNA ID no. 23369491
  misc_feature (1)..(337): Also Known As Ceres GEMINI ID 554A7
  misc_feature (20)..(128): Pfam Name: Mov34 Pfam Description: Mov34/MPN/PAD-1 family
  misc_feature 147059:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 1365 - DNA, 1092 bp, Populus balsamifera subsp. trichocarpa
  misc_feature (1)..(1092): Ceres ANNOT ID no. 1445331
  misc_feature 147221:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
atggcacggtctttccttcaggttgcagccacggaggaggttgctcttcctctccgtgttgttcagatggaaggactggttgttttgaagataatcaaacactgcaaggagttttcgccgtctttagtgactgggcagctcctagggttggatgttggtagcgatcttgaaattaccaactgctttccttttccgattagggaggaggatgaggagattgaagcagatggtgctaattaccagcttgaaatgatgaggtgcttgagagaggtcaatgttgacaataatactgttggatggtatcagtcaatgttgttcggttgtttccaaacggtggaattgattgagacatttatgaattaccaggaaaatattaagcggtgtgtttgtataatttatgatccttcaagagctaatcaaggtgccttagctctcaaggctttgaagctttctgattctttcatggatctgtaccgcaacaacaattttactggagagaaattgagggagaaaaacttgtcatgggtggatatttttgaggaaattcctatcaaagtttcaaattctgcacttatcagtgccttcatgactgggctagaagctgatacaccagtgactcagtgtgattatgaccgcctgcaattatcaaccagtccatatttggaaagtaatgtagaatttttgattgaatgcatggatgatttgtcagtcgagcagcagaagttccaatatcactatcggaacctttcacgccagcaagctcagcagcaagcatggcttcaaaagagaagaagtactaactgtcatagagtttatgtttatatgcccctgaaaccaaatatgaggtggaactattattttcagatagttgctatggatgctttgacaggaaattgttgtggatatggaacatatctgtcttgggttttgacatgtgcacatgctcaaagacacccagaggacaagggaaagatagaggttggctatttgaaaggcttggggtttcagaagttaggatataagctccttgtaactcttgaccactggattaacaacatttatccactgacaagtctacatcaaaaagactaa

SEQ ID NO: 1366 - protein, 363 aa, Populus balsamifera subsp. trichocarpa
  misc_feature (1)..(363): Ceres ANNOT ID no. 1445331
  misc_feature (16)..(127): Pfam Name: Mov34 Pfam Description: Mov34/MPN/PAD-1 family
  misc_feature: SWISSPROT Homolog: IF33_ARATH Eukaryotic translation initiation factor 3 subunit 3 (eIF-3 gamma) (eIF3 p38 subunit) (eIF3h) with e-value of 3.2e-180 and BLAST sequence identity of 100.0
  misc_feature: SWISSPROT Homolog: IF33_HUMAN Eukaryotic translation initiation factor 3 subunit 3 (eIF-3 gamma) (eIF3 p40 subunit) (eIF3h) with e-value of 9.6e-62 and BLAST sequence identity of 41.6
  misc_feature: SWISSPROT Homolog: IF33_BOVIN Eukaryotic translation initiation factor 3 subunit 3 (eIF-3 gamma) with e-value of 3.3e-61 and BLAST sequence identity of 41.3
  misc_feature: SWISSPROT Homolog: IF33_MOUSE Eukaryotic translation initiation factor 3 subunit 3 (eIF-3 gamma) (eIF3 p40 subunit) (eIF3h) with e-value of 8.6e-61 and BLAST sequence identity of 41.0
  misc_feature: SWISSPROT Homolog: RPN11_ASHGO 26S proteasome regulatory subunit RPN11 with e-value of 8.9e-08 and BLAST sequence identity of 25.6
  misc_feature 147400:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature (1)..(363): Functional Homolog of  Ceres CLONE ID no. 34385 at SEQ ID NO. 1405 with e-value of 1.10E-119 and BLAST sequence identity of 82.9
MARSFLQVAATEEVALPLRVVQMEGLVVLKIIKHCKEFSPSLVTGQLLGLDVGSDLEITNCFPFPIREEDEEIEADGANYQLEMMRCLREVNVDNNTVGWYQSMLFGCFQTVELIETFMNYQENIKRCVCIIYDPSRANQGALALKALKLSDSFMDLYRNNNFTGEKLREKNLSWVDIFEEIPIKVSNSALISAFMTGLEADTPVTQCDYDRLQLSTSPYLESNVEFLIECMDDLSVEQQKFQYHYRNLSRQQAQQQAWLQKRRSTNCHRVYVYMPLKPNMRWNYYFQIVAMDALTGNCCGYGTYLSWVLTCAHAQRHPEDKGKIEVGYLKGLGFQKLGYKLLVTLDHWINNIYPLTSLHQKD

SEQ ID NO: 1367 - DNA, 924 bp, Populus balsamifera subsp. trichocarpa
  misc_feature (1)..(924): Ceres ANNOT ID no. 1498316
  misc_feature 147573:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
atggcacggtctttccttcaggttgcagccacggaggaggttgctcttcctctccgtgttgttcagatggaaggactggttgttttgaagataatcaaacactgcaaggagttttcgccgtctttagtgactgggcagctcctagggttggatgttggtagcgatcttgaaattaccaactgctttccttttccgattagggaggaggatgaggagattgaagcagatggtgctaattaccagcttgaaatgatgaggtgcttgagagaggtcaatgttgacaataatactgttggatggtatcagtcaatgttgttcggttgtttccaaacggtggaattgattgagacatttatgaattaccaggaaaatattaagcggtgtgtttgtataatttatgatccttcaagagctaatcaaggtgccttagctctcaaggctttgaagctttctgattctttcatggatctgtaccgcaacaacaattttactggagagaaattgagggagaaaaacttgtcatgggtggatatttttgaggaaattcctatcaaagtttcaaattctgcacttatcagtgccttcatgactgggctagaagctgatacaccagtgactcagtgtgattatgaccgcctgcaattatcaaccagtccatatttggaaagtaatgtagaatttttgattgaatgcatggatgatttgtcagtcgagcagcagaagttccaatatcactatcggaacctttcacgccagcaagctcagcagcaagcatggcttcaaaagagaaggaaattgttgtggatatggaacatatctgtcttgggttttgacatgtgcacatgctcaaagacacccagaggacaagggaaagatagaggttggctatttgaaaggcttggggtttcagaagttaggatataa

SEQ ID NO: 1368 - protein, 307 aa, Populus balsamifera subsp. trichocarpa
  misc_feature (1)..(307): Ceres ANNOT ID no. 1498316
  misc_feature (16)..(127): Pfam Name: Mov34 Pfam Description: Mov34/MPN/PAD-1 family
  misc_feature: SWISSPROT Homolog: IF33_ARATH Eukaryotic translation initiation factor 3 subunit 3 (eIF-3 gamma) (eIF3 p38 subunit) (eIF3h) with e-value of 3.2e-180 and BLAST sequence identity of 100.0
  misc_feature: SWISSPROT Homolog: IF33_HUMAN Eukaryotic translation initiation factor 3 subunit 3 (eIF-3 gamma) (eIF3 p40 subunit) (eIF3h) with e-value of 9.6e-62 and BLAST sequence identity of 41.6
  misc_feature: SWISSPROT Homolog: IF33_BOVIN Eukaryotic translation initiation factor 3 subunit 3 (eIF-3 gamma) with e-value of 3.3e-61 and BLAST sequence identity of 41.3
  misc_feature: SWISSPROT Homolog: IF33_MOUSE Eukaryotic translation initiation factor 3 subunit 3 (eIF-3 gamma) (eIF3 p40 subunit) (eIF3h) with e-value of 8.6e-61 and BLAST sequence identity of 41.0
  misc_feature: SWISSPROT Homolog: RPN11_ASHGO 26S proteasome regulatory subunit RPN11 with e-value of 8.9e-08 and BLAST sequence identity of 25.6
  misc_feature 147746:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature (1)..(307): Functional Homolog of  Ceres CLONE ID no. 34385 at SEQ ID NO. 1405 with e-value of 8.10E-119 and BLAST sequence identity of 84.0
MARSFLQVAATEEVALPLRVVQMEGLVVLKIIKHCKEFSPSLVTGQLLGLDVGSDLEITNCFPFPIREEDEEIEADGANYQLEMMRCLREVNVDNNTVGWYQSMLFGCFQTVELIETFMNYQENIKRCVCIIYDPSRANQGALALKALKLSDSFMDLYRNNNFTGEKLREKNLSWVDIFEEIPIKVSNSALISAFMTGLEADTPVTQCDYDRLQLSTSPYLESNVEFLIECMDDLSVEQQKFQYHYRNLSRQQAQQQAWLQKRRKLLWIWNISVLGFDMCTCSKTPRGQGKDRGWLFERLGVSEVRI

SEQ ID NO: 1369 - protein, 261 aa, Arabidopsis thaliana
  misc_feature (1)..(261): Ceres CLONE ID no. 34406
  misc_feature (1)..(261): Also Known As Ceres CDNA ID no. 23380594
  misc_feature (1)..(261): Also Known As Ceres GEMINI ID 553C4
  misc_feature (39)..(110): Pfam Name: RRM_1 Pfam Description: RNA recognition motif. (a.k.a. RRM RBD, or RNP domain)
  misc_feature 147931:<222: Transcription Factor
  misc_feature: Phenotype: Activates expression of the gene endogenous to the AtDXPR (SEQ ID NO 4143) regalutory region Useful for modulating Terpenoid Biosynthesis
MRGRSYTPSPPRGYGRRGRSPSPRGRFGGSRDSDLPTSLLVRNLRHDCRQEDLRRPFEQFGPVKDIYLPRDYYTGDPRGFGFIQFMDPADAAEAKHQMDGYLLLGRELTVVFAEENRKKPTEMRTRDRGGRSNRFQDRRRSPPRYSRSPPRRGRRSRSRSCGYNSPPAKRHQSRSVSPQDRRYEKERSYSRSPPHNGSRVRSGSPGRVKSHSRSPRRSVSPRKNRSYTPEQARSQSPVPRQSRSPTPVPRGAQNGDRSPSQ

SEQ ID NO: 1370 - DNA, 735 bp, Populus balsamifera subsp. trichocarpa
  misc_feature (1)..(735): Ceres ANNOT ID no. 1490409
  misc_feature 148007:<222: Transcription Factor
  misc_feature: Phenotype: Activates expression of the gene endogenous to the AtDXPR (SEQ ID NO 4143) regalutory region Useful for modulating Terpenoid Biosynthesis
atgaggggaaggagttatagtccatcgcctccaaggggctatggtagaaggggacggagtcctagtcctcggggacgttatggtggtcgtagcagggatcttcctactagcctcctagttcgcaaccttcgtcatgattgcaggccagaagaccttcgcagaccctttgaacaatttggtgctctcaaggacatttacttgcctagagattattatactggggaaccccgtggttttggctttgtccaatttgcagatcctcatgatgctgctgaggcaaaacatcatatggatggtcgagttcttcttggccgggagttgactgttgtatttgctgaggagaataggaagaagccaatggatatgagaacaagggagcgtacaaggggtcgatttcgtgatagaagaagatcacctcctcgttattctcggtcaccacgccattctcgttctccacctccacgccatgcaagatccccatcccgtagtcgagagtattattcccctcctccaaaaagaaggcatcactcaagatctgtttcaccccaagaggggaggtacagtcaagagaggccatattcgagatcaaggagccacagccaaactccagttaggagcaggagccgcagcccagttagaagcagaagccgcagcccaagaagaagcagaagccatagcccaaatcatgatgaatatcctagggaagcaaatggagaaagatctcctagtccttaa

SEQ ID NO: 1371 - protein, 244 aa, Populus balsamifera subsp. trichocarpa
  misc_feature (1)..(244): Ceres ANNOT ID no. 1490409
  misc_feature (38)..(109): Pfam Name: RRM_1 Pfam Description: RNA recognition motif. (a.k.a. RRM RBD, or RNP domain)
  misc_feature: SWISSPROT Homolog: FUSIP_HUMAN FUS-interacting serine-arginine-rich protein 1 with e-value of 2.4e-33 and BLAST sequence identity of 41.2
  misc_feature: SWISSPROT Homolog: FUSIP_HUMAN TLS-associated protein with Ser-Arg repeats TLS-associated protein with SR repeats (TASR) TLS-associated serine-arginine protein
  misc_feature: SWISSPROT Homolog: FUSIP_MOUSE FUS-interacting serine-arginine-rich protein 1 with e-value of 2.4e-33 and BLAST sequence identity of 41.2
  misc_feature: SWISSPROT Homolog: FUSIP_MOUSE TLS-associated protein with Ser-Arg repeats TLS-associated protein with SR repeats (TASR) TLS-associated serine-arginine protein
  misc_feature: SWISSPROT Homolog: SRR35_HUMAN 35 kDa SR repressor protein (SRrp35) with e-value of 4.8e-28 and BLAST sequence identity of 35.9
  misc_feature: SWISSPROT Homolog: RSP4_CAEEL Probable splicing factor, arginine/serine-rich 4 (RNA-binding protein srp-2) (CeSC35) with e-value of 1.0e-27 and BLAST sequence identity of 43.5
  misc_feature: SWISSPROT Homolog: SFRS2_CHICK Splicing factor, arginine/serine-rich 2 (Splicing factor SC35) SC-35  (Splicing component, 35 kDa) (PR264 protein) with e-value of 4.3e-27 and BLAST sequence identity of 41.6
  misc_feature 148121:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(244): Functional Homolog of  Ceres CLONE ID no. 34406 at SEQ ID NO. 1410 with e-value of 1.19E-85 and BLAST sequence identity of 74.1
MRGRSYSPSPPRGYGRRGRSPSPRGRYGGRSRDLPTSLLVRNLRHDCRPEDLRRPFEQFGALKDIYLPRDYYTGEPRGFGFVQFADPHDAAEAKHHMDGRVLLGRELTVVFAEENRKKPMDMRTRERTRGRFRDRRRSPPRYSRSPRHSRSPPPRHARSPSRSREYYSPPPKRRHHSRSVSPQEGRYSQERPYSRSRSHSQTPVRSRSRSPVRSRSRSPRRSRSHSPNHDEYPREANGERSPSP

SEQ ID NO: 1372 - DNA, 738 bp, Populus balsamifera subsp. trichocarpa
  misc_feature (1)..(738): Ceres ANNOT ID no. 1501426
  misc_feature 148202:<222: Transcription Factor
  misc_feature: Phenotype: Activates expression of the gene endogenous to the AtDXPR (SEQ ID NO 4143) regalutory region Useful for modulating Terpenoid Biosynthesis
atgagaggaaggagttatagtccatcacctccaaggggctatagtagaaggggacggagtcctagtcctcggggacgttatggtggacgtagtagggatcttcctactagccttctagttcgcaacctccgtcatgattgcaggccagaagaccttcgcaggccatttgaacagtttggtgctcttaaggacatctacttgcctagagactattatactggggaaccccgtggttttggttttgtccaatatgcagatcctcatgatgctgcagaggcaaaacatcatatggatggtcgagtctttcttggccgggagttgactgttgtatttgccgaggagaataggaagaagccagttgatatgagagcaagggagcgcacagccacaaggggtcgagttggtgatagaagaagatcacctcctcgttattctcggtcaccacgccattctcgttctccaccgccacgccatgcaacatcccggtctcacagtcgtgattattattcccctccaaaaagaaggcatccctcaagatctgtttcaccccgagagaggaggtacagtcaagagaggtcatattcacgatcaaggagccacagccaaactccaaataggggtcagatccggagcccagttaggagccgaagcagtagcccaagaaaaagcagaagccgtagcccaattcatgatgaatatcctaaagaagtaaatggagacaagtctcctagtccataa

SEQ ID NO: 1373 - protein, 245 aa, Populus balsamifera subsp. trichocarpa
  misc_feature (1)..(245): Ceres ANNOT ID no. 1501426
  misc_feature (38)..(109): Pfam Name: RRM_1 Pfam Description: RNA recognition motif. (a.k.a. RRM RBD, or RNP domain)
  misc_feature: SWISSPROT Homolog: FUSIP_HUMAN FUS-interacting serine-arginine-rich protein 1 with e-value of 2.4e-33 and BLAST sequence identity of 41.2
  misc_feature: SWISSPROT Homolog: FUSIP_HUMAN TLS-associated protein with Ser-Arg repeats TLS-associated protein with SR repeats (TASR) TLS-associated serine-arginine protein
  misc_feature: SWISSPROT Homolog: FUSIP_MOUSE FUS-interacting serine-arginine-rich protein 1 with e-value of 2.4e-33 and BLAST sequence identity of 41.2
  misc_feature: SWISSPROT Homolog: FUSIP_MOUSE TLS-associated protein with Ser-Arg repeats TLS-associated protein with SR repeats (TASR) TLS-associated serine-arginine protein
  misc_feature: SWISSPROT Homolog: SRR35_HUMAN 35 kDa SR repressor protein (SRrp35) with e-value of 4.8e-28 and BLAST sequence identity of 35.9
  misc_feature: SWISSPROT Homolog: RSP4_CAEEL Probable splicing factor, arginine/serine-rich 4 (RNA-binding protein srp-2) (CeSC35) with e-value of 1.0e-27 and BLAST sequence identity of 43.5
  misc_feature: SWISSPROT Homolog: SFRS2_CHICK Splicing factor, arginine/serine-rich 2 (Splicing factor SC35) SC-35  (Splicing component, 35 kDa) (PR264 protein) with e-value of 4.3e-27 and BLAST sequence identity of 41.6
  misc_feature 148316:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(245): Functional Homolog of  Ceres CLONE ID no. 34406 at SEQ ID NO. 1410 with e-value of 1.30E-81 and BLAST sequence identity of 69.8
MRGRSYSPSPPRGYSRRGRSPSPRGRYGGRSRDLPTSLLVRNLRHDCRPEDLRRPFEQFGALKDIYLPRDYYTGEPRGFGFVQYADPHDAAEAKHHMDGRVFLGRELTVVFAEENRKKPVDMRARERTATRGRVGDRRRSPPRYSRSPRHSRSPPPRHATSRSHSRDYYSPPKRRHPSRSVSPRERRYSQERSYSRSRSHSQTPNRGQIRSPVRSRSSSPRKSRSRSPIHDEYPKEVNGDKSPSP

SEQ ID NO: 1374 - DNA, 936 bp, Populus balsamifera subsp. trichocarpa
  misc_feature (1)..(936): Ceres ANNOT ID no. 1437614
  misc_feature 148397:<222: Transcription Factor
  misc_feature: Phenotype: Activates expression of the gene endogenous to the AtDXPR (SEQ ID NO 4143) regalutory region Useful for modulating Terpenoid Biosynthesis
atgaggggaaggagttatagtccatcgcctccaaggggctatggtagaaggggacggagtcctagtcctcggggacgttatggtggtcgtagcagggatcttcctactagcctcctagttcgcaaccttcgtcatgattgcaggccagaagaccttcgcagaccctttgaacaatttggtgctctcaaggacatttacttgcctagagattattatactggggaaccccgtggttttggctttgtccaatttgcagatcctcatgatgctgctgaggcaaaacatcatatggatggtcgagttcttcttggccgggagttgactgttgtatttgctgaggagaataggaagaagccaatggatatgagaacaagggagcgtacaaggggtcgatttcgtgatagaagaagatcacctcctcgttattctcggtcaccacgccattctcgttctccacctccacgccatgcaagatccccatcccgtagtcgagagtattattcccctcctccaaaaagaaggcatcactcaaggattattgttatagaaataggatactttctgtggtttgtcacatgtcttgccattgccccactgaggtgcatagagctgtaccttttgacaatccactactcccactttaaatgttcatggctggccttttgctttgaagcagatctgtttcaccccaagaggggaggtacagtcaagagaggccatattcgagatcaaggagccacagccaaactccagttaggagcaggagccgcagcccagttagaagcagaagccgcagcccaagaagaagcagaagccatagcccaaatcatgatgaatatcctagggaagcaaatggagaaagatctcctagtccttaaaccctgtatggaaacagatgtttggaacgctgcttgtcttttggattatgtttactga

SEQ ID NO: 1375 - protein, 311 aa, Populus balsamifera subsp. trichocarpa
  misc_feature (1)..(311): Ceres ANNOT ID no. 1437614
  misc_feature (38)..(109): Pfam Name: RRM_1 Pfam Description: RNA recognition motif. (a.k.a. RRM RBD, or RNP domain)
  misc_feature: SWISSPROT Homolog: FUSIP_HUMAN FUS-interacting serine-arginine-rich protein 1 with e-value of 2.4e-33 and BLAST sequence identity of 41.2
  misc_feature: SWISSPROT Homolog: FUSIP_HUMAN TLS-associated protein with Ser-Arg repeats TLS-associated protein with SR repeats (TASR) TLS-associated serine-arginine protein
  misc_feature: SWISSPROT Homolog: FUSIP_MOUSE FUS-interacting serine-arginine-rich protein 1 with e-value of 2.4e-33 and BLAST sequence identity of 41.2
  misc_feature: SWISSPROT Homolog: FUSIP_MOUSE TLS-associated protein with Ser-Arg repeats TLS-associated protein with SR repeats (TASR) TLS-associated serine-arginine protein
  misc_feature: SWISSPROT Homolog: SRR35_HUMAN 35 kDa SR repressor protein (SRrp35) with e-value of 4.8e-28 and BLAST sequence identity of 35.9
  misc_feature: SWISSPROT Homolog: RSP4_CAEEL Probable splicing factor, arginine/serine-rich 4 (RNA-binding protein srp-2) (CeSC35) with e-value of 1.0e-27 and BLAST sequence identity of 43.5
  misc_feature: SWISSPROT Homolog: SFRS2_CHICK Splicing factor, arginine/serine-rich 2 (Splicing factor SC35) SC-35  (Splicing component, 35 kDa) (PR264 protein) with e-value of 4.3e-27 and BLAST sequence identity of 41.6
  misc_feature 148517:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(311): Functional Homolog of  Ceres CLONE ID no. 34406 at SEQ ID NO. 1410 with e-value of 2.19E-70 and BLAST sequence identity of 81.5
MRGRSYSPSPPRGYGRRGRSPSPRGRYGGRSRDLPTSLLVRNLRHDCRPEDLRRPFEQFGALKDIYLPRDYYTGEPRGFGFVQFADPHDAAEAKHHMDGRVLLGRELTVVFAEENRKKPMDMRTRERTRGRFRDRRRSPPRYSRSPRHSRSPPPRHARSPSRSREYYSPPPKRRHHSRIIVIEIGYFLWFVTCLAIAPLRCIELYLLTIHYSHFKCSWLAFCFEADLFHPKRGGTVKRGHIRDQGATAKLQLGAGAAAQLEAEAAAQEEAEAIAQIMMNILGKQMEKDLLVLKPCMETDVWNAACLLDYVY

SEQ ID NO: 1376 - protein, 486 aa, Arabidopsis thaliana
  misc_feature (1)..(486): Ceres CLONE ID no. 34412
  misc_feature (184)..(478): Pfam Name: 6PGD Pfam Description: 6-phosphogluconate dehydrogenase C-terminal domain
  misc_feature (5)..(180): Pfam Name: NAD_binding_2 Pfam Description: NAD binding domain of 6-phosphogluconate dehydrogenase
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTEWFKIARQSKI

SEQ ID NO: 1377 - DNA, 1467 bp, Populus balsamifera subsp. trichocarpa
  misc_feature (1)..(1467): Ceres ANNOT ID no. 1449739
  misc_feature 148781:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
atggctgctcccacaaagccaacaagaataggcctcgctggtctggctgtcatgggccagaatctggcccttaatattgcagagaaaggcttccccatttcggtttataatcggtctacctccaaagttgatgagactgttgagagggctaaaaaagagggagatcttcccttatatggcttccatgatcctgaatcttttgtgaagtcaatccaaaagcctcgagtgataattatgcttgtcaaggcagggtcacctgttgatcaaaccataaagactctttctgcctacttggagaagggagattgtatcattgatggtggaaatgagtggtatgagaacactgagaggagagaaaaggctatggctgaattgggcttgctctaccttggaatgggagtttcaggtggtgaagagggtgcacgtaatggaccttcaatgatgcctggaggttccttcgaggctttcaagtacatcgaagacattcttcttaaagtggcagctcaagttcctgatagtggcccttgcgtgacttacatcggcaaaggcggttctggtaattttgtcaagatggttcataatggaattgaatacggcgatatgcagttgattgctgaagcttatgatgtactaaaatcagttggaaagttgtcaaatgaagaactccgtagtgtttttgcagaatggaacaagggtgagcttcttagcttcttgattgaaatcaccgcagatatatttggaattaaagatgataagggggaaggatatctggttgacaaggttttggacaaaaccggcatgaagggtacaggtaaatggactgtgcagcaagctgctgatctatcagtagcagctcctacaattgcatcttctttggatgcaaggttcctcagtggtttgaaggaggaacgcgttgaagctgctaaagtcttcaaagcaggtggttttggggatattttaactggccaagtggtggataagaagcagttgattgatgatgtcagacaagctctttatgcatccaagatttgtagttatgcacaggggatgaatctgatccgtgcaaagagtattgagaagggatgggacttgaaattgggagaactggctaggatttggaagggtggttgtattatccgagctgtatttctggactggatcaagaaggcatacgataggaatcctgatcttgctaaccttctagtggatccagagttcgcaaaggaaattattgagcgccagtctgcgtggcgcagggttgtgtgtgttgcaatcagctccggtattagcactcctggtatgtcatccagcctcgcttattttgacacctaccggaggggaaggttgcctgctaatttggtccaagctcaaagagattattttggtgctcatacatacgaaagggttgatgtggaaggatctttccatactgaatggttcaagattgccaggcagtgtaagaattaa

SEQ ID NO: 1378 - protein, 488 aa, Populus balsamifera subsp. trichocarpa
  misc_feature (1)..(488): Ceres ANNOT ID no. 1449739
  misc_feature (186)..(480): Pfam Name: 6PGD Pfam Description: 6-phosphogluconate dehydrogenase C-terminal domain
  misc_feature (7)..(182): Pfam Name: NAD_binding_2 Pfam Description: NAD binding domain of 6-phosphogluconate dehydrogenase
  misc_feature: SWISSPROT Homolog: 6PGD_SYNP7 6-phosphogluconate dehydrogenase, decarboxylating (EC 1.1.1.44) with e-value of 3.6e-142 and BLAST sequence identity of 58.2
  misc_feature: SWISSPROT Homolog: 6PGD2_BACSU 6-phosphogluconate dehydrogenase, decarboxylating 2 (EC 1.1.1.44) (GNTZII) with e-value of 1.5e-136 and BLAST sequence identity of 55.3
  misc_feature: SWISSPROT Homolog: 6PGD_SYNY3 6-phosphogluconate dehydrogenase, decarboxylating (EC 1.1.1.44) with e-value of 2.0e-132 and BLAST sequence identity of 54.7
  misc_feature: SWISSPROT Homolog: 6PGD_STAEQ 6-phosphogluconate dehydrogenase, decarboxylating (EC 1.1.1.44) with e-value of 5.5e-130 and BLAST sequence identity of 53.5
  misc_feature: SWISSPROT Homolog: 6PGD_STAES 6-phosphogluconate dehydrogenase, decarboxylating (EC 1.1.1.44) with e-value of 5.5e-130 and BLAST sequence identity of 53.5
  misc_feature 148952:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
  misc_feature (1)..(488): Functional Homolog of  Ceres CLONE ID no. 34412 at SEQ ID NO. 1417 with e-value of 3.90E-238 and BLAST sequence identity of 91.4
MAAPTKPTRIGLAGLAVMGQNLALNIAEKGFPISVYNRSTSKVDETVERAKKEGDLPLYGFHDPESFVKSIQKPRVIIMLVKAGSPVDQTIKTLSAYLEKGDCIIDGGNEWYENTERREKAMAELGLLYLGMGVSGGEEGARNGPSMMPGGSFEAFKYIEDILLKVAAQVPDSGPCVTYIGKGGSGNFVKMVHNGIEYGDMQLIAEAYDVLKSVGKLSNEELRSVFAEWNKGELLSFLIEITADIFGIKDDKGEGYLVDKVLDKTGMKGTGKWTVQQAADLSVAAPTIASSLDARFLSGLKEERVEAAKVFKAGGFGDILTGQVVDKKQLIDDVRQALYASKICSYAQGMNLIRAKSIEKGWDLKLGELARIWKGGCIIRAVFLDWIKKAYDRNPDLANLLVDPEFAKEIIERQSAWRRVVCVAISSGISTPGMSSSLAYFDTYRRGRLPANLVQAQRDYFGAHTYERVDVEGSFHTEWFKIARQCKN

SEQ ID NO: 1379 - DNA, 1467 bp, Populus balsamifera subsp. trichocarpa
  misc_feature (1)..(1467): Ceres ANNOT ID no. 1449738
  misc_feature 149120:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
atggccgcacccccaaaaccaacaagaataggcctcgctggtctggctgtcatgggccagaacctggcccttaatattgcggagaaaggcttccccgtttctgtttataatcggtccacctcaaaagttgatgagactgttgagagggctaaaaaagagggagatcttcccttatatggcttccatgatcctgaatcttttgtgaagtcaatccaaaagcctcgagtgataattatgcttgtcaaggcagggtcacctgttgatcaaaccataaagactctttctgcctacttggagaagggagattgtatcattgatggtggaaatgagtggtatgagaacactgagaggagagaaaaggctatggctgaattgggcttgctctaccttggaatgggagtttcaggtggtgaagagggtgcacgtaatggaatttcattgacgcctggaggttccttcgaggctttcaagtccatcgaagacattcttcttaaagtggcagcccaagttcctgatagtggcccttgcgtgacttacatcggcaaaggcggttctggtaattttgtcaagatggttcataatggaattgaatacggcgatatgcagttgattgctgaagcttatgatgtactaaaatcagttggaaagttgtcaaatgaagaactccgtagtgtttttgcagaatggaacaagggtgagcttcttagcttcttgattgaaatcaccgcagatatatttggaattaaagatgataagggggaaggatatctggttgacaaggttttggacaaaaccggcatgaagggtacaggtaaatggactgtgcagcaagctgctgatctatcagtagcagctcctacaattgcatcttcattggatgcaaggttcctcagtggtttgaaggaggaacgcgttgaggctgctaaagtcttcaaagcaggtggttttggggatattttaactggccaagtggtggataagaagcagttgattgatgatgtcagacaagctctttatgcatccaagatttgtagttatgcacaggggatgaatctgatccgtgcaaagagtattgagaagggatgggacttaaaattgagagaactagctaggatttggaagggtggttgtattatccaatctgtatttctgggcagaatcaagaaggcatacgataggaatcctgatcttgctagccttctagtggatccagaatttgcaaaggaaattattgagcgccagtctgcgtggcgcagggttgtgtgtgtttcaatcacctccggtattagcactcctggtatgtcatccagcctcgcttattttgacacctaccggaggggaaggttgcctgctaatttggtccaagctcaaagagattattttggtgctcatacatatgaaagggtggatgtggaaggatctttccatactgaatggttcaagattgccaggcagttgaagaattaa

SEQ ID NO: 1380 - protein, 488 aa, Populus balsamifera subsp. trichocarpa
  misc_feature (1)..(488): Ceres ANNOT ID no. 1449738
  misc_feature (186)..(480): Pfam Name: 6PGD Pfam Description: 6-phosphogluconate dehydrogenase C-terminal domain
  misc_feature (7)..(182): Pfam Name: NAD_binding_2 Pfam Description: NAD binding domain of 6-phosphogluconate dehydrogenase
  misc_feature: SWISSPROT Homolog: 6PGD_SYNP7 6-phosphogluconate dehydrogenase, decarboxylating (EC 1.1.1.44) with e-value of 3.6e-142 and BLAST sequence identity of 58.2
  misc_feature: SWISSPROT Homolog: 6PGD2_BACSU 6-phosphogluconate dehydrogenase, decarboxylating 2 (EC 1.1.1.44) (GNTZII) with e-value of 1.5e-136 and BLAST sequence identity of 55.3
  misc_feature: SWISSPROT Homolog: 6PGD_SYNY3 6-phosphogluconate dehydrogenase, decarboxylating (EC 1.1.1.44) with e-value of 2.0e-132 and BLAST sequence identity of 54.7
  misc_feature: SWISSPROT Homolog: 6PGD_STAEQ 6-phosphogluconate dehydrogenase, decarboxylating (EC 1.1.1.44) with e-value of 5.5e-130 and BLAST sequence identity of 53.5
  misc_feature: SWISSPROT Homolog: 6PGD_STAES 6-phosphogluconate dehydrogenase, decarboxylating (EC 1.1.1.44) with e-value of 5.5e-130 and BLAST sequence identity of 53.5
  misc_feature 149291:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
  misc_feature (1)..(488): Functional Homolog of  Ceres CLONE ID no. 34412 at SEQ ID NO. 1417 with e-value of 8.60E-234 and BLAST sequence identity of 89.6
MAAPPKPTRIGLAGLAVMGQNLALNIAEKGFPVSVYNRSTSKVDETVERAKKEGDLPLYGFHDPESFVKSIQKPRVIIMLVKAGSPVDQTIKTLSAYLEKGDCIIDGGNEWYENTERREKAMAELGLLYLGMGVSGGEEGARNGISLTPGGSFEAFKSIEDILLKVAAQVPDSGPCVTYIGKGGSGNFVKMVHNGIEYGDMQLIAEAYDVLKSVGKLSNEELRSVFAEWNKGELLSFLIEITADIFGIKDDKGEGYLVDKVLDKTGMKGTGKWTVQQAADLSVAAPTIASSLDARFLSGLKEERVEAAKVFKAGGFGDILTGQVVDKKQLIDDVRQALYASKICSYAQGMNLIRAKSIEKGWDLKLRELARIWKGGCIIQSVFLGRIKKAYDRNPDLASLLVDPEFAKEIIERQSAWRRVVCVSITSGISTPGMSSSLAYFDTYRRGRLPANLVQAQRDYFGAHTYERVDVEGSFHTEWFKIARQLKN

SEQ ID NO: 1381 - DNA, 1458 bp, Populus balsamifera subsp. trichocarpa
  misc_feature (1)..(1458): Ceres ANNOT ID no. 1458830
  misc_feature 149459:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
atggctcccctgaccagaattggcctagctggccttgctgtcatgggtcaaaatcttgccctcaatattgctgagaaaggatttcctatttctgtgtataatcggaccaccttaaaagttgatgagacagttgaacgagccaagcaggagggagatcttcccttatatggtttccatgatcctgaatcctttgttaagtcaatccaaaaacctcgtgtgataatcatacttgttaaggccggtgcccctgtcgaccaaaccatcaaaacactgtcagtttacatggagaaaggggattgtatcatagatggtggtaatgaatggtatgagaacactgagaggagggagaaagccttggctgaattaggtttgctttatcttggaatgggagtttcaggtggtgaagatggtgctcggcatggaccatctttaatgccaggtggttcctttgaggcctacaaacacatagaagatatccttcttaaggtggctgctcaagttcctgatagtggtccttgtgtcacttatattggcaaaggaggatctggcaattttgttaagatggttcacaatgggatagaatatggtgatatgcagctgattgcagaggcctatgatgttctgaaatcagttgggaagctcaccaacgaggaactatgccaggttttctctgaatggaacaagggggagctgctgagtttcttgattgagatcactgcagatatatttggaattaaggatgacaagggagaaggatatttggtcgacaaggtattggataaaactggcatgaagggtactggtaagtggacggttcagcaagctgctgagttgtcagttgctgctcccactatagcgtcatccttggatggaagattcctcagtggcctgaaggaagaaagagttgaagctgcaaaagtcttcaaatcaagcggcatcatagacatgctagctgaccaagtcgtggataaggaaaaattgatctatgatgtgagacaagcactatatgtgtccaaaatatgcagctatgcccagggtatgaacttgatacgtgcaaagagtgctgaaaagggatgggatttgaaactggggcagttaacaaggatttggaagggtggttgcattatccgtgctgtcttcttggaccgtattaagaaggcttatgatagaaacccaaacctgcctaatcttcttgtggatccagaatttgcaaaagaaattattgagagacaatctgcttggagaagagttgtatccattgctatcaactctggtatcagcacccctggtatgtcttctagccttgcgtattttgacacatacaggaggtccaggctgcctgctaatttagtccaagctcaacgagattattttggagcacatacatatgagaggattgatatagatggatccttccatactgagtggtttaaaattgctaaacagtcaaagatctaa

SEQ ID NO: 1382 - protein, 485 aa, Populus balsamifera subsp. trichocarpa
  misc_feature (1)..(485): Ceres ANNOT ID no. 1458830
  misc_feature (183)..(477): Pfam Name: 6PGD Pfam Description: 6-phosphogluconate dehydrogenase C-terminal domain
  misc_feature (4)..(179): Pfam Name: NAD_binding_2 Pfam Description: NAD binding domain of 6-phosphogluconate dehydrogenase
  misc_feature: SWISSPROT Homolog: 6PGD_SYNP7 6-phosphogluconate dehydrogenase, decarboxylating (EC 1.1.1.44) with e-value of 3.6e-142 and BLAST sequence identity of 58.2
  misc_feature: SWISSPROT Homolog: 6PGD2_BACSU 6-phosphogluconate dehydrogenase, decarboxylating 2 (EC 1.1.1.44) (GNTZII) with e-value of 1.5e-136 and BLAST sequence identity of 55.3
  misc_feature: SWISSPROT Homolog: 6PGD_SYNY3 6-phosphogluconate dehydrogenase, decarboxylating (EC 1.1.1.44) with e-value of 2.0e-132 and BLAST sequence identity of 54.7
  misc_feature: SWISSPROT Homolog: 6PGD_STAEQ 6-phosphogluconate dehydrogenase, decarboxylating (EC 1.1.1.44) with e-value of 5.5e-130 and BLAST sequence identity of 53.5
  misc_feature: SWISSPROT Homolog: 6PGD_STAES 6-phosphogluconate dehydrogenase, decarboxylating (EC 1.1.1.44) with e-value of 5.5e-130 and BLAST sequence identity of 53.5
  misc_feature 149630:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Early Senescence Useful for modulating crop development and harvest
  misc_feature: Phenotype: WHOLE PLANT - Small Useful for modulating plant size
  misc_feature: Phenotype: INFLORESCENCE - No Branching Useful for modifying plant architecture, ie amount of  branching
  misc_feature: Phenotype: INFLORESCENCE - Other Useful for making ornamental plants with modified flowers
  misc_feature (1)..(485): Functional Homolog of  Ceres CLONE ID no. 34412 at SEQ ID NO. 1417 with e-value of 9.40E-228 and BLAST sequence identity of 87.1
MAPLTRIGLAGLAVMGQNLALNIAEKGFPISVYNRTTLKVDETVERAKQEGDLPLYGFHDPESFVKSIQKPRVIIILVKAGAPVDQTIKTLSVYMEKGDCIIDGGNEWYENTERREKALAELGLLYLGMGVSGGEDGARHGPSLMPGGSFEAYKHIEDILLKVAAQVPDSGPCVTYIGKGGSGNFVKMVHNGIEYGDMQLIAEAYDVLKSVGKLTNEELCQVFSEWNKGELLSFLIEITADIFGIKDDKGEGYLVDKVLDKTGMKGTGKWTVQQAAELSVAAPTIASSLDGRFLSGLKEERVEAAKVFKSSGIIDMLADQVVDKEKLIYDVRQALYVSKICSYAQGMNLIRAKSAEKGWDLKLGQLTRIWKGGCIIRAVFLDRIKKAYDRNPNLPNLLVDPEFAKEIIERQSAWRRVVSIAINSGISTPGMSSSLAYFDTYRRSRLPANLVQAQRDYFGAHTYERIDIDGSFHTEWFKIAKQSKI

SEQ ID NO: 1383 - protein, 181 aa, Arabidopsis thaliana
  misc_feature (1)..(181): Ceres CLONE ID no. 34414
  misc_feature (1)..(181): Also Known As Ceres CDNA ID no. 23384563
  misc_feature (1)..(181): Also Known As Ceres GEMINI ID 554B7
  misc_feature (19)..(179): Pfam Name: Ras Pfam Description: Ras family
  misc_feature 149818:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 1384 - DNA, 546 bp, Populus balsamifera subsp. trichocarpa; identical to SEQ ID NO: 631
  misc_feature (1)..(546): Ceres ANNOT ID no. 1471525
  misc_feature 149894:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content

SEQ ID NO: 1385 - protein, 181 aa, Populus balsamifera subsp. trichocarpa; identical to SEQ ID NO: 632
  misc_feature (1)..(181): Ceres ANNOT ID no. 1471525
  misc_feature (4)..(177): Pfam Name: Arf Pfam Description: ADP-ribosylation factor family
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 149996:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(181): Functional Homolog of  Ceres CLONE ID no. 34414 at SEQ ID NO. 1424 with e-value of 2.19E-93 and BLAST sequence identity of 98.8

SEQ ID NO: 1386 - DNA, 546 bp, Populus balsamifera subsp. trichocarpa; identical to SEQ ID NO: 627
  misc_feature (1)..(546): Ceres ANNOT ID no. 1497838
  misc_feature 150080:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content

SEQ ID NO: 1387 - protein, 181 aa, Populus balsamifera subsp. trichocarpa; identical to SEQ ID NO: 628
  misc_feature (1)..(181): Ceres ANNOT ID no. 1497838
  misc_feature (4)..(177): Pfam Name: Arf Pfam Description: ADP-ribosylation factor family
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 150182:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(181): Functional Homolog of  Ceres CLONE ID no. 34414 at SEQ ID NO. 1424 with e-value of 5.79E-93 and BLAST sequence identity of 98.8

SEQ ID NO: 1388 - DNA, 546 bp, Populus balsamifera subsp. trichocarpa; identical to SEQ ID NO: 633
  misc_feature (1)..(546): Ceres ANNOT ID no. 1511908
  misc_feature 150266:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content

SEQ ID NO: 1389 - protein, 181 aa, Populus balsamifera subsp. trichocarpa; identical to SEQ ID NO: 634
  misc_feature (1)..(181): Ceres ANNOT ID no. 1511908
  misc_feature (18)..(129): Pfam Name: MMR_HSR1 Pfam Description: GTPase of unknown function
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 150368:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(181): Functional Homolog of  Ceres CLONE ID no. 34414 at SEQ ID NO. 1424 with e-value of 1.39E-91 and BLAST sequence identity of 97.2

SEQ ID NO: 1390 - DNA, 546 bp, Populus balsamifera subsp. trichocarpa; identical to SEQ ID NO: 635
  misc_feature (1)..(546): Ceres ANNOT ID no. 1464305
  misc_feature 150452:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content

SEQ ID NO: 1391 - protein, 181 aa, Populus balsamifera subsp. trichocarpa; identical to SEQ ID NO: 636
  misc_feature (1)..(181): Ceres ANNOT ID no. 1464305
  misc_feature (18)..(129): Pfam Name: MMR_HSR1 Pfam Description: GTPase of unknown function
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 150554:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(181): Functional Homolog of  Ceres CLONE ID no. 34414 at SEQ ID NO. 1424 with e-value of 2.89E-91 and BLAST sequence identity of 96.6

SEQ ID NO: 1392 - DNA, 564 bp, Populus balsamifera subsp. trichocarpa; identical to SEQ ID NO: 637
  misc_feature (1)..(564): Ceres ANNOT ID no. 1451416
  misc_feature 150638:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content

SEQ ID NO: 1393 - protein, 187 aa, Populus balsamifera subsp. trichocarpa; identical to SEQ ID NO: 638
  misc_feature (1)..(187): Ceres ANNOT ID no. 1451416
  misc_feature (19)..(150): Pfam Name: Ras Pfam Description: Ras family
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 150740:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(187): Functional Homolog of  Ceres CLONE ID no. 34414 at SEQ ID NO. 1424 with e-value of 4.59E-84 and BLAST sequence identity of 86.7

SEQ ID NO: 1394 - DNA, 549 bp, Populus balsamifera subsp. trichocarpa
  misc_feature (1)..(549): Ceres ANNOT ID no. 1514324
  misc_feature 150824:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
atgggcgcaaccatatcccgacttgcaagaagattccttccgaagactgaaattaggattctcatggtggggcttgatgcatctgggaaaacaaccattctgtacaaactaaagctgggagaaattgttcttacagtacctacaattggttttaatgtggagacggtggtgtacaaaaatataagtttcaccgtatgggatgtaggaggacaacaaaagattcggcctctatggagatactactttcagaattcccacggactcatctttgttgtggacagcaatgatagggggagaatttcagaagctcgcaatgagctacatcgcattttatctgatatcgaactaaaggatgccatcctgcttgtctttgccaacaagcaggatgttccgaatgctatgtctgtttctgaggttgctgataagcttggactacctactcttaaacagcgtcgctggtacattcaaagctcttctgccacttcaggacgtggactatacgaaggtctggactggctatctaactatatctctaacaaggcagcataa

SEQ ID NO: 1395 - protein, 182 aa, Populus balsamifera subsp. trichocarpa
  misc_feature (1)..(182): Ceres ANNOT ID no. 1514324
  misc_feature (4)..(177): Pfam Name: Arf Pfam Description: ADP-ribosylation factor family
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 150926:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(182): Functional Homolog of  Ceres CLONE ID no. 34414 at SEQ ID NO. 1424 with e-value of 3.89E-71 and BLAST sequence identity of 74.5
MGATISRLARRFLPKTEIRILMVGLDASGKTTILYKLKLGEIVLTVPTIGFNVETVVYKNISFTVWDVGGQQKIRPLWRYYFQNSHGLIFVVDSNDRGRISEARNELHRILSDIELKDAILLVFANKQDVPNAMSVSEVADKLGLPTLKQRRWYIQSSSATSGRGLYEGLDWLSNYISNKAA

SEQ ID NO: 1396 - DNA, 588 bp, Populus balsamifera subsp. trichocarpa; identical to SEQ ID NO: 639
  misc_feature (1)..(588): Ceres ANNOT ID no. 1461050
  misc_feature 151010:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content

SEQ ID NO: 1397 - protein, 195 aa, Populus balsamifera subsp. trichocarpa; identical to SEQ ID NO: 640
  misc_feature (1)..(195): Ceres ANNOT ID no. 1461050
  misc_feature (19)..(150): Pfam Name: Ras Pfam Description: Ras family
  misc_feature: SWISSPROT Homolog: ARF1_ARATH ADP-ribosylation factor 1 with e-value of 5.9e-94 and BLAST sequence identity of 100.0
  misc_feature: SWISSPROT Homolog: ARF2_ARATH ADP-ribosylation factor 2 (AtARF2) with e-value of 6.7e-93 and BLAST sequence identity of 98.9
  misc_feature: SWISSPROT Homolog: ARF_VIGUN ADP-ribosylation factor with e-value of 1.1e-92 and BLAST sequence identity of 98.9
  misc_feature: SWISSPROT Homolog: ARF1_DAUCA ADP-ribosylation factor 1 with e-value of 3.7e-92 and BLAST sequence identity of 98.3
  misc_feature: SWISSPROT Homolog: ARF_ORYSA ADP-ribosylation factor with e-value of 4.7e-92 and BLAST sequence identity of 97.8
  misc_feature 151112:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature (1)..(195): Functional Homolog of  Ceres CLONE ID no. 34414 at SEQ ID NO. 1424 with e-value of 3.69E-59 and BLAST sequence identity of 73.2

SEQ ID NO: 1398 - protein, 309 aa, Arabidopsis thaliana
  misc_feature (1)..(309): Ceres CLONE ID no. 34480
  misc_feature (80)..(259): Pfam Name: CLP_protease Pfam Description: Clp protease
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (217)..(217): Xaa is any aa, unknown, or other
MEMSLRLASSSTSNPICLLNPGKNLNFPIRNHRIPKTSKPFCVRSSMSLSKPPRQTLSSNWDVSSFSIDSVAQSPSRLPSFEELDTTNMLLRQRIVFLGSQVDDMTADLVISQLLLLDAEDSERDITLFINSPGGSITAGMGIYDAMKQCKADVSTVCLGLAASMGAFLLASGSKGKRYCMPNSKVMIHQPLGTAGGKATEMSIRIREMMYHKIKLXKIFSRITGKPESEIESDTDRDNFLNPWEAKEYGLIDAVIDDGKPGLIAPIGDGTPPPKTKVWDLWKVEGTKKDNTNLPSERSMTQNGYAAIE

SEQ ID NO: 1399 - DNA, 1017 bp, Populus balsamifera subsp. trichocarpa
  misc_feature (1)..(1017): Ceres ANNOT ID no. 1502362
  misc_feature 151307:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
atggaggtaggtttagcatatctcacagcctcacaatccacaagcagccctctatgtttctccagtcgcaacagtttcattaacaagaatcatcttctgctaccagtcaccattgacaccagcactactattagtgtttgcagtaaaagaagaaaacctatctgtgttaaggcttcgaagagttcattcgatgctaacaccgcaagacagactttggctagcaactgggatgttgaaaagttctcatcttttgctaattcagctcctactttgccaaaatttgaggaattggatactaccaacatgcttctccgtcaaagaatcatttttttgggctctcaagtggatgacgtgacagcagattttattatcagtcagctattatttctggatgctgaagaccccaaaaaagacatcaaattgtttattaattcacctgggggttctgtcactgctggactgggaatttatgacgcgatgaagttgtgcaaggctgatgtttcaactatttgccttgggcttgctgcatccatgggagcatttcttctttctgctggttccaaaggcaagagattttgcatgcccaatgggagggtgatgattcatcagccacttggaactgctggaggcaaagcatcagaaatgagcatccggattagagaaatgagttaccacaagattaagctgaacaagatattatcaagaataacagggaagcctctagagcaggttgaagttgacactgatcgtgacaatttcatgaatgcttgggaagctaaagaatatgggttggtagatgaagttattgatgatggtaagccaggactagttgcaccgcttacagatgcttcacctccaccaaaaactcgggtgtgggatctttggaaaattgaagggagcaagaaagctaagaataatttgccttcagagcataaaatgctacagaatggatatgttggaggaggtgatggggatagaggcgtggaccgggaaaaggaaacaccaagtccagtataa

SEQ ID NO: 1400 - protein, 338 aa, Populus balsamifera subsp. trichocarpa
  misc_feature (1)..(338): Ceres ANNOT ID no. 1502362
  misc_feature (93)..(272): Pfam Name: CLP_protease Pfam Description: Clp protease
  misc_feature: SWISSPROT Homolog: CLPP1_ANASP ATP-dependent Clp protease proteolytic subunit 1 (EC 3.4.21.92) (Endopeptidase Clp 1) with e-value of 3.7e-53 and BLAST sequence identity of 57.5
  misc_feature: SWISSPROT Homolog: CLPP2_SYNP7 ATP-dependent Clp protease proteolytic subunit 2 (EC 3.4.21.92) (Endopeptidase Clp 2) with e-value of 5.4e-52 and BLAST sequence identity of 51.9
  misc_feature: SWISSPROT Homolog: CLPP3_SYNP6 ATP-dependent Clp protease proteolytic subunit 3 (EC 3.4.21.92) (Endopeptidase Clp 3) with e-value of 5.4e-52 and BLAST sequence identity of 51.9
  misc_feature: SWISSPROT Homolog: CLPP2_SYNY3 ATP-dependent Clp protease proteolytic subunit 2 (EC 3.4.21.92) (Endopeptidase Clp 2) with e-value of 4.8e-51 and BLAST sequence identity of 50.5
  misc_feature: SWISSPROT Homolog: CLPP_GEOKA ATP-dependent Clp protease proteolytic subunit (EC 3.4.21.92) (Endopeptidase Clp) with e-value of 4.8e-51 and BLAST sequence identity of 58.1
  misc_feature 151426:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (1)..(338): Functional Homolog of  Ceres CLONE ID no. 34480 at SEQ ID NO. 1442 with e-value of 1.49E-110 and BLAST sequence identity of 72.3
MEVGLAYLTASQSTSSPLCFSSRNSFINKNHLLLPVTIDTSTTISVCSKRRKPICVKASKSSFDANTARQTLASNWDVEKFSSFANSAPTLPKFEELDTTNMLLRQRIIFLGSQVDDVTADFIISQLLFLDAEDPKKDIKLFINSPGGSVTAGLGIYDAMKLCKADVSTICLGLAASMGAFLLSAGSKGKRFCMPNGRVMIHQPLGTAGGKASEMSIRIREMSYHKIKLNKILSRITGKPLEQVEVDTDRDNFMNAWEAKEYGLVDEVIDDGKPGLVAPLTDASPPPKTRVWDLWKIEGSKKAKNNLPSEHKMLQNGYVGGGDGDRGVDREKETPSPV

SEQ ID NO: 1401 - DNA, 1050 bp, Populus balsamifera subsp. trichocarpa
  misc_feature (1)..(1050): Ceres ANNOT ID no. 1449358
  misc_feature 151539:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
atggaggtaggtttagcatatctcacagcctcacaatccacaagcagccctctatgtttctccagtcgcaacagtttcattaacaagaatcatcttctgctaccagtcaccattgacaccagcactactattagtgtttgcagtaaaagaagaaaacctatctgtgttaaggcttcgaagagttcattcgatgctaacaccgcaagacagactttggctagcaactgggatgttgaaaagttctcatcttttgctaattcagctcctactttgccaaaatttgaggaattggatactaccaacatgcttctccgtcaaagaatcatttttttgggctctcaacatatttgttttggtaatgatgttggaacacaggtggatgacgtgacagcagattttattatcagtcagctattatttctggatgctgaagaccccaaaaaagacatcaaattgtttattaattcacctgggggttctgtcactgctggactgggaatttatgacgcgatgaagttgtgcaaggctgatgtttcaactatttgccttgggcttgctgcatccatgggagcatttcttctttctgctggttccaaaggcaagagattttgcatgcccaatgggagggtgatgattcatcagccacttggaactgctggaggcaaagcatcagaaatgagcatccggattagagaaatgagttaccacaagattaagctgaacaagatattatcaagaataacagggaagcctctagagcaggttgaagttgacactgatcgtgacaatttcatgaatgcttgggaagctaaagaatatgggttggtagatgaagttattgatgatggtaagccaggactagttgcaccgcttacagatgcttcacctccaccaaaaactcgggtgtgggatctttggaaaattgaagggagcaagaaagctaagaataatttgccttcagagcataaaatgctacagaatggatatgttggaggaggtgatggggatagaggcgtggaccgggaaaaggaaacaccaagtccagtataa

SEQ ID NO: 1402 - protein, 349 aa, Populus balsamifera subsp. trichocarpa
  misc_feature (1)..(349): Ceres ANNOT ID no. 1449358
  misc_feature (93)..(114): Pfam Name: CLP_protease Pfam Description: Clp protease
  misc_feature: SWISSPROT Homolog: CLPP1_ANASP ATP-dependent Clp protease proteolytic subunit 1 (EC 3.4.21.92) (Endopeptidase Clp 1) with e-value of 3.7e-53 and BLAST sequence identity of 57.5
  misc_feature: SWISSPROT Homolog: CLPP2_SYNP7 ATP-dependent Clp protease proteolytic subunit 2 (EC 3.4.21.92) (Endopeptidase Clp 2) with e-value of 5.4e-52 and BLAST sequence identity of 51.9
  misc_feature: SWISSPROT Homolog: CLPP3_SYNP6 ATP-dependent Clp protease proteolytic subunit 3 (EC 3.4.21.92) (Endopeptidase Clp 3) with e-value of 5.4e-52 and BLAST sequence identity of 51.9
  misc_feature: SWISSPROT Homolog: CLPP2_SYNY3 ATP-dependent Clp protease proteolytic subunit 2 (EC 3.4.21.92) (Endopeptidase Clp 2) with e-value of 4.8e-51 and BLAST sequence identity of 50.5
  misc_feature: SWISSPROT Homolog: CLPP_GEOKA ATP-dependent Clp protease proteolytic subunit (EC 3.4.21.92) (Endopeptidase Clp) with e-value of 4.8e-51 and BLAST sequence identity of 58.1
  misc_feature 151660:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (1)..(349): Functional Homolog of  Ceres CLONE ID no. 34480 at SEQ ID NO. 1442 with e-value of 1.79E-107 and BLAST sequence identity of 72.3
MEVGLAYLTASQSTSSPLCFSSRNSFINKNHLLLPVTIDTSTTISVCSKRRKPICVKASKSSFDANTARQTLASNWDVEKFSSFANSAPTLPKFEELDTTNMLLRQRIIFLGSQHICFGNDVGTQVDDVTADFIISQLLFLDAEDPKKDIKLFINSPGGSVTAGLGIYDAMKLCKADVSTICLGLAASMGAFLLSAGSKGKRFCMPNGRVMIHQPLGTAGGKASEMSIRIREMSYHKIKLNKILSRITGKPLEQVEVDTDRDNFMNAWEAKEYGLVDEVIDDGKPGLVAPLTDASPPPKTRVWDLWKIEGSKKAKNNLPSEHKMLQNGYVGGGDGDRGVDREKETPSPV

SEQ ID NO: 1403 - protein, 350 aa, Arabidopsis thaliana
  misc_feature (1)..(350): Ceres CLONE ID no. 34549
  misc_feature (17)..(87): Pfam Name: Alba Pfam Description: Alba
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MDKYQRVVKPKADTPIDANEIRITSQGRARNYITYAMTLLQDKGSTEVVFKAMGRAINKTVTIVELIKRRIPDLHQNTSIGSTDITDTWEPTEEGLLPLETTRHVSMITITLSKIELNTSSVGYQCPIPIELVKPMGDIDYEGREGSPGGRGRGRGRGRGRGRGRGGRGNAYVNVEHEDGGWEREQSYGRGRGRGRGRSSRGRGRGGYNGPPNEYDAPQDGGYGYDAPHEHRGYDDRGGYDAPPQGRGGYDGPQGRGGYDGPQGRRGYDGPPQGRGGYDGPSQGRGGYDGPSQGRGGYDGPSQGRGGYDGPQGRGRGRGRGRGGRGRGGGRGGDGGFNNRSDGPPVQAAA

SEQ ID NO: 1404 - DNA, 861 bp, Populus balsamifera subsp. trichocarpa
  misc_feature (1)..(861): Ceres ANNOT ID no. 1442496
  misc_feature 151874:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atggaccggtaccagagagtggagaagccgagagcggataaaacaattgatgagaacgagattcgaattactagtcaaggaaggatgcgtagctatatctcttatgccatgactctgcttcaagaaaaaggttcgaatgaaattgtattcaaggctatggggagagccatcaacaagacagtgactatagtggagttaatcaagagaagaattgttggtctccatcaaatcacatcaattggatccacggacataacagatacttgggaaccgcttgaggaaggcctccttccattggaaaccacaaggcatgtttcaatgattacaatcaacctttccaagaaggagctgaatacatcttctgctgggtaccagcctccgttacctgctgagcaggtgaaggcattcacagagttcgagtatgagggagatggctcaccacgtggccgtggcaggggacgaggaggcagaggaagggcaaggggtagagggaatgggtttgtgtccgctgagcatgaggatgggggttgggatcgcaatcggggatatcctaggggcaggggtcgaggcagaggacgtggtttccgtggccgtggaaggggaggatttaacggacctcatgctgatacccagcaagatggcggtcataattatgaaggacctccacaaggccgcggtggttataattatgaagctcctccacaaggccgtggtggttataattatgaagctcctccacaaggccgcgatggttataattatgaagcacctccacatggccgcggccgtggccgtgggaggggaaatcgcggaagaggccgtggatttagatctaatggcccgatccctgcagctgcataa

SEQ ID NO: 1405 - protein, 286 aa, Populus balsamifera subsp. trichocarpa
  misc_feature (1)..(286): Ceres ANNOT ID no. 1442496
  misc_feature (17)..(87): Pfam Name: Alba Pfam Description: Alba
  misc_feature: SWISSPROT Homolog: RBP56_HUMAN TATA-binding protein-associated factor 2N (RNA-binding protein 56) (TAFII68) (TAF(II)68) with e-value of 5.0e-26 and BLAST sequence identity of 42.8
  misc_feature: SWISSPROT Homolog: GRP2_PHAVU Glycine-rich cell wall structural protein 1.8 precursor (GRP 1.8) with e-value of 3.1e-23 and BLAST sequence identity of 39.9
  misc_feature: SWISSPROT Homolog: GRP1_PHAVU Glycine-rich cell wall structural protein 1.0 precursor (GRP 1.0) with e-value of 1.2e-22 and BLAST sequence identity of 40.4
  misc_feature: SWISSPROT Homolog: MYSB_ACACA Myosin heavy chain IB (Myosin heavy chain IL) with e-value of 3.7e-19 and BLAST sequence identity of 42.6
  misc_feature: SWISSPROT Homolog: DHX9_MOUSE ATP-dependent RNA helicase A (EC 3.6.1.-)(Nuclear DNA helicase II) (NDH II) (DEAH box protein 9) (mHEL-5) with e-value of 6.7e-19 and BLAST sequence identity of 36.3
  misc_feature 151982:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(286): Functional Homolog of  Ceres CLONE ID no. 34549 at SEQ ID NO. 1447 with e-value of 2.10E-97 and BLAST sequence identity of 75.5
MDRYQRVEKPRADKTIDENEIRITSQGRMRSYISYAMTLLQEKGSNEIVFKAMGRAINKTVTIVELIKRRIVGLHQITSIGSTDITDTWEPLEEGLLPLETTRHVSMITINLSKKELNTSSAGYQPPLPAEQVKAFTEFEYEGDGSPRGRGRGRGGRGRARGRGNGFVSAEHEDGGWDRNRGYPRGRGRGRGRGFRGRGRGGFNGPHADTQQDGGHNYEGPPQGRGGYNYEAPPQGRGGYNYEAPPQGRDGYNYEAPPHGRGRGRGRGNRGRGRGFRSNGPIPAAA

SEQ ID NO: 1406 - protein, 433 aa, Arabidopsis thaliana
  misc_feature (1)..(433): Ceres CLONE ID no. 34552
  misc_feature (116)..(264): Pfam Name: Copine Pfam Description: Copine
  misc_feature: Phenotype: CAULINE LEAVES - Curled 1 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
MGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 1407 - DNA, 1392 bp, Populus balsamifera subsp. trichocarpa
  misc_feature (1)..(1392): Ceres ANNOT ID no. 1516449
  misc_feature 152230:<222: Transcription Factor
  misc_feature: Phenotype: CAULINE LEAVES - Curled 1 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atggcgtctgtgtatgatggtaaaagctcaaaagagtccagttggagagattattcttcttatggttcagccaattcttcttcttcttcttcatcgaatcagaatggttatcctccagcatcaccatatccatatccatctcctcaacataattcctactacacatctcagaatcaccatgcgcctgctcctagttcatcatcttatccttatgaatcacaaagaaccccccaacatccacagaagaggttggataggaaatactcgagaatagctgacaattacaagaccctggatcaggtgactgctgctcttgctcaagctgggttagagtcttctaatctcattgttggaattgacttcacaaaaagcaacgagtggacaggtgcaagatcattcaatcggcgaagcttacatcatattggaaatggtcaaaatccatatgaacaagcaatatcaattattgggaggactttatctgcatttgatgaggataacttaattccatgttatggattcggagatgcatcaactcatgatcaggatgttttcagtttctttccggatgagagattctgtaatggattcgaggaggtgctgatgcaatacaaagaaattgttcccaaccttcggctcgcaggaccgacatcttttgcacctgttattgagatggccataactattgttgagcaaagtggtgggcagtaccatgttttactgataattgctgatggacaggtgacgagaagtgttgacacgcagtctggccagctcagtccacaagagagaaggacaattgatgcaattgtcagagcaagcaaataccctctatcgatcatcttagttggagttggtgatggaccttgggacatgatgagggagttcgatgataacatccctgctcgagccttcgacaatttccagtttgtgaattttacagaaataatgtccaaaaatgtgagtgaatcaagaaaagaaacagaatttgctcttgcatcattgatggaaataccttctcaacatcaagcaactattgagcttggcttattaggtcaccatagtgggaatgcgccagagagggttcctttgcccccaccactttacggcccgcattcttcaagcagatcaaatgcttcccgctcaagcagcttccagcggcgggtaccttcttattctggatatgatacaccagttagtggatacgaaacagcatcagggaaggccccatctcctagctctgtgtacgataatcaggtttgcgtcatttgtcttaccaatccaaaggacatggccttcggctgcgggcaccagacttgttgtgactgtggagaagacctccaactgtgccctatttgtcgacgcccaatacagaccagaatcaggctctattaa

SEQ ID NO: 1408 - protein, 463 aa, Populus balsamifera subsp. trichocarpa
  misc_feature (1)..(463): Ceres ANNOT ID no. 1516449
  misc_feature (137)..(285): Pfam Name: Copine Pfam Description: Copine
  misc_feature (420)..(452): Pfam Name: zf-C3HC4 Pfam Description: Zinc finger, C3HC4 type (RING finger)
  misc_feature: SWISSPROT Homolog: YP74_CAEEL Hypothetical protein B0228.4 in chromosome II with e-value of 1.9e-61 and BLAST sequence identity of 51.0
  misc_feature: SWISSPROT Homolog: CPNE1_HUMAN Copine-1 (Copine I) with e-value of 5.1e-25 and BLAST sequence identity of 33.7
  misc_feature: SWISSPROT Homolog: CPNE1_MOUSE Copine-1 (Copine I) with e-value of 2.3e-24 and BLAST sequence identity of 35.4
  misc_feature: SWISSPROT Homolog: CPNE3_MOUSE Copine-3 (Copine III) with e-value of 5.5e-23 and BLAST sequence identity of 36.6
  misc_feature: SWISSPROT Homolog: CPNE3_PONPY Copine-3 (Copine III) with e-value of 1.8e-22 and BLAST sequence identity of 34.7
  misc_feature 152396:<222: Transcription Factor
  misc_feature: Phenotype: CAULINE LEAVES - Curled 1 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(463): Functional Homolog of  Ceres CLONE ID no. 34552 at SEQ ID NO. 1450 with e-value of 4.59E-148 and BLAST sequence identity of 68.3
MASVYDGKSSKESSWRDYSSYGSANSSSSSSSNQNGYPPASPYPYPSPQHNSYYTSQNHHAPAPSSSSYPYESQRTPQHPQKRLDRKYSRIADNYKTLDQVTAALAQAGLESSNLIVGIDFTKSNEWTGARSFNRRSLHHIGNGQNPYEQAISIIGRTLSAFDEDNLIPCYGFGDASTHDQDVFSFFPDERFCNGFEEVLMQYKEIVPNLRLAGPTSFAPVIEMAITIVEQSGGQYHVLLIIADGQVTRSVDTQSGQLSPQERRTIDAIVRASKYPLSIILVGVGDGPWDMMREFDDNIPARAFDNFQFVNFTEIMSKNVSESRKETEFALASLMEIPSQHQATIELGLLGHHSGNAPERVPLPPPLYGPHSSSRSNASRSSSFQRRVPSYSGYDTPVSGYETASGKAPSPSSVYDNQVCVICLTNPKDMAFGCGHQTCCDCGEDLQLCPICRRPIQTRIRLY

SEQ ID NO: 1409 - DNA, 1647 bp, Populus balsamifera subsp. trichocarpa
  misc_feature (1)..(1647): Ceres ANNOT ID no. 1512976
  misc_feature 152558:<222: Transcription Factor
  misc_feature: Phenotype: CAULINE LEAVES - Curled 1 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
atgggaggtaaaagctcaaaagggtcaagagggagagattattcttcttatggttcagccaattcttcatcttcatggaatcaatatggatatcctccagcatcatcatatccatctcctcaacatgatccctattggacacaacaacatcaccatgcacctgctcctaatccatcttatccttatgaatcacaaatgcccccccaacaaccacacaagaggttggacaggaaatactcgagaatagctgataattaccagactttggatcaggttgcatgtgggcttcgacatgacagcttgaaatataacacaagatacagtttaagtgtatataagactcggccaaaatcaccgaatgcttacgctttactggagtttcattatctgttgaaacgcaatgccaaccagcctcaaaatagtcccttgttatctaatgaggatttccgtggggacattcctatgagggcagctggcattgacacttccatctttatggtgactgctgctcttgctcaagctggcttagagtcttctaatctcattgttggaattgacttcacaaaaagcaatgagtggacaggtgcaagatcattcaatcgacgaagcttacatgatattagaaatggtcaaaatccgtatgaacaagcaatatcaattattggcaggactatgtctgcattcgatgaggataacttaattccatgttttggatttggagatgcatctacacatgatcaagatgtctttagtttctttcctgaagagagattctgtaatggatttgaggaagtgctgacacgatacaaagaaattgttcccaaccttcggctcgctggaccgacatcttttgcacctgttattgaaatggccattactattgttgagcaaggtggtgggcaataccatgttttactgataattgctgatggacaggtgactagaagtgttgacacacatcatggccagctcagtccacaagagagaaggacaatcgatgcaattgtaaaggcaagtgaataccctctatcgatcattttagttggagttggtgatggaccttgggagatgatgagggagtttgatgacaacatccctgctcgagcctttgacaatttccagtttgtgaattttacagaaataatgtccaaaaatgtgagtcagtccagaaaagaggcagaatttgctcttgcagcattgatggaaataccttctcaatacaaagcaactattgagcttggcttattgggcaatcaccacagagggaatgcaccagagagggttcctttgcccccaccactttacggtcaaacttcttcaagcaaatcaaaagcttcccgttcaagcagcttccagcagcgtgtaccttcttactctgcatatgatacaccagtaagcggatatgaaacaacagcagagaaggcttcatctttatatgatacaccagttagtggatatgaaacaacagcagagagggcttcatcttctagctctgtgtatgataatcaggtttgccccatttgtctcactaatccaaagaacatggccttcggttgtgggcatcagacttgttgtgattgtggagaagacctccaagtgtgccccatatgtcgaggcccaatacaggctagaatcaggctctattag

SEQ ID NO: 1410 - protein, 548 aa, Populus balsamifera subsp. trichocarpa
  misc_feature (1)..(548): Ceres ANNOT ID no. 1512976
  misc_feature (203)..(351): Pfam Name: Copine Pfam Description: Copine
  misc_feature (505)..(537): Pfam Name: zf-C3HC4 Pfam Description: Zinc finger, C3HC4 type (RING finger)
  misc_feature: SWISSPROT Homolog: YP74_CAEEL Hypothetical protein B0228.4 in chromosome II with e-value of 1.9e-61 and BLAST sequence identity of 51.0
  misc_feature: SWISSPROT Homolog: CPNE1_HUMAN Copine-1 (Copine I) with e-value of 5.1e-25 and BLAST sequence identity of 33.7
  misc_feature: SWISSPROT Homolog: CPNE1_MOUSE Copine-1 (Copine I) with e-value of 2.3e-24 and BLAST sequence identity of 35.4
  misc_feature: SWISSPROT Homolog: CPNE3_MOUSE Copine-3 (Copine III) with e-value of 5.5e-23 and BLAST sequence identity of 36.6
  misc_feature: SWISSPROT Homolog: CPNE3_PONPY Copine-3 (Copine III) with e-value of 1.8e-22 and BLAST sequence identity of 34.7
  misc_feature 152732:<222: Transcription Factor
  misc_feature: Phenotype: CAULINE LEAVES - Curled 1 Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: CAULINE LEAVES - Serrate Margins Useful for making plants with increased biomass and foliage
  misc_feature: Phenotype: ROSETTE LEAVES - Serrate Margins Useful for making plants with increased biomass and foliage
  misc_feature (1)..(548): Functional Homolog of  Ceres CLONE ID no. 34552 at SEQ ID NO. 1450 with e-value of 9.99E-144 and BLAST sequence identity of 73.3
MGGKSSKGSRGRDYSSYGSANSSSSWNQYGYPPASSYPSPQHDPYWTQQHHHAPAPNPSYPYESQMPPQQPHKRLDRKYSRIADNYQTLDQVACGLRHDSLKYNTRYSLSVYKTRPKSPNAYALLEFHYLLKRNANQPQNSPLLSNEDFRGDIPMRAAGIDTSIFMVTAALAQAGLESSNLIVGIDFTKSNEWTGARSFNRRSLHDIRNGQNPYEQAISIIGRTMSAFDEDNLIPCFGFGDASTHDQDVFSFFPEERFCNGFEEVLTRYKEIVPNLRLAGPTSFAPVIEMAITIVEQGGGQYHVLLIIADGQVTRSVDTHHGQLSPQERRTIDAIVKASEYPLSIILVGVGDGPWEMMREFDDNIPARAFDNFQFVNFTEIMSKNVSQSRKEAEFALAALMEIPSQYKATIELGLLGNHHRGNAPERVPLPPPLYGQTSSSKSKASRSSSFQQRVPSYSAYDTPVSGYETTAEKASSLYDTPVSGYETTAERASSSSSVYDNQVCPICLTNPKNMAFGCGHQTCCDCGEDLQVCPICRGPIQARIRLY

SEQ ID NO: 1411 - protein, 366 aa, Arabidopsis thaliana
  misc_feature (1)..(366): Ceres CLONE ID no. 34612
  misc_feature (31)..(343): Pfam Name: Lipase_GDSL Pfam Description: GDSL-like Lipase/Acylhydrolase
  misc_feature: Phenotype: CAULINE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Serrate Margins Useful for making plants with increased biomass and foliage
MTNSVAKLALLGFCILQVTSLLVPQANARAFLVFGDSLVDNGNNDFLATTARADNYPYGIDFPTHRPTGRFSNGLNIPDLISEHLGQESPMPYLSPMLKKDKLLRGANFASAGIGILNDTGIQFLNIIRITKQLEYFEQYKVRVSGLVGEEEMNRLVNGALVLITLGGNDFVNNYYLVPFSARSRQFSLPDYVVFVISEYRKVLRKMYDLGARRVLVTGTGPMGCVPAELAQRSRNGECATELQRAASLFNPQLIQMITDLNNEVGSSAFIAANTQQMHMDFISDPQAYGFVTSKVACCGQGPYNGIGLCTPLSNLCPNRDLFAFWDPFHPSEKASRIIAQQILNGSPEYMHPMNLSTILTVDSMT

SEQ ID NO: 1412 - DNA, 1104 bp, Populus balsamifera subsp. trichocarpa
  misc_feature (1)..(1104): Ceres ANNOT ID no. 1479009
  misc_feature 153037:<222: Transcription Factor
  misc_feature: Phenotype: CAULINE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Serrate Margins Useful for making plants with increased biomass and foliage
atggctggctcagcaactatgaccatttccacactgataggtctagtggtggcaatggcaactacttttgttccacaagcagaagccagggctttctttgtgtttggagattcactggttgataatggcaataacaattatctagccaccacggcacgagcagactcaccaccttacggcatcgattatccaacccgtcgaccgaccggccgattctctaatggcttaagcattcctgattttatcagtcaacaccttggctcggaactcacactgccctacctaagtcccgagctaactggacagaggctacttgttggtgccaattttgcttcagctggaattggaatcctcaatgacactggaattcagtttctgaacataattagaatgtacaaacaattggagtacttcgagcaataccagaggcgtgtgacagctctcgtcggagctcagcaaactcagcaacttgtaaatggagcactgaccctcattacagtcggcgggaatgatttcgttaacaactactacttggtgcctttctcagcaaggtcacgccaattccggctccctgattacgtgagatatctcatctccgagtacaggaagattctaatgcgactgtatgatctcggagcacgtcgagttctcgtaaccgggacaggtccaatgggttgtgtgccggcagaactggcgcagaggagcccgaatgggcagtgctcggccgagctacagcgagcagcttccttgtacaaccctcaactcactcaaatgcttggacaactcaacgatcaatatggcgcggatatctttattgctgctaacacaaggcaaatgacagctgattttgtttacaatcctcaagcatatggattcgtgacatcaaagatagcatgttgtggtcaaggaccatacaatggtctagggctatgcacaccagcttcaaacttgtgccctaaccgtgacctctacgcattttgggacccattccacccatcggaaagggcaaacggtattgttgttcagcagattctcaacggagacgctacctatatgcaccccatgaatctgagcaccatcctggccttggactcgaggacctag

SEQ ID NO: 1413 - protein, 367 aa, Populus balsamifera subsp. trichocarpa
  misc_feature (1)..(367): Ceres ANNOT ID no. 1479009
  misc_feature (32)..(344): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.6e-46 and BLAST sequence identity of 32.0
  misc_feature: SWISSPROT Homolog: APG_BRANA Anter-specific proline-rich protein APG (Protein CEX) (Fragment) with e-value of 1.0e-41 and BLAST sequence identity of 31.0
  misc_feature: SWISSPROT Homolog: EST_HEVBR Esterase precursor (EC 3.1.1.-) Early nodule-specific protein homolog  (Latex allergen Hev b 13) with e-value of 1.5e-20 and BLAST sequence identity of 26.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 1.6e-18 and BLAST sequence identity of 26.6
  misc_feature 153165:<222: Transcription Factor
  misc_feature: Phenotype: CAULINE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(367): Functional Homolog of  Ceres CLONE ID no. 34612 at SEQ ID NO. 1455 with e-value of 1.99E-147 and BLAST sequence identity of 75.2
MAGSATMTISTLIGLVVAMATTFVPQAEARAFFVFGDSLVDNGNNNYLATTARADSPPYGIDYPTRRPTGRFSNGLSIPDFISQHLGSELTLPYLSPELTGQRLLVGANFASAGIGILNDTGIQFLNIIRMYKQLEYFEQYQRRVTALVGAQQTQQLVNGALTLITVGGNDFVNNYYLVPFSARSRQFRLPDYVRYLISEYRKILMRLYDLGARRVLVTGTGPMGCVPAELAQRSPNGQCSAELQRAASLYNPQLTQMLGQLNDQYGADIFIAANTRQMTADFVYNPQAYGFVTSKIACCGQGPYNGLGLCTPASNLCPNRDLYAFWDPFHPSERANGIVVQQILNGDATYMHPMNLSTILALDSRT

SEQ ID NO: 1414 - DNA, 1107 bp, Populus balsamifera subsp. trichocarpa
  misc_feature (1)..(1107): Ceres ANNOT ID no. 1469640
  misc_feature 153295:<222: Transcription Factor
  misc_feature: Phenotype: CAULINE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Serrate Margins Useful for making plants with increased biomass and foliage
atggccagtaactcatcagcttgcagttcttattgggtgatctcaggtctggcattggtactgggagccattgttcaccaagctgacgcaagggcattcctcgtcttcggtgattcactagtcgatagtggcaacaacaactacctggcaacaactgcacgagccgattcatacccttatgggatcgattatccaacacatcaagcgaccggccgattctctaatggcctgaacattcctgaccttatcagtgagcaaattggctcagaatccccgttgccttacctgagtccagagcttagaggacaaaaactacttgttggtgccaactttgcttcggctggaatcggaatccttaatgacactggaattcagtttttaaatataataagaatgcatagacaactggagtatttccaacaatatcagcaacgagttggtgcgcttatcggagccgagaaggccaagcgactcgtcaaccagtcacttatcctgctcaccgttggtgggaatgattttgtcaacaactattacttggttccttattctgcaaggtctcgccaatatgatttgccagattatgtcaagcatctcatttcagagtacaagaaaatattgatgaggctgtataatctcggagcacgtcgagttcttgtgactggtactggaccgctgggttgtgttccagcagagttggccacgaggagcacaaatggtggctgctcagcggaactacagagagcggctgccttgtataaccctcaacttgagagcatgataattgatgtcaacagaaaaatcggcagtgatgtgtttattgctgcaaatacccaccaaatgcacgcagattttgtcagtaatcctcaagcatatggatttactacatcaaagatagcatgttgtggacaagggccatacaatggcctaggactgtgcacactgttgtcaaacttgtgccctaaccgtgagctttatgcattctgggatccattccatccatcagaaaaggcaaacaaaattatagtacagcagatcatgactggctccacccgatacatgaaacctatgaatctcagcaccatcatggccttggattccaggacctga

SEQ ID NO: 1415 - protein, 368 aa, Populus balsamifera subsp. trichocarpa
  misc_feature (1)..(368): Ceres ANNOT ID no. 1469640
  misc_feature (33)..(345): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 4.6e-46 and BLAST sequence identity of 32.0
  misc_feature: SWISSPROT Homolog: APG_BRANA Anter-specific proline-rich protein APG (Protein CEX) (Fragment) with e-value of 1.0e-41 and BLAST sequence identity of 31.0
  misc_feature: SWISSPROT Homolog: EST_HEVBR Esterase precursor (EC 3.1.1.-) Early nodule-specific protein homolog  (Latex allergen Hev b 13) with e-value of 1.5e-20 and BLAST sequence identity of 26.2
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 1.6e-18 and BLAST sequence identity of 26.6
  misc_feature 153423:<222: Transcription Factor
  misc_feature: Phenotype: CAULINE LEAVES - Curled 3 Useful for making ornamental plants with altered leaf shape
  misc_feature: Phenotype: CAULINE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(368): Functional Homolog of  Ceres CLONE ID no. 34612 at SEQ ID NO. 1455 with e-value of 1.80E-144 and BLAST sequence identity of 73.9
MASNSSACSSYWVISGLALVLGAIVHQADARAFLVFGDSLVDSGNNNYLATTARADSYPYGIDYPTHQATGRFSNGLNIPDLISEQIGSESPLPYLSPELRGQKLLVGANFASAGIGILNDTGIQFLNIIRMHRQLEYFQQYQQRVGALIGAEKAKRLVNQSLILLTVGGNDFVNNYYLVPYSARSRQYDLPDYVKHLISEYKKILMRLYNLGARRVLVTGTGPLGCVPAELATRSTNGGCSAELQRAAALYNPQLESMIIDVNRKIGSDVFIAANTHQMHADFVSNPQAYGFTTSKIACCGQGPYNGLGLCTLLSNLCPNRELYAFWDPFHPSEKANKIIVQQIMTGSTRYMKPMNLSTIMALDSRT

SEQ ID NO: 1416 - protein, 232 aa, Arabidopsis thaliana
  misc_feature (1)..(232): Ceres CLONE ID no. 34635
  misc_feature (71)..(170): Pfam Name: K-box Pfam Description: K-box region
  misc_feature (9)..(59): Pfam Name: SRF-TF Pfam Description: SRF-type transcription factor DNA-binding and dimerisation domain)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLNKLDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 1417 - DNA, 690 bp, Populus balsamifera subsp. trichocarpa
  misc_feature (1)..(690): Ceres ANNOT ID no. 1487773
  misc_feature 153650:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgggtcgtggaaagattgagatcaaaaagattgaaaaccccactaacaggcaagtcacctactcaaaaagaagaaatggtattttcaagaaagcccaggaactcactgttctttgtgatgctaaggtctctcttatcatgttctccaacactaacaaattccatgagtacattagcccctccacaacgacaaagaagatctacgatcaatatcagaaggctttaggcatagatctgtggagcgctcaatacgagaaaatgcaagagcaattgcggaagctgaaagatatcaatcataagctgaaaaaagaaatcaggcagaggataggagaggaccttaatgaattgagcattgatcatctgcgcgttcttgagcaaaatatgactgaagccttgaatggtgtccgtggcaggaagtaccatgttatcaaaacacaaaccgaaacctataaaaagaaggtaaggagtttggaggagagacatggaaacctctggatggaatatgaagcaaaaatggaggatccacgatatggattagtggacagtgaaggagattatgaatctgctgctgctcttgtaaatggggcttccaacctctatgcattccgcctgcaccaggggcaccaccaccaccatcctaatcttcaccttgctggtgggtttggaccccatgacctccgtcttccttga

SEQ ID NO: 1418 - protein, 229 aa, Populus balsamifera subsp. trichocarpa
  misc_feature (1)..(229): Ceres ANNOT ID no. 1487773
  misc_feature (71)..(170): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AP3_ARATH Floral homeotic protein APETALA3 with e-value of 4.9e-122 and BLAST sequence identity of 99.1
  misc_feature: SWISSPROT Homolog: MADS1_PETHY Floral homeotic protein PMADS 1 (Green petal homeotic protein) with e-value of 4.0e-72 and BLAST sequence identity of 61.6
  misc_feature: SWISSPROT Homolog: DEFA_ANTMA Floral homeotic protein DEFICIENS with e-value of 1.7e-71 and BLAST sequence identity of 60.8
  misc_feature: SWISSPROT Homolog: MAD16_ORYSA MADS-box transcription factor 16 (OsMADS16) (Protein SUPERWOMAN1) (Protein APETALA3-like) with e-value of 1.2e-47 and BLAST sequence identity of 54.7
  misc_feature: SWISSPROT Homolog: CMB2_DIACA MADS-box protein CMB2 with e-value of 6.8e-45 and BLAST sequence identity of 45.0
  misc_feature 153763:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(229): Functional Homolog of  Ceres CLONE ID no. 34635 at SEQ ID NO. 1460 with e-value of 8.30E-62 and BLAST sequence identity of 57.4
MGRGKIEIKKIENPTNRQVTYSKRRNGIFKKAQELTVLCDAKVSLIMFSNTNKFHEYISPSTTTKKIYDQYQKALGIDLWSAQYEKMQEQLRKLKDINHKLKKEIRQRIGEDLNELSIDHLRVLEQNMTEALNGVRGRKYHVIKTQTETYKKKVRSLEERHGNLWMEYEAKMEDPRYGLVDSEGDYESAAALVNGASNLYAFRLHQGHHHHHPNLHLAGGFGPHDLRLP

SEQ ID NO: 1419 - DNA, 684 bp, Populus balsamifera subsp. trichocarpa
  misc_feature (1)..(684): Ceres ANNOT ID no. 1457333
  misc_feature 153855:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgggtcgtggaaagattgaaatcaagaagatcgaaaaccccacaaacaggcaagtcacctactcgaagagaagaaatggtattttcaagaaagcccaagaactcactgtactttgtgatgctaaggtctctcttatcatgttctccaacactaacaaactcaatgagtacattagcccctccacatcgacaaagaagatctacgatcaatatcagaacgctttaggcatagatctgtggggcactcaatacgagaaaatgcaagagcacttgaggaagctgaatgatatcaatcataagctgagacaagaaatcaggcagaggagaggagagggcctgaatgatctgagcattgatcatctgcgcggtcttgagcaacatatgactgaagccttgaatggtgtgcgtggcaggaagtaccatgtgatcaaaacacaaaacgaaacctacaggaagaaggtgaagaatttagaggagagacatggaaacctcttgatggaatatgaagcaaaactagaggatcgacagtatggtttagtggacaatgaagctgctgttgcacttgcaaatggggcttccaacctctatgcattccgcctgcatcacgggcacaaccaccaccaccacctccctaatcttcaccttggagatggatttggagcccatgaacttcgccttccttga

SEQ ID NO: 1420 - protein, 227 aa, Populus balsamifera subsp. trichocarpa
  misc_feature (1)..(227): Ceres ANNOT ID no. 1457333
  misc_feature (71)..(170): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AP3_ARATH Floral homeotic protein APETALA3 with e-value of 4.9e-122 and BLAST sequence identity of 99.1
  misc_feature: SWISSPROT Homolog: MADS1_PETHY Floral homeotic protein PMADS 1 (Green petal homeotic protein) with e-value of 4.0e-72 and BLAST sequence identity of 61.6
  misc_feature: SWISSPROT Homolog: DEFA_ANTMA Floral homeotic protein DEFICIENS with e-value of 1.7e-71 and BLAST sequence identity of 60.8
  misc_feature: SWISSPROT Homolog: MAD16_ORYSA MADS-box transcription factor 16 (OsMADS16) (Protein SUPERWOMAN1) (Protein APETALA3-like) with e-value of 1.2e-47 and BLAST sequence identity of 54.7
  misc_feature: SWISSPROT Homolog: CMB2_DIACA MADS-box protein CMB2 with e-value of 6.8e-45 and BLAST sequence identity of 45.0
  misc_feature 153968:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(227): Functional Homolog of  Ceres CLONE ID no. 34635 at SEQ ID NO. 1460 with e-value of 5.60E-56 and BLAST sequence identity of 56.6
MGRGKIEIKKIENPTNRQVTYSKRRNGIFKKAQELTVLCDAKVSLIMFSNTNKLNEYISPSTSTKKIYDQYQNALGIDLWGTQYEKMQEHLRKLNDINHKLRQEIRQRRGEGLNDLSIDHLRGLEQHMTEALNGVRGRKYHVIKTQNETYRKKVKNLEERHGNLLMEYEAKLEDRQYGLVDNEAAVALANGASNLYAFRLHHGHNHHHHLPNLHLGDGFGAHELRLP

SEQ ID NO: 1421 - DNA, 606 bp, Populus balsamifera subsp. trichocarpa
  misc_feature (1)..(606): Ceres ANNOT ID no. 1442634
  misc_feature 154060:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atggcaagagggaagatccagatcaagaagattgagaactcgactaacaggcaagttacttactccaaacgacgaaatggtctcttcaagaaagctcatgagctcactgttctttgtgatgccgaggtctctcttgtcatggtttcttgcactgacaaggtccacgactacactagcccctccactacaacgaagcggatatttgatcagtatcagcagactaagggaatagatctttggagctcccactatgagataatgaaagagaacttggaaaaactgaaagaggtgaacatgaaaatcaggagggagatgaggcagaggatgggtcagtgtttgaatggtttgagctttcaggatctgcagagtcttgagagcgatatggaaagtgcttggagggttattcatgaccgtgcggatcgtgtgcttactaatcagattgaaacttccaagaaaaaggcgaggaatgtggagcaaatcaacagaaaacttcaagtggaactagtaagtatggagctccaacgagctagtcaggaagcaatggatcaagatccatacggcttggttgacaatggaggggactacaattctgttatgggattttga

SEQ ID NO: 1422 - protein, 201 aa, Populus balsamifera subsp. trichocarpa
  misc_feature (1)..(201): Ceres ANNOT ID no. 1442634
  misc_feature (71)..(170): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AP3_ARATH Floral homeotic protein APETALA3 with e-value of 4.9e-122 and BLAST sequence identity of 99.1
  misc_feature: SWISSPROT Homolog: MADS1_PETHY Floral homeotic protein PMADS 1 (Green petal homeotic protein) with e-value of 4.0e-72 and BLAST sequence identity of 61.6
  misc_feature: SWISSPROT Homolog: DEFA_ANTMA Floral homeotic protein DEFICIENS with e-value of 1.7e-71 and BLAST sequence identity of 60.8
  misc_feature: SWISSPROT Homolog: MAD16_ORYSA MADS-box transcription factor 16 (OsMADS16) (Protein SUPERWOMAN1) (Protein APETALA3-like) with e-value of 1.2e-47 and BLAST sequence identity of 54.7
  misc_feature: SWISSPROT Homolog: CMB2_DIACA MADS-box protein CMB2 with e-value of 6.8e-45 and BLAST sequence identity of 45.0
  misc_feature 154171:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(201): Functional Homolog of  Ceres CLONE ID no. 34635 at SEQ ID NO. 1460 with e-value of 6.39E-55 and BLAST sequence identity of 59.1
MARGKIQIKKIENSTNRQVTYSKRRNGLFKKAHELTVLCDAEVSLVMVSCTDKVHDYTSPSTTTKRIFDQYQQTKGIDLWSSHYEIMKENLEKLKEVNMKIRREMRQRMGQCLNGLSFQDLQSLESDMESAWRVIHDRADRVLTNQIETSKKKARNVEQINRKLQVELVSMELQRASQEAMDQDPYGLVDNGGDYNSVMGF

SEQ ID NO: 1423 - protein, 470 aa, Arabidopsis thaliana
  misc_feature (1)..(470): Ceres CLONE ID no. 34783
  misc_feature (122)..(456): Pfam Name: PALP Pfam Description: Pyridoxal-phosphate dependent enzyme
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MAASGTSATFRASVSSAPSSSSQLTHLKSPFKAVKYTPLPSSRSKSSSFSVSCTIAKDPPVLMAAGSDPALWQRPDSFGRFGKFGGKYVPETLMHALSELESAFYALATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRGVHSGTATLKDATSEAIRDWVTNVETTHYILGSVAGPHPYPMMVRDFHAVIGKETRKQALEKWGGKPDVLVACVGGGSNAMGLFHEFVNDTEVRMIGVEAAGFGLDSGKHAATLTKGDVGVLHGAMSYLLQDDDGQIIEPHSISAGLDYPGVGPEHSFFKDMGRAEYYSITDEEALEAFKRVSRLEGIIPALETSHALAYLEKLCPTLSDGTRVVLNFSGRGDKDVQTVAKYLDV

SEQ ID NO: 1424 - DNA, 1419 bp, Populus balsamifera subsp. trichocarpa
  misc_feature (1)..(1419): Ceres ANNOT ID no. 1466952
  misc_feature 154410:<222: Transcription Factor
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcagccaccgcttccataaccaccgcagcagcagccaccaccaaacctcagtcctcttcttcttctctcctcaagccctactcttcttcccaattacccattaaattctccaaattttcaacgtctcgcgcaccttcaagatttgcaatttcttgcactttggcccgagaggctgaggttaaaatggaggaagtggcggattctgacccggccctatggcaacgacctgattcttttggtaggtttggtaaatatggcgggaaatatgtacctgagacccttatgtatgctctcactgagcttgaatctgctttctattccttcaaggatgatcctgaatttaagaaagaaataaatggaattttgaaagattatgttggaagggaaaatcctctttattttgctgagcggcttacagagcattataaacgccctagtggtgaagggccacatatttatctcaagagggaagatcttaaccacacaggtgctcataagattaacaatgctgttggccaagtcttacttgcaaagcgtttgggaaaacagcgcataattgctgaaactggagctggtcagcatggagttgcaactgctacagtctgtgcgcggtttggtttgccatgtgttgtttatatgggcgcacaagatatggaaagacaagcactaaatgttttcaggatgcgtcttcttggggctgaggtgagaggagttcattctggtactgcaacattgaaagatgctacatcagaagctatacgagattgggtgactaatgtggagacaacccattatattttgggatctgttgctgggccacatccctttcccatgatggtgcgagagttccatagggttattggtatagaaacaagaaaacaagcattggaaaaatggggtgggaagccagatgtgctggttgcatgtgttggtggcggttcaaatgcaatgggactctttgatgaatttattaaggacaaggatgtgaggttgatcggtgtggaggctgcaggtttaggcatagatagcggcaagcacgctgccactctgaccaaaggagaagtaggggtgttgcatggagctatgagctatttgttacaagatgaagatggacaaataattgagcctcattcaattagtgcagggttggactaccctggagttggacctgagcacagtttcctgaaagataaaggacgtgctgaatactatagtgtcacagatcaagaagcattggatgcattcaagagattatcgcgattagagggcataattcctgctttggagacatcacatgcgctggcttatttggagaagctctgccccactctcccggatggaacaaaggttgttcttaactgcagcggcagaggggataaagatgttcaaactgccatcaagtatttggaggtttaa

SEQ ID NO: 1425 - protein, 472 aa, Populus balsamifera subsp. trichocarpa
  misc_feature (1)..(472): Ceres ANNOT ID no. 1466952
  misc_feature (124)..(458): Pfam Name: PALP Pfam Description: Pyridoxal-phosphate dependent enzyme
  misc_feature: SWISSPROT Homolog: TRPB1_ARATH Tryptophan synthase beta chain 1, (EC 4.2.1.20) with e-value of 2.8e-252 and BLAST sequence identity of 100.0
  misc_feature: SWISSPROT Homolog: TRBP2_ARATH Tryptophan synthase beta chain 2, (EC 4.2.1.20) with e-value of 1.3e-229 and BLAST sequence identity of 90.2
  misc_feature: SWISSPROT Homolog: TRPB_CAMAC Tryptophan synthase beta chain 2, (EC 4.2.1.20) with e-value of 9.5e-197 and BLAST sequence identity of 80.3
  misc_feature: SWISSPROT Homolog: TRPB2_MAIZE Tryptophan synthase beta chain 2, (EC 4.2.1.20) (Orange pericarp 2) (Fragment) with e-value of 5.4e-194 and BLAST sequence identity of 83.4
  misc_feature: SWISSPROT Homolog: TRPB1_MAIZE Tryptophan synthase beta chain 1 (EC 4.2.1.20) (Orange pericarp 1) (Fragment) with e-value of 1.1e-188 and BLAST sequence identity of 88.7
  misc_feature 154564:<222: Transcription Factor
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(472): Functional Homolog of  Ceres CLONE ID no. 34783 at SEQ ID NO. 1467 with e-value of 3.60E-203 and BLAST sequence identity of 80.3
MAATASITTAAAATTKPQSSSSSLLKPYSSSQLPIKFSKFSTSRAPSRFAISCTLAREAEVKMEEVADSDPALWQRPDSFGRFGKYGGKYVPETLMYALTELESAFYSFKDDPEFKKEINGILKDYVGRENPLYFAERLTEHYKRPSGEGPHIYLKREDLNHTGAHKINNAVGQVLLAKRLGKQRIIAETGAGQHGVATATVCARFGLPCVVYMGAQDMERQALNVFRMRLLGAEVRGVHSGTATLKDATSEAIRDWVTNVETTHYILGSVAGPHPFPMMVREFHRVIGIETRKQALEKWGGKPDVLVACVGGGSNAMGLFDEFIKDKDVRLIGVEAAGLGIDSGKHAATLTKGEVGVLHGAMSYLLQDEDGQIIEPHSISAGLDYPGVGPEHSFLKDKGRAEYYSVTDQEALDAFKRLSRLEGIIPALETSHALAYLEKLCPTLPDGTKVVLNCSGRGDKDVQTAIKYLEV

SEQ ID NO: 1426 - DNA, 1440 bp, Populus balsamifera subsp. trichocarpa
  misc_feature (1)..(1440): Ceres ANNOT ID no. 1523551
  misc_feature 154722:<222: Transcription Factor
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcagctaccaccaccaccgccgcatccataaccacagcagcagcagcgtccaccgctgcaaccatcaccaaatctcaatcttcctctttcctcaaaccctactcttcttcgcagttacccttcaaattttccaaatttacagcatctcgcgcaccttcaaggttggcaatttcttgcactttggcccgagaggctgtggttaaaatggaggacgtggtggattctgacccggcccaatggcaacgacccgattcttttggccggtttggtaaatttggcgggaaatatgtacctgaaacccttatccatgcactcactgagcttgaatctgctttccattccttaaaagatgaccctgaatttaagaaagaactagatgggatattgaaagattatgttggaagggaaaaccctctttattttgctgagcggcttacagagcattataagcgtcctaatggtgaagggcctcatatttatctcaagagggaagatttaaaccacacaggtgctcataagattaataatgctattggccaagtcttgctagcaaagcgtttgggaaaacagcggataattgctgaaactggagctggtcagcatggagttgcaactgctaccgtttgtgcacggttcggttttccatgtgttgtttatatgggcgcacaagatatggaaagacaatcgcttaatgttttcaggatgcgtcttcttggggctgaagtgagaggagttcattctggcactgcaaccttgaaagatgctacatcagaagctatacgagattgggtgactaacgtggagacaacccattatattctgggatctgttgcagggccacatccttttcccatgatggtgcgagagttccatagggttattggtatagaaacaagaaaacaggcactggaaaaatggggtgggaagccagatgtgctggttgcatgtgttggtggtggttcaaacgcaatgggactctttgatgatttcattaaggacaaggatgttaggttgattggcgtggaggctgcgggtttaggagtagatagtggcaagcatgctgccactctgaccaaaggagaagtgggggtgttgcatggagctatgagctatttgttacaagatgaagatggacaaataattgagcctcattctattagtgcagggttggactaccctggagttggacccgagcacagcttcttgaaagataaaggacgtgctgaatactatagcgtcacagatgaagaagctttggatgcattcaagagattatcgcgattagagggcataatccctgctttggagacatcacatgcactggcgtatttggagaatctctgccccactctcccagatggaacaaaggtggttcttaactgcagtggcagaggggacaaagatgttcaaactgccataaagtatttgcaggtttaa

SEQ ID NO: 1427 - protein, 479 aa, Populus balsamifera subsp. trichocarpa
  misc_feature (1)..(479): Ceres ANNOT ID no. 1523551
  misc_feature (131)..(465): Pfam Name: PALP Pfam Description: Pyridoxal-phosphate dependent enzyme
  misc_feature: SWISSPROT Homolog: TRPB1_ARATH Tryptophan synthase beta chain 1, (EC 4.2.1.20) with e-value of 2.8e-252 and BLAST sequence identity of 100.0
  misc_feature: SWISSPROT Homolog: TRBP2_ARATH Tryptophan synthase beta chain 2, (EC 4.2.1.20) with e-value of 1.3e-229 and BLAST sequence identity of 90.2
  misc_feature: SWISSPROT Homolog: TRPB_CAMAC Tryptophan synthase beta chain 2, (EC 4.2.1.20) with e-value of 9.5e-197 and BLAST sequence identity of 80.3
  misc_feature: SWISSPROT Homolog: TRPB2_MAIZE Tryptophan synthase beta chain 2, (EC 4.2.1.20) (Orange pericarp 2) (Fragment) with e-value of 5.4e-194 and BLAST sequence identity of 83.4
  misc_feature: SWISSPROT Homolog: TRPB1_MAIZE Tryptophan synthase beta chain 1 (EC 4.2.1.20) (Orange pericarp 1) (Fragment) with e-value of 1.1e-188 and BLAST sequence identity of 88.7
  misc_feature 154878:<222: Transcription Factor
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(479): Functional Homolog of  Ceres CLONE ID no. 34783 at SEQ ID NO. 1467 with e-value of 8.59E-202 and BLAST sequence identity of 82.6
MAATTTTAASITTAAAASTAATITKSQSSSFLKPYSSSQLPFKFSKFTASRAPSRLAISCTLAREAVVKMEDVVDSDPAQWQRPDSFGRFGKFGGKYVPETLIHALTELESAFHSLKDDPEFKKELDGILKDYVGRENPLYFAERLTEHYKRPNGEGPHIYLKREDLNHTGAHKINNAIGQVLLAKRLGKQRIIAETGAGQHGVATATVCARFGFPCVVYMGAQDMERQSLNVFRMRLLGAEVRGVHSGTATLKDATSEAIRDWVTNVETTHYILGSVAGPHPFPMMVREFHRVIGIETRKQALEKWGGKPDVLVACVGGGSNAMGLFDDFIKDKDVRLIGVEAAGLGVDSGKHAATLTKGEVGVLHGAMSYLLQDEDGQIIEPHSISAGLDYPGVGPEHSFLKDKGRAEYYSVTDEEALDAFKRLSRLEGIIPALETSHALAYLENLCPTLPDGTKVVLNCSGRGDKDVQTAIKYLQV

SEQ ID NO: 1428 - DNA, 1557 bp, Populus balsamifera subsp. trichocarpa
  misc_feature (1)..(1557): Ceres ANNOT ID no. 1470164
  misc_feature 155036:<222: Transcription Factor
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcagctaccaccaccaccgccgcatccataaccacagcagcagcagcgtccaccgctgcaaccatcaccaaatctcaatcttcctctttcctcaaaccctactcttcttcgcagttacccttcaaattttccaaatttacagcatctcgcgcaccttcaaggttggcaatttcttgcactttggcccgagaggctgtggttaaaatggaggacgtggtggattctgacccggcccaatggcaacgacccgattcttttggccggtttggtaaatttggcgggaaatatgtacctgaaacccttatccatgcactcactgagcttgaatctgctttccattccttaaaagatgaccctgaatttaagaaagaactagatgggatattgaaagattatgttggaagggaaaaccctctttattttgctgagcggcttacagagcattataagcgtcctaatggtgaagggcctcatatttatctcaagagggaagatttaaaccacacaggtgctcataagattaataatgctattggccaagtcttgctagcaaagcgtttgggaaaacagcggataattgctgaaactggagctggtcagcatggagttgcaactgctaccgtttgtgcacggttcggttttccatgtgttgtttatatgggcgcacaagatatggaaagacaatcgcttaatgttttcaggatgcgtcttcttggggctgaagtgagaggagttcattctggcactgcaaccttgaaagatgctacatcagaagctatacgagattgggtgactaacgtggagacaacccattatattctgggatctgttgcagggccacatccttttcccatgatggtgcgagagttccatagggttattggtatagaaacaagaaaacaggcactggaaaaatggggtgggaagccagatgtgctggttgcatgtgttggtggtggttcaaacgcaatgggactctttgatgatttcattaaggacaaggatgttaggttgattggcgtggaggctgcgggtttaggagtagatagtggcaagcatgctgccactctgaccaaaggagaagtgggggtgttgcatggagctatgagctatttgttacaagatgaagatggacaaataattgagcctcattctattagtgcagggttggactaccctggagttggacccgagcacagcttcttgaaagataaaggacgtgctgaatactatagcgtcacagatgaagaagctttggatgcattcaagagattatcgcgattagagggcataatccctgctttggagacatcacatgcactggcgtatttggagaatctctgccccactctcccagatggaacaaaggtggttcttaactgcagtggcagaggggacaaagatgttcaaactgccataaatgctgggggtgtcccgctcataggttttagagcaagcataatttgcaattcagctcatattgacaatggaaatgctgagaaatacgtcgacctttcagtgccatggagagacggtgcctccagttgccactag

SEQ ID NO: 1429 - protein, 518 aa, Populus balsamifera subsp. trichocarpa
  misc_feature (1)..(518): Ceres ANNOT ID no. 1470164
  misc_feature (131)..(465): Pfam Name: PALP Pfam Description: Pyridoxal-phosphate dependent enzyme
  misc_feature: SWISSPROT Homolog: TRPB1_ARATH Tryptophan synthase beta chain 1, (EC 4.2.1.20) with e-value of 2.8e-252 and BLAST sequence identity of 100.0
  misc_feature: SWISSPROT Homolog: TRBP2_ARATH Tryptophan synthase beta chain 2, (EC 4.2.1.20) with e-value of 1.3e-229 and BLAST sequence identity of 90.2
  misc_feature: SWISSPROT Homolog: TRPB_CAMAC Tryptophan synthase beta chain 2, (EC 4.2.1.20) with e-value of 9.5e-197 and BLAST sequence identity of 80.3
  misc_feature: SWISSPROT Homolog: TRPB2_MAIZE Tryptophan synthase beta chain 2, (EC 4.2.1.20) (Orange pericarp 2) (Fragment) with e-value of 5.4e-194 and BLAST sequence identity of 83.4
  misc_feature: SWISSPROT Homolog: TRPB1_MAIZE Tryptophan synthase beta chain 1 (EC 4.2.1.20) (Orange pericarp 1) (Fragment) with e-value of 1.1e-188 and BLAST sequence identity of 88.7
  misc_feature 155194:<222: Transcription Factor
  misc_feature: Phenotype: INFLORESCENCE - Asecondary Branching Useful for making ornamental plants with modified flowers
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(518): Functional Homolog of  Ceres CLONE ID no. 34783 at SEQ ID NO. 1467 with e-value of 8.90E-200 and BLAST sequence identity of 83.0
MAATTTTAASITTAAAASTAATITKSQSSSFLKPYSSSQLPFKFSKFTASRAPSRLAISCTLAREAVVKMEDVVDSDPAQWQRPDSFGRFGKFGGKYVPETLIHALTELESAFHSLKDDPEFKKELDGILKDYVGRENPLYFAERLTEHYKRPNGEGPHIYLKREDLNHTGAHKINNAIGQVLLAKRLGKQRIIAETGAGQHGVATATVCARFGFPCVVYMGAQDMERQSLNVFRMRLLGAEVRGVHSGTATLKDATSEAIRDWVTNVETTHYILGSVAGPHPFPMMVREFHRVIGIETRKQALEKWGGKPDVLVACVGGGSNAMGLFDDFIKDKDVRLIGVEAAGLGVDSGKHAATLTKGEVGVLHGAMSYLLQDEDGQIIEPHSISAGLDYPGVGPEHSFLKDKGRAEYYSVTDEEALDAFKRLSRLEGIIPALETSHALAYLENLCPTLPDGTKVVLNCSGRGDKDVQTAINAGGVPLIGFRASIICNSAHIDNGNAEKYVDLSVPWRDGASSCH

SEQ ID NO: 1430 - protein, 259 aa, Arabidopsis thaliana
  misc_feature (1)..(259): Ceres CLONE ID no. 34944
  misc_feature (1)..(259): Also Known As Ceres CDNA ID no. 23389848
  misc_feature (1)..(259): Also Known As Ceres GEMINI ID 554C7
  misc_feature (8)..(72): Pfam Name: RRM_1 Pfam Description: RNA recognition motif. (a.k.a. RRM RBD, or RNP domain)
  misc_feature 155382:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MASQVRSVKVGNLSSGATEHDIKEFFSFSGEVESIDIQSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHTSEYSKN

SEQ ID NO: 1431 - DNA, 876 bp, Populus balsamifera subsp. trichocarpa
  misc_feature (1)..(876): Ceres ANNOT ID no. 1485544
  misc_feature 155466:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggcctcaatgcttgcgacgaggaagtttagtggcttggtaaaaacagtaaaagtcagcaacgtttccttaggagcatctgagcgagacctcaaagaattcttttctttttctggtgatattgaatatgttgaaatgaaaagtgataatgagcgttctcaaattgcatatgttaccttcaaagattctcaaggagcagacactgctgttcttctctcgggagcaacaatagttgatctttctgtcactgtggctttggatccagattaccagcttccacctgctgctttagcagaactctctgcaacaggaaataaagctcctggtgatgaatcagctcttcggaaggcagaagatgtagtcagtggcatgcttgcaaagggtttcatcttgggcaaagatgcaatcaacaaagcaaagggttttgatgagaagcaccagttgacttcgacagcctcagctaaagttgtttctttcgacaaaaagataggtctcactgagaagattagtgctggcaccactgttgttggtgacaaagtccgggaagtggatcagaaatttcaggtttctgagaaaaccaaatcagcatttgcagttgccgagcagaaagtcagtagcgcaggatctgccataatgagtaataggtacgtgtttactggggctgcttgggtcactggtgcattcaataaggttgccaaggcagctggggatgttggccagaaggccaaagaaaaggcaggaatggctgaagaggaacaaaagaggaaaatggtggatgactttgctcaggtccacctatctgagtctcccaaagcatccggtgcaagtgaccagaagccgtccaagcctccacctgcacaaggtttgattctttga

SEQ ID NO: 1432 - protein, 288 aa, Populus balsamifera subsp. trichocarpa
  misc_feature (1)..(288): Ceres ANNOT ID no. 1485544
  misc_feature (14)..(81): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 2.0e-09 and BLAST sequence identity of 24.0
  misc_feature 155543:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(288): Functional Homolog of  Ceres CLONE ID no. 34944 at SEQ ID NO. 1474 with e-value of 2.09E-72 and BLAST sequence identity of 59.6
MLATRKFSGLVKTVKVSNVSLGASERDLKEFFSFSGDIEYVEMKSDNERSQIAYVTFKDSQGADTAVLLSGATIVDLSVTVALDPDYQLPPAALAELSATGNKAPGDESALRKAEDVVSGMLAKGFILGKDAINKAKGFDEKHQLTSTASAKVVSFDKKIGLTEKISAGTTVVGDKVREVDQKFQVSEKTKSAFAVAEQKVSSAGSAIMSNRYVFTGAAWVTGAFNKVAKAAGDVGQKAKEKAGMAEEEQKRKMVDDFAQVHLSESPKASGASDQKPSKPPPAQGLIL

SEQ ID NO: 1433 - DNA, 870 bp, Populus balsamifera subsp. trichocarpa
  misc_feature (1)..(870): Ceres ANNOT ID no. 1447051
  misc_feature 155641:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggaaatgaaatgttttagactgaacaaggacccacttgttactgtcatactggtaaaaacagtgaaagttagtaatgtttctttaggagcttctgagcaagacctcaaggaattcttttctttttctggtgatattgaatatgttgaaatgaaaagtgagaatgagcaatctcagattgcatatgtatccttcaaagattctcaaggagcagacactgctgttcttctttcgggagcaacaatagttgaccttcctgtcaccgtaactttggatccagattaccagctgccaccagctgctttagcagcacttgttgcaacagaaaataaagctccgagtgatgaatcagctcttcataaggcagaagatgtggttactggcatgcttgctaagggctttatcttgggtaaagatgcgatcaacaaagccaagagttttgatgagaagcaccagttgacttcaacagcctcagctaaagttgcttctttagacaaaaagataggtctcactgagaagattagtgctagcaccactgttgttggtgacaaagttcgggaagtggatcagaaatttcaggtttctgagaaaactaaattggcacttgcagctgctgagcagaaagtcagtagtgcaggatctgccataatgagtaacaggtacgtgtttactggggctgcttgggtgacaggcacattcaataaggttgcaaaggcagctaaagaaaaggtagggatgtccgaagaggaacaaaagaggaaaatggtggatgactatgctcaggtccacctatctgagtccccaaaagcatctggtgaaagtgagcagcagccttccaagcctccacctgctcaaggtttgattctttaa

SEQ ID NO: 1434 - protein, 289 aa, Populus balsamifera subsp. trichocarpa
  misc_feature (1)..(289): Ceres ANNOT ID no. 1447051
  misc_feature (22)..(89): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 2.0e-09 and BLAST sequence identity of 24.0
  misc_feature 155718:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(289): Functional Homolog of  Ceres CLONE ID no. 34944 at SEQ ID NO. 1474 with e-value of 3.79E-66 and BLAST sequence identity of 59.2
MEMKCFRLNKDPLVTVILVKTVKVSNVSLGASEQDLKEFFSFSGDIEYVEMKSENEQSQIAYVSFKDSQGADTAVLLSGATIVDLPVTVTLDPDYQLPPAALAALVATENKAPSDESALHKAEDVVTGMLAKGFILGKDAINKAKSFDEKHQLTSTASAKVASLDKKIGLTEKISASTTVVGDKVREVDQKFQVSEKTKLALAAAEQKVSSAGSAIMSNRYVFTGAAWVTGTFNKVAKAAKEKVGMSEEEQKRKMVDDYAQVHLSESPKASGESEQQPSKPPPAQGLIL

SEQ ID NO: 1435 - protein, 247 aa, Arabidopsis thaliana
  misc_feature (1)..(247): Ceres CLONE ID no. 34976
  misc_feature (80)..(245): Pfam Name: DUF617 Pfam Description: Protein of unknown function, DUF617
  misc_feature: Phenotype: WHOLE PLANT - Small Useful for modulating plant size
  misc_feature: Phenotype: ROSETTE LEAVES - Oval Shaped Useful for making plants with increased biomass and foliage
MTKIDSLRRFLLPCISTPTNPTTVSTTSTGASKKRLSTSLRDDIDVQDSASSSASSSEATSAVDYSISAVTVPQRPSKTMVIGTIFGRRKGHVWFCVQHDRLSVKPILLLELSIATSQLVHEMGSGLVRVALECPTRPELKSCLLRSVPVWTMFCNGRKLGFAVRRSANEETRMMLKRLESMTVGAGVLPSGSGLGGSDESDTDEVMYMRANYEHVVGSSDSESFHLINPDANSAQELSIFLLRTSS

SEQ ID NO: 1436 - DNA, 486 bp, Populus balsamifera subsp. trichocarpa
  misc_feature (1)..(486): Ceres ANNOT ID no. 1507231
  misc_feature 155899:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
atggtgatcagtaccattttcggcaaccgcagaggccacgtttggttctgcatccaacatgaccgtctctccactatacctcttctccttcttgaactctcaatccccacccaccaactcgtcaaagaaatgcaatgtgggctggtccgcctcgctcttgagtgcaatcgatctgagttgaactctgtcccgctacgagcagtcccagtctggacagtgaattgcaatgggaagaaagcaggttttgctttaaggagaaaggcaagtgagcagattcgtttgatgttgaagacagtgcagtcaatgacggttgctgcgggtgttattccggccaggttggggtcatcttcggattcggaggagatcatgtatatgagggctaattatgagcatatggttggtagagctgattcagaatcgtttcatttgattaacccagatgagtgtcctggtcaagaactcagtgtgttcttgatgaggtcttga

SEQ ID NO: 1437 - protein, 161 aa, Populus balsamifera subsp. trichocarpa
  misc_feature (1)..(161): Ceres ANNOT ID no. 1507231
  misc_feature (1)..(161): Pfam Name: DUF617 Pfam Description: Protein of unknown function, DUF617
  misc_feature 155955:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(161): Functional Homolog of  Ceres CLONE ID no. 34976 at SEQ ID NO. 1479 with e-value of 1.70E-54 and BLAST sequence identity of 68.9
MVISTIFGNRRGHVWFCIQHDRLSTIPLLLLELSIPTHQLVKEMQCGLVRLALECNRSELNSVPLRAVPVWTVNCNGKKAGFALRRKASEQIRLMLKTVQSMTVAAGVIPARLGSSSDSEEIMYMRANYEHMVGRADSESFHLINPDECPGQELSVFLMRS

SEQ ID NO: 1438 - protein, 264 aa, Arabidopsis thaliana
  misc_feature (1)..(264): Ceres CLONE ID no. 35015
  misc_feature (5)..(243): Pfam Name: Tetraspannin Pfam Description: Tetraspanin family
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MGMGTSTFVIRWVNLLTMLLAVAVIIFGVWMSTHNDGCRRSLTFPVIALGGFIFLISIIGFLGACKRSVALLWIYLAVLLIVLIAILVFTVLAFIVTNNGSGHTNPGLRYKEYKLNDYSSWFLKQLNNTSNWIRLKSCLVKSEQCRKLSKKYKTIKQLKSAELTPIEAGCCRPPSECGYPAVNASYYDLSFHSISSNKDCKLYKNLRTIKCYNCDSCKAGVAQYMKTEWRLVAIFNVVLFVVLSMVYFVGCCARRNAASYRSKA

SEQ ID NO: 1439 - DNA, 762 bp, Populus balsamifera subsp. trichocarpa
  misc_feature (1)..(762): Ceres ANNOT ID no. 1438730
  misc_feature 156114:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atgggtgtaggcaccagcaactttgtgattagatggatcaactttctcaccatgggtgcttttctatctgctttctttcttacactgatgattattgttgttcttggttatgctggtaactggttgtccatgcttttagctatagctgtcataatttttggggtatggatgagcacacatcatgacagttgtcgaaggtctcttactctcccagtgttgggccttggtgctgtcatctttgtaatgtttattataactaataatggatctggtcatagtgtccctggtttgagatacaaggagtatcaacttcaggattacagctcatggtttcttaaacagttgaacaacaccaagaactggaaccgattgaagagttgtcttgtgaaaactgatgactgcaataacctaccaagaaaatataagactattaagcagtacaagtcagccaaactaacagccattgaagctggttgctgccgaccaccatccgtgtgcggttatcctgctgtcaatgcttcatactacgacttgagctttcatccgattagctccaataaggactgcaaactttacaaaaattcccgggctaccaaatgctacaattgtgattcctgcaaggcaggagttgcacaatatatgaaaactgagtggagagtggttgccatctttaatgtcattctgtttgttgttctgtcaatgatctattttgtcgggtgttgtgccagacgaagtgctgccaggagtcactctaaagcttga

SEQ ID NO: 1440 - protein, 253 aa, Populus balsamifera subsp. trichocarpa
  misc_feature (1)..(253): Ceres ANNOT ID no. 1438730
  misc_feature (31)..(232): Pfam Name: Tetraspannin Pfam Description: Tetraspanin family
  misc_feature 156178:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(253): Functional Homolog of  Ceres CLONE ID no. 35015 at SEQ ID NO. 1482 with e-value of 2.09E-88 and BLAST sequence identity of 81.0
MGVGTSNFVIRWINFLTMGAFLSAFFLTLMIIVVLGYAGNWLSMLLAIAVIIFGVWMSTHHDSCRRSLTLPVLGLGAVIFVMFIITNNGSGHSVPGLRYKEYQLQDYSSWFLKQLNNTKNWNRLKSCLVKTDDCNNLPRKYKTIKQYKSAKLTAIEAGCCRPPSVCGYPAVNASYYDLSFHPISSNKDCKLYKNSRATKCYNCDSCKAGVAQYMKTEWRVVAIFNVILFVVLSMIYFVGCCARRSAARSHSKA

SEQ ID NO: 1441 - protein, 337 aa, Arabidopsis thaliana
  misc_feature (1)..(337): Ceres CLONE ID no. 35051
  misc_feature (201)..(299): Pfam Name: Pribosyltran Pfam Description: Phosphoribosyl transferase domain
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
MSENAANNIMETKICTDAIVSELQKKKVHLFYCLECEELARNIAAESDHITLQSINWRSFADGFPNLFINNAHDIRGQHVAFLASFSSPAVIFEQISVIYLLPRLFVASFTLVLPFFPTGSFERMEEEGDVATAFTMARIVSNIPISRGGPTSVVIYDIHALQERFYFADQVLPLFETGIPLLTKRLQQLPETEKVIVAFPDDGAWKRFHKLLDHYPTVVCTKVREGDKRIVRLKEGNPAGCHVVIVDDLVQSGGTLIECQKVLAAHGAVKVSAYVTHGVFPKSSWERFTHKKNGLEEAFAYFWITDSCPQTVKAIGNKAPFEVLSLAGSIADALQI

SEQ ID NO: 1442 - DNA, 984 bp, Populus balsamifera subsp. trichocarpa
  misc_feature (1)..(984): Ceres ANNOT ID no. 1443033
  misc_feature 156388:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
atggaggtggacaaagtagagacacaacaacaacaacagaaacagaagcaagtgcatctgttttactgcgtggaatccgaagagcttgcccgtaatgttgccgctcactctgaactcatcacactccaatccatcaactggaggaatttcgatgatggatttcctaatctttttataaacaatgctgaaaatttgcgaggtcaacatgtcgccttccttgcatcttttagttctccaggagttatcttcgaacagctttccgtcatttatgcactgccgcgtctgtttgttgcctccttctcgttggtgttgcctttctttccaactggctcctttgaacgaatggaagaagaaggggatgttgcaactgcatttaccatggctaggatattatcgaatattcccatttcaagaggcggccccactagtttagtcatctatgacatacatgcactgcaggaaagattctattttggggaccatgttttgcctttatttgttactgggattcctctgttaaagcaacgtcttcaccaacttcctgaatctgataagattgttgttgcttttccggatgatggagcctggaagcggttccacaagctgttggatcattttcctatggtggtatgtgcgaaggttcgtgaaggtgataagaggatagttagaataaaggagggaaatcctgccggctgccatgtggttattgttgatgatttggtacaatctggaggcacccttattgagtgccagaaagtattggcagctcatggggcagcaaaagtcagtgcatatgtcacccacggggtgtttcctaagcgttcctgggagcgatttactcacaaagataatggcatggagaatgcatttgcttatttttggataacagattcctgccctcacactgtgaaagccatcacaaataagcctccatttgaagttttgagccttgctggatccattgctgatgctttacaaatatga

SEQ ID NO: 1443 - protein, 327 aa, Populus balsamifera subsp. trichocarpa
  misc_feature (1)..(327): Ceres ANNOT ID no. 1443033
  misc_feature (191)..(289): Pfam Name: Pribosyltran Pfam Description: Phosphoribosyl transferase domain
  misc_feature: SWISSPROT Homolog: KPRS4_ARATH Ribose-phosphate pyrophosphokinase 4 (EC 2.7.6.1) (Phosphoribosyl pyrophosphate synthetase 4) with e-value of 2.0e-180 and BLAST sequence identity of 100.0
  misc_feature: SWISSPROT Homolog: KPRS4_SPIOL Ribose-phosphate pyrophosphokinase 4 (EC 2.7.6.1) (Phosphoribosyl pyrophosphate synthetase 4) with e-value of 8.9e-146 and BLAST sequence identity of 86.2
  misc_feature: SWISSPROT Homolog: KPRS4_ORYSA Ribose-phosphate pyrophosphokinase 4 (EC 2.7.6.1) (Phosphoribosyl pyrophosphate synthetase 4) with e-value of 3.1e-136 and BLAST sequence identity of 81.2
  misc_feature: SWISSPROT Homolog: KPRS3_SPIOL Ribose-phosphate pyrophosphokinase 3, (EC 2.7.6.1) (Phosphoribosyl pyrophosphate synthetase 3) with e-value of 1.2e-125 and BLAST sequence identity of 74.8
  misc_feature: SWISSPROT Homolog: KPRS3_ARATH Ribose-phosphate pyrophosphokinase 3 (EC 2.7.6.1) (Phosphoribosyl pyrophosphate synthetase 3) with e-value of 4.2e-123 and BLAST sequence identity of 73.5
  misc_feature 156521:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature (1)..(327): Functional Homolog of  Ceres CLONE ID no. 35051 at SEQ ID NO. 1485 with e-value of 1.39E-148 and BLAST sequence identity of 86.6
MEVDKVETQQQQQKQKQVHLFYCVESEELARNVAAHSELITLQSINWRNFDDGFPNLFINNAENLRGQHVAFLASFSSPGVIFEQLSVIYALPRLFVASFSLVLPFFPTGSFERMEEEGDVATAFTMARILSNIPISRGGPTSLVIYDIHALQERFYFGDHVLPLFVTGIPLLKQRLHQLPESDKIVVAFPDDGAWKRFHKLLDHFPMVVCAKVREGDKRIVRIKEGNPAGCHVVIVDDLVQSGGTLIECQKVLAAHGAAKVSAYVTHGVFPKRSWERFTHKDNGMENAFAYFWITDSCPHTVKAITNKPPFEVLSLAGSIADALQI

SEQ ID NO: 1444 - DNA, 984 bp, Populus balsamifera subsp. trichocarpa
  misc_feature (1)..(984): Ceres ANNOT ID no. 1452408
  misc_feature 156645:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
atggaggtggacaaagtagagactcaaaaccagcaacagaaacacaagcaagtacatctgttttactgcttggaatccgaagagcttgcccgtaaagttgccggtcactctgacctcatcaccctgcaatccatcaactggaggaattttgatgatggatttcctaacctttttataaacaatgctgaagatttgcggggtcagcatgttgccttccttgcatgttttagttccccgggagttatcttcgaacagctatctgtcatttatgcgctgccacgtctgtttgctgcttctttcacattggtgttgcctttctttccaactggctccttcgagcgaatggaagaagaaggggatgttgcaactgcatttaccatggcaaggatattgtcaaacattcccatttcaagaggtggccccactagtctagtcatatatgacatacacgcactgcaggaaaggttctattttggggaccaagttttgcctttatttgtgactgggattcctctgttaaagcaacgtcttcaccaacttcctgaatccgataagattgctgttgcatttccagatgatggagcttggaagcgattccacaagctgttggatcattttcctatggtggtatgtgtgaaggttcgtgaaggtgatgagaggatagttagaataaaggagggaaatcctgctggttaccatgttgtcattgttgatgatttggtacaatctggaggcacacttgttgagtgccagaaagtattagcagctcacggtgcagcaaaagtaagtgcatatgtcacccacggtgtctttcctaagcgctcttgggagcgtttcactcacaaaaatgagggcatggaggatgcatttgcctatttttggataacagattcctgccctcacactgtgaaagccatagcaaataagcgtccatttgaagttttgagtcttgctggatccattgctgatgctttacaaatatga

SEQ ID NO: 1445 - protein, 327 aa, Populus balsamifera subsp. trichocarpa
  misc_feature (1)..(327): Ceres ANNOT ID no. 1452408
  misc_feature (161)..(289): Pfam Name: Pribosyltran Pfam Description: Phosphoribosyl transferase domain
  misc_feature: SWISSPROT Homolog: KPRS4_ARATH Ribose-phosphate pyrophosphokinase 4 (EC 2.7.6.1) (Phosphoribosyl pyrophosphate synthetase 4) with e-value of 2.0e-180 and BLAST sequence identity of 100.0
  misc_feature: SWISSPROT Homolog: KPRS4_SPIOL Ribose-phosphate pyrophosphokinase 4 (EC 2.7.6.1) (Phosphoribosyl pyrophosphate synthetase 4) with e-value of 8.9e-146 and BLAST sequence identity of 86.2
  misc_feature: SWISSPROT Homolog: KPRS4_ORYSA Ribose-phosphate pyrophosphokinase 4 (EC 2.7.6.1) (Phosphoribosyl pyrophosphate synthetase 4) with e-value of 3.1e-136 and BLAST sequence identity of 81.2
  misc_feature: SWISSPROT Homolog: KPRS3_SPIOL Ribose-phosphate pyrophosphokinase 3, (EC 2.7.6.1) (Phosphoribosyl pyrophosphate synthetase 3) with e-value of 1.2e-125 and BLAST sequence identity of 74.8
  misc_feature: SWISSPROT Homolog: KPRS3_ARATH Ribose-phosphate pyrophosphokinase 3 (EC 2.7.6.1) (Phosphoribosyl pyrophosphate synthetase 3) with e-value of 4.2e-123 and BLAST sequence identity of 73.5
  misc_feature 156778:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature (1)..(327): Functional Homolog of  Ceres CLONE ID no. 35051 at SEQ ID NO. 1485 with e-value of 1.40E-146 and BLAST sequence identity of 85.4
MEVDKVETQNQQQKHKQVHLFYCLESEELARKVAGHSDLITLQSINWRNFDDGFPNLFINNAEDLRGQHVAFLACFSSPGVIFEQLSVIYALPRLFAASFTLVLPFFPTGSFERMEEEGDVATAFTMARILSNIPISRGGPTSLVIYDIHALQERFYFGDQVLPLFVTGIPLLKQRLHQLPESDKIAVAFPDDGAWKRFHKLLDHFPMVVCVKVREGDERIVRIKEGNPAGYHVVIVDDLVQSGGTLVECQKVLAAHGAAKVSAYVTHGVFPKRSWERFTHKNEGMEDAFAYFWITDSCPHTVKAIANKRPFEVLSLAGSIADALQI

SEQ ID NO: 1446 - DNA, 969 bp, Populus balsamifera subsp. trichocarpa
  misc_feature (1)..(969): Ceres ANNOT ID no. 1505508
  misc_feature 156902:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
atggaggtggacaaagtagagactcaaaaccagcaacagaaacacaagcaagtacatctgttttactgcttggaatccgaagagcttgcccgtaaagttgccggtcactctgacctcatcaccctgcaatccatcaactggaggaattttgatgatggatttcctaacctttttataaacaatgctgaagatttgcggggtcagcatgttgccttccttgcatgttttagttccccgggagttatcttcgaacagctatctgtcatttatgcgctgccacgtctgtttgctgcttctttcacattggtgttgcctttctttccaactggctccttcgagcgaatggaagaagaaggggatgttgcaactgcatttaccatggcaaggatattgtcaaacattcccatttcaagaggtggccccactagtctagtcatatatgacatacacgcactgcaggaaaggttctattttggggaccaagttttgcctttatttgtgactgggattcctctgttaaagcaacgtcttcaccaacttcctgaatccgataagattgctgttgcatttccagatgatggagcttggaagcgattccacaagctgttggatcattttcctatggttcgtgaaggtgatgagaggatagttagaataaaggagggaaatcctgctggttaccatgttgtcattgttgatgatttggtacaatctggaggcacacttgttgagtgccagaaagtattagcagctcacggtgcagcaaaagtaagtgcatatgtcacccacggtgtctttcctaagcgctcttgggagcgtttcactcacaaaaatgagggcatggaggatgcatttgcctatttttggataacagattcctgccctcacactgtgaaagccatagcaaataagcgtccatttgaagttttgagtcttgctggatccattgctgatgctttacaaatatga

SEQ ID NO: 1447 - protein, 322 aa, Populus balsamifera subsp. trichocarpa
  misc_feature (1)..(322): Ceres ANNOT ID no. 1505508
  misc_feature (191)..(284): Pfam Name: Pribosyltran Pfam Description: Phosphoribosyl transferase domain
  misc_feature: SWISSPROT Homolog: KPRS4_ARATH Ribose-phosphate pyrophosphokinase 4 (EC 2.7.6.1) (Phosphoribosyl pyrophosphate synthetase 4) with e-value of 2.0e-180 and BLAST sequence identity of 100.0
  misc_feature: SWISSPROT Homolog: KPRS4_SPIOL Ribose-phosphate pyrophosphokinase 4 (EC 2.7.6.1) (Phosphoribosyl pyrophosphate synthetase 4) with e-value of 8.9e-146 and BLAST sequence identity of 86.2
  misc_feature: SWISSPROT Homolog: KPRS4_ORYSA Ribose-phosphate pyrophosphokinase 4 (EC 2.7.6.1) (Phosphoribosyl pyrophosphate synthetase 4) with e-value of 3.1e-136 and BLAST sequence identity of 81.2
  misc_feature: SWISSPROT Homolog: KPRS3_SPIOL Ribose-phosphate pyrophosphokinase 3, (EC 2.7.6.1) (Phosphoribosyl pyrophosphate synthetase 3) with e-value of 1.2e-125 and BLAST sequence identity of 74.8
  misc_feature: SWISSPROT Homolog: KPRS3_ARATH Ribose-phosphate pyrophosphokinase 3 (EC 2.7.6.1) (Phosphoribosyl pyrophosphate synthetase 3) with e-value of 4.2e-123 and BLAST sequence identity of 73.5
  misc_feature 157035:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature (1)..(322): Functional Homolog of  Ceres CLONE ID no. 35051 at SEQ ID NO. 1485 with e-value of 1.90E-142 and BLAST sequence identity of 85.5
MEVDKVETQNQQQKHKQVHLFYCLESEELARKVAGHSDLITLQSINWRNFDDGFPNLFINNAEDLRGQHVAFLACFSSPGVIFEQLSVIYALPRLFAASFTLVLPFFPTGSFERMEEEGDVATAFTMARILSNIPISRGGPTSLVIYDIHALQERFYFGDQVLPLFVTGIPLLKQRLHQLPESDKIAVAFPDDGAWKRFHKLLDHFPMVREGDERIVRIKEGNPAGYHVVIVDDLVQSGGTLVECQKVLAAHGAAKVSAYVTHGVFPKRSWERFTHKNEGMEDAFAYFWITDSCPHTVKAIANKRPFEVLSLAGSIADALQI

SEQ ID NO: 1448 - protein, 359 aa, Arabidopsis thaliana
  misc_feature (1)..(359): Ceres CLONE ID no. 35220
  misc_feature: Utility: PEG Useful for making plants with increased tolerance to drought
  misc_feature: Phenotype: WHOLE PLANT - PEG Useful for making plants with increased tolerance to drought
MKNGQCAQELQSSTQASHDSQGDQKTNLSIDAPIQDSGSVSASSNDSRKVSRQDIELVQNLIERCLQLYMNRDEVVKTLLTRARIDPGFTTLVWQKLEEENADFFRAYYIRLKLKKQIILFNHLLEHQYHLMKYPPGPPKVPLAPIQNGMHPMAPVNMPMGYPVLQHPQMHVPGHPHHLDAMGVSSCHVVNGVPAPANFHPLRMNTANDMVIDTTANDATPQVIPPNSGAMPEMVASPASVASSGHFPFAASDMSGMVMDTSVLDSAFTSDVGPDGEGAGNSRDSLRSFDQIPWNFSLSDLTADLSNLGDLGALGNYPGSPFLPSDSEIFLDSPEQEDIEEFFVDSVPGPRSNSDEEKP

SEQ ID NO: 1449 - DNA, 1089 bp, Populus balsamifera subsp. trichocarpa
  misc_feature (1)..(1089): Ceres ANNOT ID no. 1444404
  misc_feature: Utility: PEG Useful for making plants with increased tolerance to drought
  misc_feature 157262:<222: Transcription Factor
  misc_feature: Phenotype: WHOLE PLANT - PEG Useful for making plants with increased tolerance to drought
atgaagaccttacagagtgcacaagaacagtcctccacccaagtttcgcaggattcccaaagtgagcagcagaataatcacaatatagagccgccagtagcagactctggttcaaaatctgcctcaagcaatgatagcagaaaggtttcacgccaagatattgaacttgtccaaaatttaatagaacggtgcctacaactgtatatgaatagagatgaggttgttaaaaccctcttgactcgtgcaagaatagaccctgggtttacaacgctagtatggcagaagctggaagaagaaaatgctgatttcttcagggcctattacattaggctgaaattgaagaaacagatcctcttgtttaattatttacttgagcatcaatatcatctaatgaagtatccagtagctacgaaagttccgttggctcccatacaaaacgggattcaccccatgcctgttaacaatctaccaatgggataccctgtcctgcaacaaccccctatggctactcctggtcagcctcatcttgattcaatgggctgtggagtatcaagctgtcatgtggttaatggagtccctgcaccaggaaattttcatcccattcggatgaattctggaaatgatatggtgatggaaaacagtgcaactgacacaactcatgtagtgccgccaagcagtaccatttcatccctgtctgagatgcctgtgagccctacatcagtggcgtctagtggccattttccatttactgcatctgacatggcaggaatgggggtagacacagcattagacacaacatttacatctgatgtggcaagctcagtaggattgcagcttggacaagatggcggggctgggaattccaggtcattggatcagattcaatggaatttcagcctttctgatctaacggcagatttgtcaaacttgggagatttaggagctctaggaaactatcccggttccccctttctgccatctgattcagaaattttgcttgattctccagagaatgaggacatagttgaggagttttttgtcgactctgtcccagggccaccatcccagtcagatgaagagaggtcctag

SEQ ID NO: 1450 - protein, 362 aa, Populus balsamifera subsp. trichocarpa
  misc_feature (1)..(362): Ceres ANNOT ID no. 1444404
  misc_feature: Utility: PEG Useful for making plants with increased tolerance to drought
  misc_feature 157331:<222: Transcription Factor
  misc_feature: Phenotype: WHOLE PLANT - PEG Useful for making plants with increased tolerance to drought
  misc_feature (1)..(362): Functional Homolog of  Ceres CLONE ID no. 35220 at SEQ ID NO. 1492 with e-value of 2.89E-139 and BLAST sequence identity of 80.7
MKTLQSAQEQSSTQVSQDSQSEQQNNHNIEPPVADSGSKSASSNDSRKVSRQDIELVQNLIERCLQLYMNRDEVVKTLLTRARIDPGFTTLVWQKLEEENADFFRAYYIRLKLKKQILLFNYLLEHQYHLMKYPVATKVPLAPIQNGIHPMPVNNLPMGYPVLQQPPMATPGQPHLDSMGCGVSSCHVVNGVPAPGNFHPIRMNSGNDMVMENSATDTTHVVPPSSTISSLSEMPVSPTSVASSGHFPFTASDMAGMGVDTALDTTFTSDVASSVGLQLGQDGGAGNSRSLDQIQWNFSLSDLTADLSNLGDLGALGNYPGSPFLPSDSEILLDSPENEDIVEEFFVDSVPGPPSQSDEERS

SEQ ID NO: 1451 - DNA, 1089 bp, Populus balsamifera subsp. trichocarpa
  misc_feature (1)..(1089): Ceres ANNOT ID no. 1471304
  misc_feature: Utility: PEG Useful for making plants with increased tolerance to drought
  misc_feature 157439:<222: Transcription Factor
  misc_feature: Phenotype: WHOLE PLANT - PEG Useful for making plants with increased tolerance to drought
atgaagaccttacagagtgcacaagaacagtccacccaaatttcacaggattcccaaagcgagcaacagaataatcacaaaacagaggctccagtagcggactctagttcaatatctgcatcaagcaatgatagcagaaaggtttcacgccaagatattgaacttgtccaaaatttaatagaacgctgcctacaattgtatatgaatagagacgaggttgttaaaaccctcttgacccgtgctaggatagaccctgggtttacgacacttgtatggcagaagttggaagaagaaaatgctgatttctttagggcctattacattaggctgaaattgaagaaacagattctcttgtttaatcatttgcttgagcgtcaatatcatctcatgaagtatcctgtaccttcgaaagttcctttggctccaatacaaaacggggttcatcccatgcccgttaacaatttaccgatgggataccctgtcctgcaacaaccccaaatgccagctccaggtcaacctcatcttgactcaatgagctgtggaatatcaagctgtcatgttgttaatggaatccctgcgccaggaaattttcatcccattcggatgaattctggaaatgatatggtgatgggaaatagtgcagctgatacagctcctgtagtgccaccaagcagtgccatttcatccatgtctgagatgcctctgagccctacgtcagtgacatctaatggtcattttccatttaatgcatctgacatgtcaggaatgggggtagacacctcagcactatatacagcatttgcatctgatgcggcaagctctgtaggattgcagcttggaccagatggtggggctggaaattccagatcattggaacagattcaatggactttcagcctttcagacctaacagcagatctgtcgaacttgggagatttaggagctctaggaaactatcctggttccccctttctgccttctgattctgagatcttgcttgattctccagagaacgaggacatagtggaggagttttttgttgattccgtcccagggccaccataccagtcagatgaagagaagtcctag

SEQ ID NO: 1452 - protein, 362 aa, Populus balsamifera subsp. trichocarpa
  misc_feature (1)..(362): Ceres ANNOT ID no. 1471304
  misc_feature: Utility: PEG Useful for making plants with increased tolerance to drought
  misc_feature 157508:<222: Transcription Factor
  misc_feature: Phenotype: WHOLE PLANT - PEG Useful for making plants with increased tolerance to drought
  misc_feature (1)..(362): Functional Homolog of  Ceres CLONE ID no. 35220 at SEQ ID NO. 1492 with e-value of 2.30E-137 and BLAST sequence identity of 79.3
MKTLQSAQEQSTQISQDSQSEQQNNHKTEAPVADSSSISASSNDSRKVSRQDIELVQNLIERCLQLYMNRDEVVKTLLTRARIDPGFTTLVWQKLEEENADFFRAYYIRLKLKKQILLFNHLLERQYHLMKYPVPSKVPLAPIQNGVHPMPVNNLPMGYPVLQQPQMPAPGQPHLDSMSCGISSCHVVNGIPAPGNFHPIRMNSGNDMVMGNSAADTAPVVPPSSAISSMSEMPLSPTSVTSNGHFPFNASDMSGMGVDTSALYTAFASDAASSVGLQLGPDGGAGNSRSLEQIQWTFSLSDLTADLSNLGDLGALGNYPGSPFLPSDSEILLDSPENEDIVEEFFVDSVPGPPYQSDEEKS

SEQ ID NO: 1453 - DNA, 1050 bp, Populus balsamifera subsp. trichocarpa
  misc_feature (1)..(1050): Ceres ANNOT ID no. 1497357
  misc_feature: Utility: PEG Useful for making plants with increased tolerance to drought
  misc_feature 157616:<222: Transcription Factor
  misc_feature: Phenotype: WHOLE PLANT - PEG Useful for making plants with increased tolerance to drought
atgaagaccttacagagtgcacaagaacagtcctccacccaagtttcgcaggattcccaaagtgagcagcagaataatcacaatatagagccgccagtagcagactctggttcaaaatctgcctcaagcaatgatagcagaaaggtttcacgccaagatattgaacttgtccaaaatttaatagaacggtgcctacaactgtatatgaatagagatgaggttgttaaaaccctcttgactcgtgcaagaatagaccctgggtttacaacgctagtatggcagaagctggaagaagaaaatgctgatttcttcagggcctattacattaggctgaaattgaagaaacagatcctcttgtttaattatttacttgagcatcaatatcatctaatgaagtatccagtagctacgaaagttccgttggctcccatacaaaacgggattcaccccatgcctgttaacaatctaccaatgggataccctgtcctgcaacaaccccctatggctactcctggtcagcctcatcttgattcaatgggctgtggagtatcaagctgtcatgtggttaatggagtccctgcaccaggaaattttcatcccattcggatgaattctggaaatgatatggtgatggaaaacagtgcaactgacacaactcatgtagtgccgccaagcagtaccatttcatccctgtctgagatgcctgtgagccctacatcagtggcgtctagtggccattttccatttactgcatctgacatggcaggaatgggggtagacacagcattagacacaacatttacatctgatgtggcaagctcagtaggattgcagcttggacaagatggcggggctgggaattccaggtcattggatcagattcaatggaatttcagcctttctgatctaacggcagatttgtcaaacttgggagatttaggagctctaggaaactatcccggttccccctttctgccatctgattcagaaattttgcttgattctccagagaatgaggacatagggttggtaatcttcaagctaaaatag

SEQ ID NO: 1454 - protein, 349 aa, Populus balsamifera subsp. trichocarpa
  misc_feature (1)..(349): Ceres ANNOT ID no. 1497357
  misc_feature: Utility: PEG Useful for making plants with increased tolerance to drought
  misc_feature 157683:<222: Transcription Factor
  misc_feature: Phenotype: WHOLE PLANT - PEG Useful for making plants with increased tolerance to drought
  misc_feature (1)..(349): Functional Homolog of  Ceres CLONE ID no. 35220 at SEQ ID NO. 1492 with e-value of 2.49E-131 and BLAST sequence identity of 80.5
MKTLQSAQEQSSTQVSQDSQSEQQNNHNIEPPVADSGSKSASSNDSRKVSRQDIELVQNLIERCLQLYMNRDEVVKTLLTRARIDPGFTTLVWQKLEEENADFFRAYYIRLKLKKQILLFNYLLEHQYHLMKYPVATKVPLAPIQNGIHPMPVNNLPMGYPVLQQPPMATPGQPHLDSMGCGVSSCHVVNGVPAPGNFHPIRMNSGNDMVMENSATDTTHVVPPSSTISSLSEMPVSPTSVASSGHFPFTASDMAGMGVDTALDTTFTSDVASSVGLQLGQDGGAGNSRSLDQIQWNFSLSDLTADLSNLGDLGALGNYPGSPFLPSDSEILLDSPENEDIGLVIFKLK

SEQ ID NO: 1455 - protein, 281 aa, Arabidopsis thaliana
  misc_feature (1)..(281): Ceres CLONE ID no. 35228
  misc_feature (1)..(281): Also Known As Ceres CDNA ID no. 23384591
  misc_feature (1)..(281): Also Known As Ceres GEMINI ID 554D7
  misc_feature (95)..(165): Pfam Name: RRM_1 Pfam Description: RNA recognition motif. (a.k.a. RRM RBD, or RNP domain)
  misc_feature 157803:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
MSGALNMTLDEIVKRGKTARSGGRGISRGRGRGRGGGGRGAGPARRGPLAVNARPSSFTINKPVRRVRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGRGGRGPAPTVSRRLPIHNQQGGGMRGGRGGFRARGRGNGGRGRGGGRGNGKKPVEKSAADLDKDLESYHADAMNTS

SEQ ID NO: 1456 - DNA, 1035 bp, Populus balsamifera subsp. trichocarpa
  misc_feature (1)..(1035): Ceres ANNOT ID no. 1445433
  misc_feature 157897:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atggctgcaactgtggatatgtctcttgatgacattataaagaaaaacagggagagaggtagaggacgaggtagggccagccgtggacgtggccgtggacgtggacctgttaggtcctttaataatggaaggatgtcaggggctgttcgtagaggccctctctcagtgaatacttggccatcaaaatactccattgctaaggcaagctcaaaactgtggatgcttttgacttgtttagacggaaagattatgatggatcctcctgttatgtgcggaatttcttcggtgcaagaactcatctctcctagttcatggtgtttttgcaaaggagttccttcgcttaacttcagaactggagctcccacctatatcatagcactgccttctcgcagagtcaggagtttgccttggcagcatgatctgcttgaggatagcattagagctgcaggaataacaggagtagaagttggaaccaagttatatgtttcaaacttggattatggggtgaccaacgaagacataagggagctcttcgcagaggttggagatctgaaacgatatgctgttcactatgacaaagatggtcgctctagtggctcagctgaagttatgtatacaagaagaagcgatgcatttgctgctcttaagaagtataacaatgttctgttagatggaaagcccatgaagattgagattgtgggtcccaatccagtggtgcctatttcagctcgaatgaatgttactggagcaaatggaaagaagaagagaactgttgttacgacacctggactaggtggtggaagaggtgctggcgcaaataatcgtggttctggtcagagtcgtcgtggaggtggggatctaaggaatggtacgaggaatggccgtggtcaagctcctggccgtggtcgtgctcctggacgtggtcaggctcctggccgaggacgtggccgtgggaagaagcaacctgttgaaaagtcagtagatgagctggacaaggaattggaaagttaccatgctgaagccatgcaaacttaa

SEQ ID NO: 1457 - protein, 300 aa, Populus balsamifera subsp. trichocarpa
  misc_feature (1)..(300): Ceres ANNOT ID no. 1445433
  misc_feature (116)..(186): Pfam Name: RRM_1 Pfam Description: RNA recognition motif. (a.k.a. RRM RBD, or RNP domain)
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 3.4e-34 and BLAST sequence identity of 41.2
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.9e-33 and BLAST sequence identity of 40.1
  misc_feature: SWISSPROT Homolog: REFP2_MOUSE RNA and export factor-binding protein 2 with e-value of 2.7e-25 and BLAST sequence identity of 38.6
  misc_feature: SWISSPROT Homolog: MLO3_SCHPO Protein mlo3 with e-value of 7.5e-11 and BLAST sequence identity of 32.3
  misc_feature: SWISSPROT Homolog: ACN2_ACAGO Acanthoscurrin-2 precursor (Fragment) with e-value of 2.1e-09 and BLAST sequence identity of 39.3
  misc_feature 158018:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(300): Functional Homolog of  Ceres CLONE ID no. 35228 at SEQ ID NO. 1499 with e-value of 2.40E-68 and BLAST sequence identity of 62.1
MSGAVRRGPLSVNTWPSKYSIAKASSKLWMLLTCLDGKIMMDPPVMCGISSVQELISPSSWCFCKGVPSLNFRTGAPTYIIALPSRRVRSLPWQHDLLEDSIRAAGITGVEVGTKLYVSNLDYGVTNEDIRELFAEVGDLKRYAVHYDKDGRSSGSAEVMYTRRSDAFAALKKYNNVLLDGKPMKIEIVGPNPVVPISARMNVTGANGKKKRTVVTTPGLGGGRGAGANNRGSGQSRRGGGDLRNGTRNGRGQAPGRGRAPGRGQAPGRGRGRGKKQPVEKSVDELDKELESYHAEAMQT

SEQ ID NO: 1458 - DNA, 984 bp, Populus balsamifera subsp. trichocarpa
  misc_feature (1)..(984): Ceres ANNOT ID no. 1498413
  misc_feature 158123:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atggctgcaactgtggatatgtctcttgatgacattataaagaaaaacagggagagaggtagaggacgaggtagggccagccgtggacgtggccgtggacgtggacctgttaggtcctttaataatggaaggatgtcaggggctgttcgtagaggccctctctcagtgaatacttggccatcaaaatactccattgctaaggcaagctcaaaactgtggatgcttttgacttgtttagacggaaagattatgatggatcctcctgttatgtgcggaatttcttcggtgcaagaactcatctctcctagttcatggtgtttttgcaaaggagttccttcgcttaacttcagaactggagctcccacctatatcatagcactgccttctcgcagagtcaggagtttgccttggcagcatgatctgcttgaggatagcattagagctgcaggaataacaggagtagaagttggaaccaagttatatgtttcaaacttggattatggggtgaccaacgaagacataagggagctcttcgcagaggttggagatctgaaacgatatgctgttcactatgacaaagatggtcgctctagtggctcagctgaagttatgtatacaagaagaagcgatgcatttgctgctcttaagaagtataacaatgttctgttagatggaaagcccatgaagattgagattgtgggtcccaatccagtggtgcctatttcagctcgaatgaatgttactggagcaaatggaaagaagaagagaactgttgttacgactcagagtcgtcgtggaggtggggatctaaggaatggtacgaggaatggccgtggtcaagctcctggccgtggtcgtgctcctggacgtggtcaggctcctggccgaggacgtggccgtgggaagaagcaacctgttgaaaagtcagtagatgagctggacaaggaattggaaagttaccatgctgaagccatgcaaacttaa

SEQ ID NO: 1459 - protein, 283 aa, Populus balsamifera subsp. trichocarpa
  misc_feature (1)..(283): Ceres ANNOT ID no. 1498413
  misc_feature (116)..(186): Pfam Name: RRM_1 Pfam Description: RNA recognition motif. (a.k.a. RRM RBD, or RNP domain)
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 3.4e-34 and BLAST sequence identity of 41.2
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.9e-33 and BLAST sequence identity of 40.1
  misc_feature: SWISSPROT Homolog: REFP2_MOUSE RNA and export factor-binding protein 2 with e-value of 2.7e-25 and BLAST sequence identity of 38.6
  misc_feature: SWISSPROT Homolog: MLO3_SCHPO Protein mlo3 with e-value of 7.5e-11 and BLAST sequence identity of 32.3
  misc_feature: SWISSPROT Homolog: ACN2_ACAGO Acanthoscurrin-2 precursor (Fragment) with e-value of 2.1e-09 and BLAST sequence identity of 39.3
  misc_feature 158242:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(283): Functional Homolog of  Ceres CLONE ID no. 35228 at SEQ ID NO. 1499 with e-value of 2.09E-65 and BLAST sequence identity of 63.5
MSGAVRRGPLSVNTWPSKYSIAKASSKLWMLLTCLDGKIMMDPPVMCGISSVQELISPSSWCFCKGVPSLNFRTGAPTYIIALPSRRVRSLPWQHDLLEDSIRAAGITGVEVGTKLYVSNLDYGVTNEDIRELFAEVGDLKRYAVHYDKDGRSSGSAEVMYTRRSDAFAALKKYNNVLLDGKPMKIEIVGPNPVVPISARMNVTGANGKKKRTVVTTQSRRGGGDLRNGTRNGRGQAPGRGRAPGRGQAPGRGRGRGKKQPVEKSVDELDKELESYHAEAMQT

SEQ ID NO: 1460 - protein, 412 aa, Arabidopsis thaliana
  misc_feature (1)..(412): Ceres CLONE ID no. 35493
  misc_feature (111)..(323): Pfam Name: GHMP_kinases Pfam Description: GHMP kinases putative ATP-binding protein
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
MAEEKWVVMVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 1461 - DNA, 1206 bp, Populus balsamifera subsp. trichocarpa
  misc_feature (1)..(1206): Ceres ANNOT ID no. 1457751
  misc_feature 158485:<222: Transcription Factor
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggcagagaaaacatgggtgaggatggtgactgcacagacaccaacgaatatagctgtgataaagtactggggcaagcgagatgagaccttgattttgcctgttaatgatagcataagtgtcactcttgatccggctcatctttgcaccaccacaactgttgctgtgagtcctagttttgaccaggatcggatgtggctcaatggaaaggagatttccctttctggaggcaggtaccaaaattgtttaagggaaattcgtgcccgagcttgtgcagttgaggataaggagaagggtatcaagattgcaaagaaggattgggagaaactgcacttgcatgttgcttcatataacaatttccctactgccgctggactggcttcctctgcagctggctttgcttgtcttgtttttgcccttgcaaagctgatgaatgcaaaagaagataatagtgagctttctgctattgcaaggcaaggttctggcagtgcctgccgcagtttatttggaggatttgtgaagtggatcatgggaaaagctgaggatggaagtgatagtctagctgttcaacttgtagatgaaaagcactgggatgaacttgttattattattgctgtggtaagttcgcgacagaaagaaacaagtagcaccacaggaatgcgggatagtgttgaaactagcttgcttttgcaacacagggctaaggaagttgtgccaaaacgcattaaacaaatggaagaagccataaagaatcgtgattttggatcttttgcacaattaagctgtgcagatagcaatcagttccatgcagtctgtttggatacatgccccccaatattctacatgaacgatacatctcacaggcaagtggcttatacctttgatgctgggccaaatgcagttctaattgcacataatagaaaggctgctacccagttaatgcagaaactgcttttctgcttccctccaagttccgatgctgatttgaacagttatgttataggtgacaagtctatactaaaagatgctgggattgaagatattaaggatgtggaagctttgccaccacctccagaaattaaggatgcccagagatgcaaaggagatgttagttatttcatttgtacgaaacctggtagaggtcctgctttgctctccgatgaaagccaggcccttctccatcccgaaactgggctgcctaaatga

SEQ ID NO: 1462 - protein, 401 aa, Populus balsamifera subsp. trichocarpa
  misc_feature (1)..(401): Ceres ANNOT ID no. 1457751
  misc_feature (111)..(308): Pfam Name: GHMP_kinases Pfam Description: GHMP kinases putative ATP-binding protein
  misc_feature: SWISSPROT Homolog: ERG19_HUMAN Diphosphomevalonate decarboxylase with e-value of 3.6e-94 and BLAST sequence identity of 49.3
  misc_feature: SWISSPROT Homolog: ERG19_HUMAN EC 4.1.1.33 Mevalonate pyrophosphate decarboxylase Mevalonate (diphospho)decarboxylase
  misc_feature: SWISSPROT Homolog: ERG19_MOUSE Diphosphomevalonate decarboxylase with e-value of 3.2e-93 and BLAST sequence identity of 50.4
  misc_feature: SWISSPROT Homolog: ERG19_MOUSE EC 4.1.1.33 (Mevalonate pyrophosphate decarboxylase) Mevalonate (diphospho)decarboxylase
  misc_feature: SWISSPROT Homolog: ERG19_RAT Diphosphomevalonate decarboxylase with e-value of 5.3e-93 and BLAST sequence identity of 49.4
  misc_feature: SWISSPROT Homolog: ERG19_RAT EC 4.1.1.33 (Mevalonate pyrophosphate decarboxylase) Mevalonate (diphospho)decarboxylase
  misc_feature: SWISSPROT Homolog: ERG19_YEAST Diphosphomevalonate decarboxylase with e-value of 3.7e-85 and BLAST sequence identity of 46.5
  misc_feature: SWISSPROT Homolog: ERG19_YEAST EC 4.1.1.33 Mevalonate pyrophosphate decarboxylase Mevalonate-5-diphosphate decarboxylase (MDD)
  misc_feature 158655:<222: Transcription Factor
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(401): Functional Homolog of  Ceres CLONE ID no. 35493 at SEQ ID NO. 1504 with e-value of 7.00E-168 and BLAST sequence identity of 81.7
MAEKTWVRMVTAQTPTNIAVIKYWGKRDETLILPVNDSISVTLDPAHLCTTTTVAVSPSFDQDRMWLNGKEISLSGGRYQNCLREIRARACAVEDKEKGIKIAKKDWEKLHLHVASYNNFPTAAGLASSAAGFACLVFALAKLMNAKEDNSELSAIARQGSGSACRSLFGGFVKWIMGKAEDGSDSLAVQLVDEKHWDELVIIIAVVSSRQKETSSTTGMRDSVETSLLLQHRAKEVVPKRIKQMEEAIKNRDFGSFAQLSCADSNQFHAVCLDTCPPIFYMNDTSHRQVAYTFDAGPNAVLIAHNRKAATQLMQKLLFCFPPSSDADLNSYVIGDKSILKDAGIEDIKDVEALPPPPEIKDAQRCKGDVSYFICTKPGRGPALLSDESQALLHPETGLPK

SEQ ID NO: 1463 - DNA, 1206 bp, Populus balsamifera subsp. trichocarpa
  misc_feature (1)..(1206): Ceres ANNOT ID no. 1518757
  misc_feature 158801:<222: Transcription Factor
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggcagggaaaccatgggtgaggatggtgactgcacagacaccaacaaatatagctgtgataaagtactggggcaagagagatgagaccttgattttgcctgttaatgatagcataagtgtcactcttgatccggctcatctttgtacaaccacaactgttgctgttagtcctagttttgaccaggatcggatgtggctcaatggaaaggagatttccctttctggaggcaggtaccaaaattgtttaagggaaattcgtgcccaggcttgtgatgctgaggatgaagagaagggtatcaagattacaaagaaggattgggagaaattgcatgtgcatgttgcatcatacaacaatttccctactgctgctggactggcttcctctgcagctggctttgcttgtcttgtttttgcccttgcaaagctgatgaatgcaaaagaagacaatagtgaactttctgctattgcaaggcaaggttctggcagtgcctgtcgcagtttatttggtggatttgtgaagtggatcatgggaaaagctgaggatggaagtgatagccttgctgttcaacttgtagacgaaaagcactgggatgaacttgttattattatcgctgtggtaagttcacggcagaaagaaacaagtagcaccacaggaatgcgggacagtgttgaaactagcttgcttttgcaacacagagctaaggaagttgtaccgaaacgcattaaacaaatggaagaagccataaagaatcgtgattttggatcttttgcacaattaacctgtgcagatagcaatcagttccatgcagtctgcttggatacatgtcccccaatattctacatgaatgatacatctcacaggcaagtagcttatacgtttgatgctgggcccaatgcagttctgattgcacataatagaaaggctgctacccagttattgcagaagctgcttttttacttccctccaagttccgatgctgatttgaacagttatgttataggtgataagtccatactaaaagatgctgggattgaagatatgaaggatgtggaagctttgtcaccacctccagaaattaagaatgcccagagaagcaaaggagatgtcagttatttcatctgtacgaaacctggtagaggtcctgttttgctctctgatgaaagccaggctcttctccatcctgaaactgggctgcccaaatga

SEQ ID NO: 1464 - protein, 401 aa, Populus balsamifera subsp. trichocarpa
  misc_feature (1)..(401): Ceres ANNOT ID no. 1518757
  misc_feature (111)..(308): Pfam Name: GHMP_kinases Pfam Description: GHMP kinases putative ATP-binding protein
  misc_feature: SWISSPROT Homolog: ERG19_HUMAN Diphosphomevalonate decarboxylase with e-value of 3.6e-94 and BLAST sequence identity of 49.3
  misc_feature: SWISSPROT Homolog: ERG19_HUMAN EC 4.1.1.33 Mevalonate pyrophosphate decarboxylase Mevalonate (diphospho)decarboxylase
  misc_feature: SWISSPROT Homolog: ERG19_MOUSE Diphosphomevalonate decarboxylase with e-value of 3.2e-93 and BLAST sequence identity of 50.4
  misc_feature: SWISSPROT Homolog: ERG19_MOUSE EC 4.1.1.33 (Mevalonate pyrophosphate decarboxylase) Mevalonate (diphospho)decarboxylase
  misc_feature: SWISSPROT Homolog: ERG19_RAT Diphosphomevalonate decarboxylase with e-value of 5.3e-93 and BLAST sequence identity of 49.4
  misc_feature: SWISSPROT Homolog: ERG19_RAT EC 4.1.1.33 (Mevalonate pyrophosphate decarboxylase) Mevalonate (diphospho)decarboxylase
  misc_feature: SWISSPROT Homolog: ERG19_YEAST Diphosphomevalonate decarboxylase with e-value of 3.7e-85 and BLAST sequence identity of 46.5
  misc_feature: SWISSPROT Homolog: ERG19_YEAST EC 4.1.1.33 Mevalonate pyrophosphate decarboxylase Mevalonate-5-diphosphate decarboxylase (MDD)
  misc_feature 158971:<222: Transcription Factor
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(401): Functional Homolog of  Ceres CLONE ID no. 35493 at SEQ ID NO. 1504 with e-value of 1.19E-165 and BLAST sequence identity of 80.7
MAGKPWVRMVTAQTPTNIAVIKYWGKRDETLILPVNDSISVTLDPAHLCTTTTVAVSPSFDQDRMWLNGKEISLSGGRYQNCLREIRAQACDAEDEEKGIKITKKDWEKLHVHVASYNNFPTAAGLASSAAGFACLVFALAKLMNAKEDNSELSAIARQGSGSACRSLFGGFVKWIMGKAEDGSDSLAVQLVDEKHWDELVIIIAVVSSRQKETSSTTGMRDSVETSLLLQHRAKEVVPKRIKQMEEAIKNRDFGSFAQLTCADSNQFHAVCLDTCPPIFYMNDTSHRQVAYTFDAGPNAVLIAHNRKAATQLLQKLLFYFPPSSDADLNSYVIGDKSILKDAGIEDMKDVEALSPPPEIKNAQRSKGDVSYFICTKPGRGPVLLSDESQALLHPETGLPK

SEQ ID NO: 1465 - DNA, 1242 bp, Populus balsamifera subsp. trichocarpa
  misc_feature (1)..(1242): Ceres ANNOT ID no. 1465420
  misc_feature 159117:<222: Transcription Factor
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggcagggaaaccatgggtgaggatggtgactgcacagacaccaacaaatatagctgtgataaagtactggggcaagagagatgagaccttgattttgcctgttaatgatagcataagtgtcactcttgatccggctcatctttgtacaaccacaactgttgctgttagtcctagttttgaccaggatcggatgtggctcaatggaaaggagatttccctttctggaggcaggtaccaaaattgtttaagggaaattcgtgcccaggcttgtgatgctgaggatgaagagaagggtatcaagattacaaagaaggattgggagaaattgcatgtgcatgttgcatcatacaacaatttccctactgctgctggactggcttcctctgcagctggctttgcttgtcttgaatcctctagtctagctttatcatggatggagcttgtttttgcccttgcaaagctgatgaatgcaaaagaagacaatagtgaactttctgctattgcaaggcaaggttctggcagtgcctgtcgcagtttatttggtggatttgtgaagtggatcatgggaaaagctgaggatggaagtgatagccttgctgttcaacttgtagacgaaaagcactgggatgaacttgttattattatcgctgtggtaagttcacggcagaaagaaacaagtagcaccacaggaatgcgggacagtgttgaaactagcttgcttttgcaacacagagctaaggaagttgtaccgaaacgcattaaacaaatggaagaagccataaagaatcgtgattttggatcttttgcacaattaacctgtgcagatagcaatcagttccatgcagtctgcttggatacatgtcccccaatattctacatgaatgatacatctcacaggcaagtagcttatacgtttgatgctgggcccaatgcagttctgattgcacataatagaaaggctgctacccagttattgcagaagctgcttttttacttccctccaagttccgatgctgatttgaacagttatgttataggtgataagtccatactaaaagatgctgggattgaagatatgaaggatgtggaagctttgtcaccacctccagaaattaagaatgcccagagaagcaaaggagatgtcagttatttcatctgtacgaaacctggtagaggtcctgttttgctctctgatgaaagccaggctcttctccatcctgaaactgggctgcccaaatga

SEQ ID NO: 1466 - protein, 413 aa, Populus balsamifera subsp. trichocarpa
  misc_feature (1)..(413): Ceres ANNOT ID no. 1465420
  misc_feature (111)..(136): Pfam Name: GHMP_kinases Pfam Description: GHMP kinases putative ATP-binding protein
  misc_feature: SWISSPROT Homolog: ERG19_HUMAN Diphosphomevalonate decarboxylase with e-value of 3.6e-94 and BLAST sequence identity of 49.3
  misc_feature: SWISSPROT Homolog: ERG19_HUMAN EC 4.1.1.33 Mevalonate pyrophosphate decarboxylase Mevalonate (diphospho)decarboxylase
  misc_feature: SWISSPROT Homolog: ERG19_MOUSE Diphosphomevalonate decarboxylase with e-value of 3.2e-93 and BLAST sequence identity of 50.4
  misc_feature: SWISSPROT Homolog: ERG19_MOUSE EC 4.1.1.33 (Mevalonate pyrophosphate decarboxylase) Mevalonate (diphospho)decarboxylase
  misc_feature: SWISSPROT Homolog: ERG19_RAT Diphosphomevalonate decarboxylase with e-value of 5.3e-93 and BLAST sequence identity of 49.4
  misc_feature: SWISSPROT Homolog: ERG19_RAT EC 4.1.1.33 (Mevalonate pyrophosphate decarboxylase) Mevalonate (diphospho)decarboxylase
  misc_feature: SWISSPROT Homolog: ERG19_YEAST Diphosphomevalonate decarboxylase with e-value of 3.7e-85 and BLAST sequence identity of 46.5
  misc_feature: SWISSPROT Homolog: ERG19_YEAST EC 4.1.1.33 Mevalonate pyrophosphate decarboxylase Mevalonate-5-diphosphate decarboxylase (MDD)
  misc_feature 159287:<222: Transcription Factor
  misc_feature: Phenotype: WHOLE PLANT - Dark Green Useful for increasing chlorophyll and photosynthetic capacity
  misc_feature: Phenotype: SILIQUES - Bent Useful for modifying fruit shape, composition and seed yield
  misc_feature: Phenotype: INFLORESCENCE - Short Useful for modulating plant height
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(413): Functional Homolog of  Ceres CLONE ID no. 35493 at SEQ ID NO. 1504 with e-value of 2.30E-162 and BLAST sequence identity of 80.7
MAGKPWVRMVTAQTPTNIAVIKYWGKRDETLILPVNDSISVTLDPAHLCTTTTVAVSPSFDQDRMWLNGKEISLSGGRYQNCLREIRAQACDAEDEEKGIKITKKDWEKLHVHVASYNNFPTAAGLASSAAGFACLESSSLALSWMELVFALAKLMNAKEDNSELSAIARQGSGSACRSLFGGFVKWIMGKAEDGSDSLAVQLVDEKHWDELVIIIAVVSSRQKETSSTTGMRDSVETSLLLQHRAKEVVPKRIKQMEEAIKNRDFGSFAQLTCADSNQFHAVCLDTCPPIFYMNDTSHRQVAYTFDAGPNAVLIAHNRKAATQLLQKLLFYFPPSSDADLNSYVIGDKSILKDAGIEDMKDVEALSPPPEIKNAQRSKGDVSYFICTKPGRGPVLLSDESQALLHPETGLPK

SEQ ID NO: 1467 - protein, 300 aa, Arabidopsis thaliana
  misc_feature (1)..(300): Ceres CLONE ID no. 35594
  misc_feature (1)..(300): Also Known As Ceres CDNA ID no. 23376150
  misc_feature (1)..(300): Also Known As Ceres GEMINI ID 534B11
  misc_feature (123)..(185): Pfam Name: Linker_histone Pfam Description: linker histone H1 and H5 family
  misc_feature (5)..(57): Pfam Name: Myb_DNA-binding Pfam Description: Myb-like DNA-binding domain
  misc_feature 159459:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVGATSGLQVSSNPPPRRPNVRLDSLIMEAIATLKEPGGCNKTTIGAYIEDQYHAPPDFKRLLSTKLKYLTSCGKLVKVKRKYRIPNSTSLSSHRRKGLGVFGGKQRTSSLPSPKTDIDEVNFQTRSQIDTEIARMKSMNVHEAAAVAAQAVAEAEAAMAEAEEAAKEAEAAEAEAEVAQAFAEEASKTLKGRNICKMMIRA

SEQ ID NO: 1468 - DNA, 951 bp, Populus balsamifera subsp. trichocarpa
  misc_feature (1)..(951): Ceres ANNOT ID no. 1514436
  misc_feature 159542:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgggtgcacccaaacagaaatggacggcagaagaagaagcagcgctaaaagctggagtgattaagcatggagctggaaaatggcgcacgatacttaaagatccggaatttagtggtgtcttgtatctgcgttcgaatgtggaccttaaggacaaatggagaaacatgagtgtaatggtaaatgggtatggctcgagagagaagcctaagttagcacctaaaagggtgcaccatgtccatagacaggatgagaaccttatgtctgttggcactgttcaaagcgatgaagatattccagatgccaaggctcttccagttagcagtgctgcattgccggttgttaatccgaagagaactactgtaaggctggataatcttataatggaggcaataactagcttgaaggagcctggaggttcacataagaccgcaattgcttcatacatagaggaacaatattggccaccaaatgactttaagaggatattatcagctaaattgaagtatctggcagcaaatggtaaactgattaaggttaaacggaagtatagaattgcacctacttcagcatttgctgagagaagggtttctcccttattctttgaaggaagacagaggatctctcccaaaattgaaagggatgatttcaatatacttacaatgtctcagattgatttggatctggggaagatgaggactatgaccgcagaacaggctgctgaggtagcggctcgagcggttgcggaggcagaagctgctatagcagtagctgaagaggcggcaagggaggcggagacagcagaagctgatgcagaggcagcacaagcatttgcggaagcagctatgaagacactgaaaggaaggaccgcccctaaggtgcttggatctattctgggagtccatcagggatgtgattcttcatttgcatctcttgcttcactgcatctttag

SEQ ID NO: 1469 - protein, 316 aa, Populus balsamifera subsp. trichocarpa
  misc_feature (1)..(316): Ceres ANNOT ID no. 1514436
  misc_feature (125)..(187): Pfam Name: Linker_histone Pfam Description: linker histone H1 and H5 family
  misc_feature (5)..(57): Pfam Name: Myb_DNA-binding Pfam Description: Myb-like DNA-binding domain
  misc_feature: SWISSPROT Homolog: H1_WHEAT Histone H1 with e-value of 1.2e-12 and BLAST sequence identity of 31.2
  misc_feature: SWISSPROT Homolog: H11_ARATH Histone H1.1 with e-value of 1.6e-10 and BLAST sequence identity of 28.2
  misc_feature: SWISSPROT Homolog: H12_ARATH Histone H1.2 with e-value of 2.7e-09 and BLAST sequence identity of 27.5
  misc_feature: SWISSPROT Homolog: H1_MAIZE Histone H1 with e-value of 8.5e-08 and BLAST sequence identity of 29.5
  misc_feature: SWISSPROT Homolog: H1_LYCES Histone H1 with e-value of 1.5e-07 and BLAST sequence identity of 30.1
  misc_feature 159647:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(316): Functional Homolog of  Ceres CLONE ID no. 35594 at SEQ ID NO. 1511 with e-value of 2.09E-88 and BLAST sequence identity of 64.8
MGAPKQKWTAEEEAALKAGVIKHGAGKWRTILKDPEFSGVLYLRSNVDLKDKWRNMSVMVNGYGSREKPKLAPKRVHHVHRQDENLMSVGTVQSDEDIPDAKALPVSSAALPVVNPKRTTVRLDNLIMEAITSLKEPGGSHKTAIASYIEEQYWPPNDFKRILSAKLKYLAANGKLIKVKRKYRIAPTSAFAERRVSPLFFEGRQRISPKIERDDFNILTMSQIDLDLGKMRTMTAEQAAEVAARAVAEAEAAIAVAEEAAREAETAEADAEAAQAFAEAAMKTLKGRTAPKVLGSILGVHQGCDSSFASLASLHL

SEQ ID NO: 1470 - DNA, 960 bp, Populus balsamifera subsp. trichocarpa
  misc_feature (1)..(960): Ceres ANNOT ID no. 1461164
  misc_feature 159741:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgggtgcacccaaacagaaatggacggcagaagaagaagcagcgctaaaagctggagtgattaagcatggagctggaaaatggcgcacgatacttaaagatccggaatttagtggtgtcttgtatctgcgttcgaatgtggaccttaaggacaaatggagaaacatgagtgtaatggtaaatgggtatggctcgagagagaagcctaagttagcacctaaaagggtgcaccatgtccatagacaggatgagaaccttatgtctgttggcactgttcaaagcgatgaagatattccagatgccaaggctcttccagttagcagtgctgcattgccggttgttaatccgaagagaactactgtaaggctggataatcttataatggaggcaataactagcttgaaggagcctggaggttcacataagaccgcaattgcttcatacatagaggaacaatattggccaccaaatgactttaagaggatattatcagctaaattgaagtatctggcagcaaatggtaaactgattaaggttaaacggaagtatagaattgcacctacttcagcatttgctgagagaagggtttctcccttattctttgaaggaagacagaggatctctcccaaaattgaaagggatgatttcaatatacttacaatgtctcagattgatttggatctggggaagatgaggactatgaccgcagaacaggctgctgaggtagcggctcgagcggttgcggaggcagaagctgctatagcagtagctgaagaggcggcaagggaggcggagacagcagaagctgatgcagaggcagcacaagcatttgcggaagcagctatgaagacactgaaaggaaggaccgcccctaaggtgcttggatctattctgggagtccatcaggacggttcgagcttgatggaaaatctcgaaaaggtcactaaggagtttgattga

SEQ ID NO: 1471 - protein, 319 aa, Populus balsamifera subsp. trichocarpa
  misc_feature (1)..(319): Ceres ANNOT ID no. 1461164
  misc_feature (125)..(187): Pfam Name: Linker_histone Pfam Description: linker histone H1 and H5 family
  misc_feature (5)..(57): Pfam Name: Myb_DNA-binding Pfam Description: Myb-like DNA-binding domain
  misc_feature: SWISSPROT Homolog: H1_WHEAT Histone H1 with e-value of 1.2e-12 and BLAST sequence identity of 31.2
  misc_feature: SWISSPROT Homolog: H11_ARATH Histone H1.1 with e-value of 1.6e-10 and BLAST sequence identity of 28.2
  misc_feature: SWISSPROT Homolog: H12_ARATH Histone H1.2 with e-value of 2.7e-09 and BLAST sequence identity of 27.5
  misc_feature: SWISSPROT Homolog: H1_MAIZE Histone H1 with e-value of 8.5e-08 and BLAST sequence identity of 29.5
  misc_feature: SWISSPROT Homolog: H1_LYCES Histone H1 with e-value of 1.5e-07 and BLAST sequence identity of 30.1
  misc_feature 159848:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(319): Functional Homolog of  Ceres CLONE ID no. 35594 at SEQ ID NO. 1511 with e-value of 2.09E-88 and BLAST sequence identity of 64.8
MGAPKQKWTAEEEAALKAGVIKHGAGKWRTILKDPEFSGVLYLRSNVDLKDKWRNMSVMVNGYGSREKPKLAPKRVHHVHRQDENLMSVGTVQSDEDIPDAKALPVSSAALPVVNPKRTTVRLDNLIMEAITSLKEPGGSHKTAIASYIEEQYWPPNDFKRILSAKLKYLAANGKLIKVKRKYRIAPTSAFAERRVSPLFFEGRQRISPKIERDDFNILTMSQIDLDLGKMRTMTAEQAAEVAARAVAEAEAAIAVAEEAAREAETAEADAEAAQAFAEAAMKTLKGRTAPKVLGSILGVHQDGSSLMENLEKVTKEFD

SEQ ID NO: 1472 - DNA, 918 bp, Populus balsamifera subsp. trichocarpa
  misc_feature (1)..(918): Ceres ANNOT ID no. 1494183
  misc_feature 159942:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgggtgcaccgaaacagaaatggacagcagaagaagaagcagcgctaaaagctggagttattaagcatggagctggaaaatggcgcacgattcttaaagatccagaatttagtggtgtcttgtatctgcgttcaaatgtggatcttaaggacaaatggagaaacataagtgtaatggtaaatggctatggatcaagagagaagcctaagttagcacctaagatggtgcaccatgtcctaagacaggatgagaaccctatggctgttgatcaaaccgatgaagatatttcagatgccaagcctcttgcagttagcagtggtgcattgctggttgctaatccaaagagaactactgtaaggctggataatcttataatggaggcaataactagcttgaaggagcctgggggctcacataagacagcaattgcttcatacatagaggaacaatattggccaccaaatgactttaagaggatattatcagcgaaattgaagtatttggcagctaatggtaaactgattaaggttaaacggaagtatagaattgcacctacttcagtgtttgccgagagaagaagggtttctcccttactattggaaggaagacagaggatctctcctaaaattgaaagggatggtttcaatatgtttacaatgtctcagattgacttggatctgggcaggatgaggactatgactgcagaacaggctgctgaggtagcagctcgagcagttgcggaggcagaagctgccatagcagtagctgaagaggcaacaagggaggctgagacagcagaagctgacgcagaggcagcacaagcatttgctgaaacagctaggaagacactgaaaggaaggaccacccccaagatggtagactttatcactgcatcttttctgaatgatttgttttga

SEQ ID NO: 1473 - protein, 305 aa, Populus balsamifera subsp. trichocarpa
  misc_feature (1)..(305): Ceres ANNOT ID no. 1494183
  misc_feature (123)..(185): Pfam Name: Linker_histone Pfam Description: linker histone H1 and H5 family
  misc_feature (5)..(57): Pfam Name: Myb_DNA-binding Pfam Description: Myb-like DNA-binding domain
  misc_feature: SWISSPROT Homolog: H1_WHEAT Histone H1 with e-value of 1.2e-12 and BLAST sequence identity of 31.2
  misc_feature: SWISSPROT Homolog: H11_ARATH Histone H1.1 with e-value of 1.6e-10 and BLAST sequence identity of 28.2
  misc_feature: SWISSPROT Homolog: H12_ARATH Histone H1.2 with e-value of 2.7e-09 and BLAST sequence identity of 27.5
  misc_feature: SWISSPROT Homolog: H1_MAIZE Histone H1 with e-value of 8.5e-08 and BLAST sequence identity of 29.5
  misc_feature: SWISSPROT Homolog: H1_LYCES Histone H1 with e-value of 1.5e-07 and BLAST sequence identity of 30.1
  misc_feature 160047:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(305): Functional Homolog of  Ceres CLONE ID no. 35594 at SEQ ID NO. 1511 with e-value of 6.40E-87 and BLAST sequence identity of 62.5
MGAPKQKWTAEEEAALKAGVIKHGAGKWRTILKDPEFSGVLYLRSNVDLKDKWRNISVMVNGYGSREKPKLAPKMVHHVLRQDENPMAVDQTDEDISDAKPLAVSSGALLVANPKRTTVRLDNLIMEAITSLKEPGGSHKTAIASYIEEQYWPPNDFKRILSAKLKYLAANGKLIKVKRKYRIAPTSVFAERRRVSPLLLEGRQRISPKIERDGFNMFTMSQIDLDLGRMRTMTAEQAAEVAARAVAEAEAAIAVAEEATREAETAEADAEAAQAFAETARKTLKGRTTPKMVDFITASFLNDLF

SEQ ID NO: 1474 - DNA, 951 bp, Populus balsamifera subsp. trichocarpa
  misc_feature (1)..(951): Ceres ANNOT ID no. 1441280
  misc_feature 160141:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgggtgcaccgaaacagaaatggacagcagaagaagaagcagcgctaaaagctggagttattaagcatggagctggaaaatggcgcacgattcttaaagatccagaatttagtggtgtcttgtatctgcgttcaaatgtggatcttaaggacaaatggagaaacataagtgtaatggtaaatggctatggatcaagagagaagcctaagttagcacctaagatggtgcaccatgtcctaagacaggatgagaaccctatggctgttgatcaaaccgatgaagatatttcagatgccaagcctcttgcagttagcagtggtgcattgctggttgctaatccaaagagaactactgtaaggctggataatcttataatggaggcaataactagcttgaaggagcctgggggctcacataagacagcaattgcttcatacatagaggaacaatattggccaccaaatgactttaagaggatattatcagcgaaattgaagtatttggcagctaatggtaaactgattaagctggacacattagatgatgttagagatctagaggttaaacggaagtatagaattgcacctacttcagtgtttgccgagagaagaagggtttctcccttactattggaaggaagacagaggatctctcctaaaattgaaagggatggtttcaatatgtttacaatgtctcagattgacttggatctgggcaggatgaggactatgactgcagaacaggctgctgaggtagcagctcgagcagttgcggaggcagaagctgccatagcagtagctgaagaggcaacaagggaggctgagacagcagaagctgacgcagaggcagcacaagcatttgctgaaacagctaggaagacactgaaaggaaggaccacccccaagatggtagactttatcactgcatcttttctgaatgatttgttttga

SEQ ID NO: 1475 - protein, 316 aa, Populus balsamifera subsp. trichocarpa
  misc_feature (1)..(316): Ceres ANNOT ID no. 1441280
  misc_feature (123)..(151): Pfam Name: Linker_histone Pfam Description: linker histone H1 and H5 family
  misc_feature (5)..(57): Pfam Name: Myb_DNA-binding Pfam Description: Myb-like DNA-binding domain
  misc_feature: SWISSPROT Homolog: H1_WHEAT Histone H1 with e-value of 1.2e-12 and BLAST sequence identity of 31.2
  misc_feature: SWISSPROT Homolog: H11_ARATH Histone H1.1 with e-value of 1.6e-10 and BLAST sequence identity of 28.2
  misc_feature: SWISSPROT Homolog: H12_ARATH Histone H1.2 with e-value of 2.7e-09 and BLAST sequence identity of 27.5
  misc_feature: SWISSPROT Homolog: H1_MAIZE Histone H1 with e-value of 8.5e-08 and BLAST sequence identity of 29.5
  misc_feature: SWISSPROT Homolog: H1_LYCES Histone H1 with e-value of 1.5e-07 and BLAST sequence identity of 30.1
  misc_feature 160246:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(316): Functional Homolog of  Ceres CLONE ID no. 35594 at SEQ ID NO. 1511 with e-value of 7.49E-84 and BLAST sequence identity of 62.5
MGAPKQKWTAEEEAALKAGVIKHGAGKWRTILKDPEFSGVLYLRSNVDLKDKWRNISVMVNGYGSREKPKLAPKMVHHVLRQDENPMAVDQTDEDISDAKPLAVSSGALLVANPKRTTVRLDNLIMEAITSLKEPGGSHKTAIASYIEEQYWPPNDFKRILSAKLKYLAANGKLIKLDTLDDVRDLEVKRKYRIAPTSVFAERRRVSPLLLEGRQRISPKIERDGFNMFTMSQIDLDLGRMRTMTAEQAAEVAARAVAEAEAAIAVAEEATREAETAEADAEAAQAFAETARKTLKGRTTPKMVDFITASFLNDLF

SEQ ID NO: 1476 - protein, 150 aa, Arabidopsis thaliana
  misc_feature (1)..(150): Ceres CLONE ID no. 35733
  misc_feature (8)..(150): Pfam Name: Mago_nashi Pfam Description: Mago nashi protein
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
MAAEEATEFYLRYYVGHKGKFGHEFLEFEFREDGKLRYANNSNYKNDTIIRKEVFLTPAVLKECKRIVSESEILKEDDNNWPEPDRVGKQELEIVLGNEHISFATSKIGSLVDCQSSNDPEGLRIFYYLVQDLKCLVFSLISLHFKIKPI

SEQ ID NO: 1477 - DNA, 447 bp, Populus balsamifera subsp. trichocarpa
  misc_feature (1)..(447): Ceres ANNOT ID no. 1486258
  misc_feature 160412:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
atggcagcgatggaggaagataacggagagttctatcttcgttactacgttggtcacagaggtaaattcggtcacgaattcttggaattcgagttccggcctgatggaaaactccgatacgcaaacaactctaattacaaaaacgacaccatgattcgtaaagaagtctttcttacccccgccgttctcaaagagtgccgccgcatcatctccgagagcgagattatgaaggaagatgacaacaactggccagagccggaccgggttgggaggcaagagctggagattgtgatggggaatgagcatatttcatttactacgtctaagattggatcacttgttgatgttcacagtagccaggatcctgaagggcttcgcatcttctattatcttgttcaggtgattgcaatttataagcatgaatatctctttgaatgtagtggttaa

SEQ ID NO: 1478 - protein, 148 aa, Populus balsamifera subsp. trichocarpa
  misc_feature (1)..(148): Ceres ANNOT ID no. 1486258
  misc_feature (10)..(133): Pfam Name: Mago_nashi Pfam Description: Mago nashi protein
  misc_feature: SWISSPROT Homolog: MGN_ARATH Protein mago nashi homolog with e-value of 1.7e-78 and BLAST sequence identity of 100.0
  misc_feature: SWISSPROT Homolog: MGN_EUPLA Protein mago nashi homolog with e-value of 1.4e-67 and BLAST sequence identity of 86.0
  misc_feature: SWISSPROT Homolog: MGN_ORYSA Protein mago nashi homolog (Mago nashi-like protein) with e-value of 4.8e-67 and BLAST sequence identity of 86.7
  misc_feature: SWISSPROT Homolog: MGN2_HUMAN Protein mago nashi homolog 2 with e-value of 1.4e-60 and BLAST sequence identity of 77.9
  misc_feature: SWISSPROT Homolog: MGNR_MOUSE Protein mago nashi homolog 1-related with e-value of 3.7e-60 and BLAST sequence identity of 77.8
  misc_feature 160509:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature (1)..(148): Functional Homolog of  Ceres CLONE ID no. 35733 at SEQ ID NO. 1520 with e-value of 2.49E-60 and BLAST sequence identity of 88.5
MAAMEEDNGEFYLRYYVGHRGKFGHEFLEFEFRPDGKLRYANNSNYKNDTMIRKEVFLTPAVLKECRRIISESEIMKEDDNNWPEPDRVGRQELEIVMGNEHISFTTSKIGSLVDVHSSQDPEGLRIFYYLVQVIAIYKHEYLFECSG

SEQ ID NO: 1479 - DNA, 1371 bp, Populus balsamifera subsp. trichocarpa
  misc_feature (1)..(1371): Ceres ANNOT ID no. 1443988
  misc_feature 160586:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
atggttgtttatgatgtgacagaccaagagagcttcaacaatgtcaagcagtggctcaatgaaattgatcgatatgctagtgataatgtgaacaaacttctggttggaaacaagtctgatctcactgcaaataaagtagtgtcatacgagacagcaaaggcttttgctgatgagattggcatacctttcatggaaactagtgcaaaagatgccactaatgtggaacaagctttcatggccatggctgctgcaatcaaggatagctcagaggacagcctgttgaacaaaagggaggctgctgctcgtcttgagccagtagaagtatttatgagttttctgtgccttgtccattggctcaaccattacctgttcaaaatgaaaatactatctgaggtgattttctccctcaggaaaagggaaactggatcatccttggatatctctggcagagtgctcgatgccaacatagtccccaaagttaaaatgaacaaagacgtaaatgatgtgaaagatgaagatatggtccttgggctcggtaacgataagctagggtggggagtttcggttttatgccgacattgttttcgacacgctgatacagtgacgaatcccaagctgcatcatcgcataccaggtatgagaaacgtccgacagatcccacataaaaatgcaaagcaaattacccttagaccataccctgcaccagcatgggctacatcaaagctcaagaatcaaaatacaacaaagaaaaaccttccaggggataaaaaacaaccagcatttcagttttactcatcaaggccagatgatgccatgcccaataagcaagagacttgggctgaaccaattaaagtcacgaaagaaaggagaaagataaaaggaaggaaaaaagccatggcagcgacggagggagataacggagagttctaccttcgttactacgtaggtcacagaggtaaattcggtcacgaattcctggagttcgagttccgtccagatggcaagctccgatacgccaacaactctaactacaaaaacgacaccatgattcgcaaagaagtcttccttacccccgccgtcctgaaagagtgccgccgcatcatctccgagagcgagattatgtacctatatgtgattgaattggatgctgttgaagatgtgattagttctatgatgattatgaaggaagatgacaacaactggccagagccagaccgggttgggaaacaggagctggagattgtgatggggaatgagcatatttcttttactacatcaaagattggatcacttgttgatgttcacagtagccaggatcctgaagggcttcgcatcttctattatcttgtccaggtgattgcaactcattga

SEQ ID NO: 1480 - protein, 378 aa, Populus balsamifera subsp. trichocarpa
  misc_feature (1)..(378): Ceres ANNOT ID no. 1443988
  misc_feature (230)..(379): Pfam Name: Mago_nashi Pfam Description: Mago nashi protein
  misc_feature: SWISSPROT Homolog: MGN_ARATH Protein mago nashi homolog with e-value of 1.7e-78 and BLAST sequence identity of 100.0
  misc_feature: SWISSPROT Homolog: MGN_EUPLA Protein mago nashi homolog with e-value of 1.4e-67 and BLAST sequence identity of 86.0
  misc_feature: SWISSPROT Homolog: MGN_ORYSA Protein mago nashi homolog (Mago nashi-like protein) with e-value of 4.8e-67 and BLAST sequence identity of 86.7
  misc_feature: SWISSPROT Homolog: MGN2_HUMAN Protein mago nashi homolog 2 with e-value of 1.4e-60 and BLAST sequence identity of 77.9
  misc_feature: SWISSPROT Homolog: MGNR_MOUSE Protein mago nashi homolog 1-related with e-value of 3.7e-60 and BLAST sequence identity of 77.8
  misc_feature 160713:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: INFLORESCENCE - Weak Useful for making stronger plants
  misc_feature (1)..(378): Functional Homolog of  Ceres CLONE ID no. 35733 at SEQ ID NO. 1520 with e-value of 1.19E-55 and BLAST sequence identity of 89.3
MAMAAAIKDSSEDSLLNKREAAARLEPVEVFMSFLCLVHWLNHYLFKMKILSEVIFSLRKRETGSSLDISGRVLDANIVPKVKMNKDVNDVKDEDMVLGLGNDKLGWGVSVLCRHCFRHADTVTNPKLHHRIPGMRNVRQIPHKNAKQITLRPYPAPAWATSKLKNQNTTKKNLPGDKKQPAFQFYSSRPDDAMPNKQETWAEPIKVTKERRKIKGRKKAMAATEGDNGEFYLRYYVGHRGKFGHEFLEFEFRPDGKLRYANNSNYKNDTMIRKEVFLTPAVLKECRRIISESEIMYLYVIELDAVEDVISSMMIMKEDDNNWPEPDRVGKQELEIVMGNEHISFTTSKIGSLVDVHSSQDPEGLRIFYYLVQVIATH

SEQ ID NO: 1481 - protein, 479 aa, Arabidopsis thaliana
  misc_feature (1)..(479): Ceres CLONE ID no. 35742
  misc_feature (21)..(418): Pfam Name: Pkinase Pfam Description: Protein kinase domain
  misc_feature: Phenotype: WHOLE PLANT - Small Useful for modulating plant size
  misc_feature: Phenotype: ROSETTE LEAVES - Glossy Useful for making plants with enhanced abiotic stress tolerance
MDKQPATSWSIHTRPEIIAKYEIFERVGSGAYADVYRARRLSDGLIVALKEIFDYQSAFREIDALTILNGSPNVVVMHEYFWREEENAVLVLEFLRSDLAAVIRDGKRKKKVEGGDGFSVGEIKRWMIQILTGVDACHRNLIVHRDLKPGNMLISDDGVLKLADFGQARILMEHDIVASDENQQAYKLEDKDGETSEPPEVIPDYENSPRQGSDGQEREAMSKDEYFRQVEELKAKQVVRDDTDKDSNVHDGDISCLATCTVSEMDDDLGRNSFSYDADEAVDDTQGLMTSCVGTRWFRPPELLYGSTMYGLEVDLWSLGCVFAELLSLEPLFPGISDIDQISRVTNVLGNLNEEVWPGCVDLPDYKSISFAKVESPLGIEGCLPNHSGDVISLLKKLICYDPASRATTMEMLNDKYLSEEPLPVPVSELYVPPTMSGPDEDSPRKWNDYREMDSDSDFDGFGPMNVKPTSSGFTIEFP

SEQ ID NO: 1482 - DNA, 1437 bp, Populus balsamifera subsp. trichocarpa
  misc_feature (1)..(1437): Ceres ANNOT ID no. 1478035
  misc_feature 160957:<222: Transcription Factor
  misc_feature: Phenotype: WHOLE PLANT - Small Useful for modulating plant size
  misc_feature: Phenotype: ROSETTE LEAVES - Glossy Useful for making plants with enhanced abiotic stress tolerance
atggaccgatctccgccgcccgcaaagagctggagcatccacacccgacccgaaatcatatccaaatacgaaatccaagagcgaattggctccggcgcctactccgacgtgtacaaagccaggcgtcactccgacaatctcacagtggctctcaaagaaatccacgactaccagtctgcatctagagaaatcgaggcattgcaggtcctccagaattgtccaaacgtcgtcgttttgcacgagtatttttggagagaagacgaggacgctgtgcttgttttggagttcttgagaactgacttggctgctgttattaagcaaggggaaaagagggatgatggtgttggcgttagtgttggagaagttaagagatggatggttcagattttatgcggggttgatgcgtgtcatcggaatatgatcgtgcatcgtgatttgaaacctagtaatttgttggtttctgacgatggggttcttaagttggctgattttggccaggcgaggatactcatggatcctgggttcgttgcagccgatgagaacattcaaccatatgaacagaacccattatttcaggaacatgctactccaccagctgaagttgttcctgagatagacagctcatctcaagaaggacatagaaatgaaaagcaaggtacgattagtagagaagaatcatttcgagagatgggcaactacaagattcagggttcattagatgacattgataaggaaatgagtattcgggatggagatacttcttgttttgcaactggcactgcaagcgacttaggagatgatatgttgaagagttattgttcatatgaggctgaggatgctgaaaacgatgggtgtggttcactcacttcatgtgttggaacacggtggttccgggctccggaactgctctatggatccacagactatggcctggaggttgatctgtggtctttgggctgtatttttgctgagcttttgaccctcaaacccctcttcccaggcacttctgatatagatcaaattagcagaattttcagtgtcttgggaaatttgactgaggaagtctggccaggctgtgtaaaacttcctgattacggaacaatttcttttgccaaggtggaaaatcccactggcatagaagcctgcctccctaatcattcccctggtgaaatctctctggtcaagaagcttgtctgctatgacccagctagtagagctacagccatggaattgctccatgatgagtactttagcaaagagcctcttccggttcccttctctgatctctgggttccttcaactagtagtgggcaggatgaggattcccctggtctgtggcatgattacaatgatagggaatctgattctgattttgatgacttcggccccatgagtgtcaaaaccacctcggatggtttctccatacagttttcctga

SEQ ID NO: 1483 - protein, 478 aa, Populus balsamifera subsp. trichocarpa
  misc_feature (1)..(478): Ceres ANNOT ID no. 1478035
  misc_feature (141)..(172): Pfam Name: Pkinase_Tyr Pfam Description: Protein tyrosine kinase
  misc_feature (286)..(417): Pfam Name: Pkinase Pfam Description: Protein kinase domain
  misc_feature: SWISSPROT Homolog: CCRK_HUMAN Cell cycle-related kinase with e-value of 5.1e-55 and BLAST sequence identity of 44.2
  misc_feature: SWISSPROT Homolog: CCRK_HUMAN EC 2.7.11.22(Cyclin-kinase-activating kinase p42) ( CDK-activating kinase p42) (CAK-kinase p42)
  misc_feature: SWISSPROT Homolog: CCRK_PONPY Cell cycle-related kinase (EC 2.7.11.22) with e-value of 2.2e-54 and BLAST sequence identity of 42.9
  misc_feature: SWISSPROT Homolog: CCRK_MOUSE Cell cycle-related kinase with e-value of 7.4e-54 and BLAST sequence identity of 43.4
  misc_feature: SWISSPROT Homolog: CCRK_MOUSE EC 2.7.11.22 (Cyclin-kinase-activating kinase p42) CDK-activating kinase p42) (CAK-kinase p42) CDK-related protein kinase PNQLARE)
  misc_feature: SWISSPROT Homolog: CCRK_RAT Cell cycle-related kinase (EC 2.7.11.22) with e-value of 7.4e-54 and BLAST sequence identity of 43.4
  misc_feature: SWISSPROT Homolog: CDK3_HUMAN Cell division protein kinase 3 (EC 2.7.11.22) with e-value of 2.2e-48 and BLAST sequence identity of 44.3
  misc_feature 161104:<222: Transcription Factor
  misc_feature: Phenotype: WHOLE PLANT - Small Useful for modulating plant size
  misc_feature: Phenotype: ROSETTE LEAVES - Glossy Useful for making plants with enhanced abiotic stress tolerance
  misc_feature (1)..(478): Functional Homolog of  Ceres CLONE ID no. 35742 at SEQ ID NO. 1525 with e-value of 1.19E-170 and BLAST sequence identity of 66.2
MDRSPPPAKSWSIHTRPEIISKYEIQERIGSGAYSDVYKARRHSDNLTVALKEIHDYQSASREIEALQVLQNCPNVVVLHEYFWREDEDAVLVLEFLRTDLAAVIKQGEKRDDGVGVSVGEVKRWMVQILCGVDACHRNMIVHRDLKPSNLLVSDDGVLKLADFGQARILMDPGFVAADENIQPYEQNPLFQEHATPPAEVVPEIDSSSQEGHRNEKQGTISREESFREMGNYKIQGSLDDIDKEMSIRDGDTSCFATGTASDLGDDMLKSYCSYEAEDAENDGCGSLTSCVGTRWFRAPELLYGSTDYGLEVDLWSLGCIFAELLTLKPLFPGTSDIDQISRIFSVLGNLTEEVWPGCVKLPDYGTISFAKVENPTGIEACLPNHSPGEISLVKKLVCYDPASRATAMELLHDEYFSKEPLPVPFSDLWVPSTSSGQDEDSPGLWHDYNDRESDSDFDDFGPMSVKTTSDGFSIQFS

SEQ ID NO: 1484 - protein, 441 aa, Arabidopsis thaliana
  misc_feature (1)..(441): Ceres CLONE ID no. 35786
  misc_feature (1)..(441): Also Known As Ceres CDNA ID no. 23381009
  misc_feature (1)..(441): Also Known As Ceres GEMINI ID 534B6
  misc_feature (123)..(156): Pfam Name: TPR_2 Pfam Description: Tetratricopeptide repeat
  misc_feature (157)..(190): Pfam Name: TPR_2 Pfam Description: Tetratricopeptide repeat
  misc_feature (191)..(221): Pfam Name: TPR_1 Pfam Description: Tetratricopeptide repeat
  misc_feature 161266:<222: Transcription Factor
  misc_feature: Phenotype: Activates expression of the gene endogenous to the AtHMGS (SEQ ID NO 4144) regalutory region Useful for modulating Terpenoid Biosynthesis
MDSTKLSELKVFIDQCKSDPSLLTTPSLSFFRDYLESLGAKIPTGVHEEDKDTKPRSFVVEESDDDMDETEEVKPKVEEEEEEDEIVESDVELEGDTVEPDNDPPQKMGDSSVEVTDENREAAQEAKGKAMEALSEGNFDEAIEHLTRAITLNPTSAIMYGNRASVYIKLKKPNAAIRDANAALEINPDSAKGYKSRGMARAMLGEWAEAAKDLHLASTIDYDEEISAVLKKVEPNAHKLEEHRRKYDRLRKEREDKKAERDRLRRRAEAQAAYDKAKKEEQSSSSRPSGGGFPGGMPGGFPGGMPGGFPGGMGGMPGGFPGGMGGMGGMPGGFPGGMGGGMPAGMGGGMPGMGGGMPAGMGGGGMPGAGGGMPGGGGMPGGMDFSKILNDPELMTAFSDPEVMAALQDVMKNPANLAKHQANPKVAPVIAKMMGKFAGPQ

SEQ ID NO: 1485 - DNA, 1230 bp, Populus balsamifera subsp. trichocarpa
  misc_feature (1)..(1230): Ceres ANNOT ID no. 1447278
  misc_feature 161375:<222: Transcription Factor
  misc_feature: Phenotype: Activates expression of the gene endogenous to the AtHMGS (SEQ ID NO 4144) regalutory region Useful for modulating Terpenoid Biosynthesis
atggacgcaacaaaactagaagaactgaagcaatttattgaacagtgcaaatccaatccttccatcctcgccgatccttctctttccttcttccacgactacctcgaaagtcttggtgctaagctccctgcctgtgctcacaagcacgacgactccaaatcgaagagttatgtggtcgaggagagtgatgaggaaatggagaaggaagagtcacaaggagaacctgaagtcgaggaggaggaggaggaggagataattgaatccgatgttgagctcgaaggcgagactgttgagcctgataacgatcctccacagaagatgggggacccatctgtagaggttacagaagaaagtcgtgatgcttctcaagaggccaaggctaaggccatggaagctatctctgaaggtaaattggaggaagcaattgagcatttgacagaagcaatttcactcaatccaacatctgcaataatgtatgcaacaagagctactgtttacatcaaaatgaagaggcccaatgctgctatccgggatgctaatgctgctcttgagattaacctggattcagctaagggatataagtcccgtggcatggcacgagcaatgcttggtcagtgggaagatgctgctaaggatctccacctggcatcaaagttagattacgatgaggagataagtgctgtacttaagaaggttgaaccaaacgctcataggattgaggaacaccgcaggaagtatgaaaggctacacaaagagagggaggatagaaaggctgagcgtgagagacaacgtcgtcgtgctaaagctcaggctgagtatgagaaggccaagaagcaagagcaatcatcttctagtagaaaacctggaggcatgccaagtggatttccaggaggatttccaggaggtatgcccgggggaatgcctggaggtatgcccgggggaatgcctggaggtatgcccgggggaatgcctggaggtatgcccgggggaatgccaggagggatgcctggaggcttcccgggtgccatgccaggagggatgcctggaaatgttgatttcagcaaaatattgaatgaccctgaattgatggctgcatttagtgacccggaaataatggctgcccttcaagatgtgatgaagaacccagctaatcttgctaagcatcaagggaaccccaaggtggctcctataattgcaaagatgatgggcaaatttgccgggcctaagtga

SEQ ID NO: 1486 - protein, 409 aa, Populus balsamifera subsp. trichocarpa
  misc_feature (1)..(409): Ceres ANNOT ID no. 1447278
  misc_feature (122)..(155): Pfam Name: TPR_2 Pfam Description: Tetratricopeptide repeat
  misc_feature (156)..(189): Pfam Name: TPR_1 Pfam Description: Tetratricopeptide repeat
  misc_feature: SWISSPROT Homolog: F10A1_HUMAN Hsc70-interacting protein (Hip) (Putative tumor suppressor ST13) (Protein FAM10A1) (Progesterone receptor-associated p48 protein) with e-value of 7.1e-103 and BLAST sequence identity of 47.3
  misc_feature: SWISSPROT Homolog: F10A1_PONPY Hsc70-interacting protein (Hip) (Protein ST13 homolog) (Protein FAM10A1) with e-value of 1.9e-102 and BLAST sequence identity of 47.0
  misc_feature: SWISSPROT Homolog: F10A1_RAT Hsc70-interacting protein (Hip) (Protein ST13 homolog) (Protein FAM10A1) with e-value of 2.4e-102 and BLAST sequence identity of 48.0
  misc_feature: SWISSPROT Homolog: F10A5_HUMAN Protein FAM10A5 with e-value of 2.5e-98 and BLAST sequence identity of 46.1
  misc_feature: SWISSPROT Homolog: F10A1_CHICK Hsc70-interacting protein (Hip) (Protein ST13 homolog) (Protein FAM10A1) with e-value of 2.2e-97 and BLAST sequence identity of 48.9
  misc_feature 161493:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(409): Functional Homolog of  Ceres CLONE ID no. 35786 at SEQ ID NO. 1528 with e-value of 4.30E-168 and BLAST sequence identity of 80.6
MDATKLEELKQFIEQCKSNPSILADPSLSFFHDYLESLGAKLPACAHKHDDSKSKSYVVEESDEEMEKEESQGEPEVEEEEEEEIIESDVELEGETVEPDNDPPQKMGDPSVEVTEESRDASQEAKAKAMEAISEGKLEEAIEHLTEAISLNPTSAIMYATRATVYIKMKRPNAAIRDANAALEINLDSAKGYKSRGMARAMLGQWEDAAKDLHLASKLDYDEEISAVLKKVEPNAHRIEEHRRKYERLHKEREDRKAERERQRRRAKAQAEYEKAKKQEQSSSSRKPGGMPSGFPGGFPGGMPGGMPGGMPGGMPGGMPGGMPGGMPGGMPGGMPGGFPGAMPGGMPGNVDFSKILNDPELMAAFSDPEIMAALQDVMKNPANLAKHQGNPKVAPIIAKMMGKFAGPK

SEQ ID NO: 1487 - protein, 224 aa, Arabidopsis thaliana
  misc_feature (1)..(224): Ceres CLONE ID no. 35999
  misc_feature (30)..(197): Pfam Name: FAA_hydrolase Pfam Description: Fumarylacetoacetate (FAA) hydrolase family
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Long Petioles Useful for making plants that grow better in shade
MATSMIQRLFKQGTKIVGVGLNYASHAKELGNALPKDPIVFLKPTSSYLENGGTIEIPHPLDSLHHEVELAVVIGQKARDVPERLAMNYIGGYALALDMTARELQVSAMASGLPCTLAKGQDTFTPISSVLPKAMVLDPNNLELWLKVDDETRQKGWTKDMIFKVPYLISYISSVMTLFKGDVILTGTPEGIGPVKIGQKITAGITGLSEVQFDVGRRLKPLLR

SEQ ID NO: 1488 - DNA, 681 bp, Populus balsamifera subsp. trichocarpa
  misc_feature (1)..(681): Ceres ANNOT ID no. 1515818
  misc_feature 161691:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Long Petioles Useful for making plants that grow better in shade
atggcatcaccgtcagcaggcatacaaaagctacttcatgtaggaaccaagatcgttgctgttggccgtaactacgctgctcacgccaaagaactaggcaacgccgtccctaaggaaccggtgttgtttatgaaaccgacgtcatcttatttggaaaacggaggtacgatcgagattccacaaccgttggagtcgttgcatcatgaagtcgagcttgctgttgttattggccagaaagctcgtgatgtgcctgaatcaactgccatggattatgttggagggtatgcgcttgcattggatatgactgctagggaaatacaagctactgctaagtctgcagggctcccgtggactgtggctaaagggcaggacacattcacacctatcagttctgttctttccaagtcaaatgtgcttgaccctaacaacttggaactatggttaaaggtagatggagaaatacgccagaaaggttctaccaaagatatgatctttaaaatcccgtttctcattagccacatcagttctatcatgacactctttgaaggagatgttatattaacaggcaccccacaaggtgttggccctgtaaaaataggtcaaaaaataacagctggtataacagatcttatcgatgtgcacttcaatgttgagaaacgcaaaaggcctggaagttgctga

SEQ ID NO: 1489 - protein, 226 aa, Populus balsamifera subsp. trichocarpa
  misc_feature (1)..(226): Ceres ANNOT ID no. 1515818
  misc_feature (32)..(199): Pfam Name: FAA_hydrolase Pfam Description: Fumarylacetoacetate (FAA) hydrolase family
  misc_feature: SWISSPROT Homolog: FAHD1_PONPY Fumarylacetoacetate hydrolase domain-containing protein 1 (EC 3.-.-.-) with e-value of 2.0e-54 and BLAST sequence identity of 50.0
  misc_feature: SWISSPROT Homolog: FAHD1_HUMAN Fumarylacetoacetate hydrolase domain-containing protein 1 EC 3.-.-.-) (YISK-like) with e-value of 3.2e-54 and BLAST sequence identity of 50.0
  misc_feature: SWISSPROT Homolog: FAHD1_MOUSE Fumarylacetoacetate hydrolase domain-containing protein 1 (EC 3.-.-.-) with e-value of 6.0e-53 and BLAST sequence identity of 47.2
  misc_feature: SWISSPROT Homolog: FAHD1_RAT Fumarylacetoacetate hydrolase domain-containing protein 1 (EC 3.-.-.-) with e-value of 4.2e-52 and BLAST sequence identity of 47.2
  misc_feature: SWISSPROT Homolog: Y643_PYRHO Hypothetical protein PH0643 with e-value of 1.9e-49 and BLAST sequence identity of 49.0
  misc_feature 161799:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Long Petioles Useful for making plants that grow better in shade
  misc_feature (1)..(226): Functional Homolog of  Ceres CLONE ID no. 35999 at SEQ ID NO. 1531 with e-value of 1.00E-88 and BLAST sequence identity of 77.7
MASPSAGIQKLLHVGTKIVAVGRNYAAHAKELGNAVPKEPVLFMKPTSSYLENGGTIEIPQPLESLHHEVELAVVIGQKARDVPESTAMDYVGGYALALDMTAREIQATAKSAGLPWTVAKGQDTFTPISSVLSKSNVLDPNNLELWLKVDGEIRQKGSTKDMIFKIPFLISHISSIMTLFEGDVILTGTPQGVGPVKIGQKITAGITDLIDVHFNVEKRKRPGSC

SEQ ID NO: 1490 - protein, 280 aa, Arabidopsis thaliana
  misc_feature (1)..(280): Ceres CLONE ID no. 36094
  misc_feature: Phenotype: WHOLE PLANT - Small Useful for modulating plant size
MAFGLIGRVVGTKPSRLSTAARLIPARWTSKGSEAQSKASTGGGGASLKTFQIYRWNPDNPGKPELQDYKIDLKDCGPMVLDALIKIKNEMDPSLTFRRSCREGICGSCAMNIDGCNGLACLTKIESGSKETTITPLPHMFVIKDLVVDMTNFYNQYKSIEPWLKRKNPASVPGKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQKSG

SEQ ID NO: 1491 - DNA, 858 bp, Populus balsamifera subsp. trichocarpa
  misc_feature (1)..(858): Ceres ANNOT ID no. 1440660
  misc_feature 161967:<222: Transcription Factor
  misc_feature: Phenotype: WHOLE PLANT - Small Useful for modulating plant size
atggcaactgggttgctcaagagaggagccatttcaacggctaagatctcatcattaacctcaagatttataccatctcgcctccaagccacggcggcggcggcggtggcagaagccaaaccagttgagcagccaacaaaccctactcaaccacaacatctgaaaacattccaaatctaccgatggaacccagacaacccaaccaaaccagagctccaaaactacgaagtagacctgaacaagtgcggtccgatggtgctagatgctttgatcaagataaaaaacgagatcgacccaacgctgacatttcgtcgatcatgtcgtgaaggaatttgtgggtcctgtgcaatgaatatggatgggtgtaatgggcttgcttgcttgacaaagattgataagtctggaccgcctagtatgatcaatccgttgccacacatgtttgtgatcaaagatctggttgtggatatgactaatttttataatcagtataagagtattgagccttggttgaagaggaagaatccaccacctgttaaagggaaggagattctgcagactaagaaagatagggctaagcttgatgggatgtacgagtgtattttgtgtgcttgttgtagtacttcttgccctagctattggtggaatcctgagtcttatttgggccctgctgctttgcttcatgctaataggtggatcatggatagccgtgatgaatataccaaggagcgcctggacgcagtcaatgatgagtttaagctctatcgttgccataccatattgaattgtgcccgtgcctgccccaagggattgaaccctgggaagcagattcaaaatatcaagaagcttgagcggagctag

SEQ ID NO: 1492 - protein, 285 aa, Populus balsamifera subsp. trichocarpa
  misc_feature (1)..(285): Ceres ANNOT ID no. 1440660
  misc_feature: SWISSPROT Homolog: DHSB_DROME Succinate dehydrogenase [ubiquinone] iron-sulfur protein, (EC 1.3.5.1) (IP) with e-value of 1.0e-89 and BLAST sequence identity of 68.2
  misc_feature: SWISSPROT Homolog: DHSB_CANGA Succinate dehydrogenase [ubiquinone] iron-sulfur protein, (EC 1.3.5.1) (IP) with e-value of 1.9e-88 and BLAST sequence identity of 69.3
  misc_feature: SWISSPROT Homolog: DHSB_SCHPO Succinate dehydrogenase [ubiquinone] iron-sulfur protein, (EC 1.3.5.1) (IP) with e-value of 6.4e-88 and BLAST sequence identity of 65.3
  misc_feature: SWISSPROT Homolog: DHSB_UROFA Succinate dehydrogenase [ubiquinone] iron-sulfur protein, (EC 1.3.5.1) (IP) with e-value of 2.2e-87 and BLAST sequence identity of 69.1
  misc_feature: SWISSPROT Homolog: DHSB_YEAST Succinate dehydrogenase [ubiquinone] iron-sulfur protein, (EC 1.3.5.1) (IP) with e-value of 3.2e-86 and BLAST sequence identity of 63.7
  misc_feature 162062:<222: Transcription Factor
  misc_feature: Phenotype: WHOLE PLANT - Small Useful for modulating plant size
  misc_feature (1)..(285): Functional Homolog of  Ceres CLONE ID no. 36094 at SEQ ID NO. 1534 with e-value of 5.10E-117 and BLAST sequence identity of 76.7
MATGLLKRGAISTAKISSLTSRFIPSRLQATAAAAVAEAKPVEQPTNPTQPQHLKTFQIYRWNPDNPTKPELQNYEVDLNKCGPMVLDALIKIKNEIDPTLTFRRSCREGICGSCAMNMDGCNGLACLTKIDKSGPPSMINPLPHMFVIKDLVVDMTNFYNQYKSIEPWLKRKNPPPVKGKEILQTKKDRAKLDGMYECILCACCSTSCPSYWWNPESYLGPAALLHANRWIMDSRDEYTKERLDAVNDEFKLYRCHTILNCARACPKGLNPGKQIQNIKKLERS

SEQ ID NO: 1493 - protein, 217 aa, Arabidopsis thaliana
  misc_feature (1)..(217): Ceres CLONE ID no. 36272
  misc_feature (1)..(217): Also Known As Ceres CDNA ID no. 23427841
  misc_feature (1)..(217): Also Known As Ceres GEMINI ID 531H5
  misc_feature (63)..(138): Pfam Name: Histone Pfam Description: Core histone H2A/H2B/H3/H4
  misc_feature 162169:<222: Transcription Factor
  misc_feature: Phenotype: Activates expression of the gene endogenous to the AtDXPR (SEQ ID NO 4143) regalutory region Useful for modulating Terpenoid Biosynthesis
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 1494 - DNA, 711 bp, Populus balsamifera subsp. trichocarpa
  misc_feature (1)..(711): Ceres ANNOT ID no. 1469342
  misc_feature 162236:<222: Transcription Factor
  misc_feature: Phenotype: Activates expression of the gene endogenous to the AtDXPR (SEQ ID NO 4143) regalutory region Useful for modulating Terpenoid Biosynthesis
atggatcagcaagggtatgggacaaatccatatcagccaaaccaaatgcctgctgcctcaaatcctggatcagttcctggtcagcctgcaggagctcagcttgaacagcatcaacttgcctatcagcagatccaccagcaacagcaacagcaactccagcaacaacgccagtctttttggacaaatcagtataaagaaatagacaaagttactgatttcaaaaatcacagtcttcccttggcaaggatcaagaagatcatgaaggctgatgaggatgtcaagatgatatcagctgaggcaccagttatattcgccagggcttgtgaaatgtttattttagagttgaccttgcagtcttggaatcacacggaggagaacaagaggaggacactacagaagaatgatattgctgcagctatcactaggactgatatctttgatttcctggttgacattgtacctagggaggatatgaaagatgaagtgcttgcatcaatcccaagaggaacaatgcctgttggagggcctgttgatgcactcccttactgctatatgccacatccacatgcacctcaggtcgggactcctgggatgataatgggcaagcctgtgacagacccagccatgtatgcccagcaatctcatccctatatggcacagcatatgtggccacagggaccagagcagcagcagtcaccctcagatcagtag

SEQ ID NO: 1495 - protein, 236 aa, Populus balsamifera subsp. trichocarpa
  misc_feature (1)..(236): Ceres ANNOT ID no. 1469342
  misc_feature (76)..(140): Pfam Name: CBFD_NFYB_HMF Pfam Description: Histone-like transcription factor CBF/NF-Y) and archaeal histone
  misc_feature: SWISSPROT Homolog: NFYC3_ARATH Nuclear transcription factor Y subunit C-3 (AtNF-YC-3) with e-value of 1.9e-118 and BLAST sequence identity of 100.0
  misc_feature: SWISSPROT Homolog: NFYC9_ARATH Nuclear transcription factor Y subunit C-9 (AtNF-YC-9) (Transcriptional activator HAP5C) with e-value of 5.7e-96 and BLAST sequence identity of 82.7
  misc_feature: SWISSPROT Homolog: NFYC1_ARATH Nuclear transcription factor Y subunit C-1 (AtNF-YC-1) (Transcriptional activator HAP5A) with e-value of 5.1e-56 and BLAST sequence identity of 58.6
  misc_feature: SWISSPROT Homolog: NFYC2_ARATH Nuclear transcription factor Y subunit C-2 (AtNF-YC-2) (Transcriptional activator HAP5B) with e-value of 2.5e-55 and BLAST sequence identity of 63.2
  misc_feature: SWISSPROT Homolog: NFYC4_ARATH Nuclear transcription factor Y subunit C-4 (AtNF-YC-4) with e-value of 1.4e-53 and BLAST sequence identity of 63.9
  misc_feature 162332:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(236): Functional Homolog of  Ceres CLONE ID no. 36272 at SEQ ID NO. 1537 with e-value of 3.49E-70 and BLAST sequence identity of 74.2
MDQQGYGTNPYQPNQMPAASNPGSVPGQPAGAQLEQHQLAYQQIHQQQQQQLQQQRQSFWTNQYKEIDKVTDFKNHSLPLARIKKIMKADEDVKMISAEAPVIFARACEMFILELTLQSWNHTEENKRRTLQKNDIAAAITRTDIFDFLVDIVPREDMKDEVLASIPRGTMPVGGPVDALPYCYMPHPHAPQVGTPGMIMGKPVTDPAMYAQQSHPYMAQHMWPQGPEQQQSPSDQ

SEQ ID NO: 1496 - DNA, 777 bp, Populus balsamifera subsp. trichocarpa
  misc_feature (1)..(777): Ceres ANNOT ID no. 1513277
  misc_feature 162410:<222: Transcription Factor
  misc_feature: Phenotype: Activates expression of the gene endogenous to the AtDXPR (SEQ ID NO 4143) regalutory region Useful for modulating Terpenoid Biosynthesis
atggaccagcaaggccatgtgcagccgccagcagtaggcatggttggaagtacagctccggttccttatggcataccttcatatcaacataaccagatgatgggaccttctgcaaccggatcacttcaatctcctactcagccagcagttcttactgcttcttcagctcatcttgctcaacaccaacttgcttaccagcacatccaccaccagcagcagcagcagttgcagcaacaacttcaaactttctgggcaaatcagtatcaagaaattgagcagactactgattttaagaaccatagcctgcccttggctaggattaagaagattatgaaggcagatgaagatgtaaggatgatatcagctgaagctcccatcatatttgccagggcctgtgagatgtttattttagaactgaccttgcgatcttggaatcatacagaggagaacaaaaggagaacactccaaaagaatgacattgctgcagctatcacaagaactgatatttttgattttctggttgatattgtcccaagagaggatttgaaagatgaggtgttagcatcagtcccgagagggagtcttcctgtaggaggtccagctgatgctcttccttactattacatgccacctcagcttgcaccccaggtctctgcgccggggatgactgtaggaaagcctgtggtggatcaagctttttatggccaacagtctcgcccttatgtaccacagcagatttggccacagcaaacacagcagccacctgaagattcctga

SEQ ID NO: 1497 - protein, 226 aa, Populus balsamifera subsp. trichocarpa
  misc_feature (1)..(226): Ceres ANNOT ID no. 1513277
  misc_feature (68)..(132): Pfam Name: CBFD_NFYB_HMF Pfam Description: Histone-like transcription factor CBF/NF-Y) and archaeal histone
  misc_feature: SWISSPROT Homolog: NFYC3_ARATH Nuclear transcription factor Y subunit C-3 (AtNF-YC-3) with e-value of 1.9e-118 and BLAST sequence identity of 100.0
  misc_feature: SWISSPROT Homolog: NFYC9_ARATH Nuclear transcription factor Y subunit C-9 (AtNF-YC-9) (Transcriptional activator HAP5C) with e-value of 5.7e-96 and BLAST sequence identity of 82.7
  misc_feature: SWISSPROT Homolog: NFYC1_ARATH Nuclear transcription factor Y subunit C-1 (AtNF-YC-1) (Transcriptional activator HAP5A) with e-value of 5.1e-56 and BLAST sequence identity of 58.6
  misc_feature: SWISSPROT Homolog: NFYC2_ARATH Nuclear transcription factor Y subunit C-2 (AtNF-YC-2) (Transcriptional activator HAP5B) with e-value of 2.5e-55 and BLAST sequence identity of 63.2
  misc_feature: SWISSPROT Homolog: NFYC4_ARATH Nuclear transcription factor Y subunit C-4 (AtNF-YC-4) with e-value of 1.4e-53 and BLAST sequence identity of 63.9
  misc_feature 162508:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(226): Functional Homolog of  Ceres CLONE ID no. 36272 at SEQ ID NO. 1537 with e-value of 1.49E-64 and BLAST sequence identity of 66.8
MMGPSATGSLQSPTQPAVLTASSAHLAQHQLAYQHIHHQQQQQLQQQLQTFWANQYQEIEQTTDFKNHSLPLARIKKIMKADEDVRMISAEAPIIFARACEMFILELTLRSWNHTEENKRRTLQKNDIAAAITRTDIFDFLVDIVPREDLKDEVLASVPRGSLPVGGPADALPYYYMPPQLAPQVSAPGMTVGKPVVDQAFYGQQSRPYVPQQIWPQQTQQPPEDS

SEQ ID NO: 1498 - DNA, 777 bp, Populus balsamifera subsp. trichocarpa
  misc_feature (1)..(777): Ceres ANNOT ID no. 1470275
  misc_feature 162586:<222: Transcription Factor
  misc_feature: Phenotype: Activates expression of the gene endogenous to the AtDXPR (SEQ ID NO 4143) regalutory region Useful for modulating Terpenoid Biosynthesis
atggaccagcaaggccatgggcagcctccaacagtaggcatgattggaaggacagctccggttccttatggaatggcttcatatcaacctaaccagatgatgggaccttctgcaactggatcagttcaatctcctactcaaccagcagttcttgctgctgcttcagctcagcttgctcaacaccaacttgcttaccagcacatccaccagcaacagcagcaacagttgcagcaacaacttcaaactttctgggcaaatcagtatcaagaaattgagcagactgctgattttaagaaccatagcctgcccttggctaggattaagaagattatgaaggcagatgaagatgtaaggatgatatcagctgaagctcctgtcatatttgccagggcctgtgagatgtttattttagaactgacattgcgttcttggaatcacacagaggagaacaaaaggagaacactccaaaagaatgacattgctgcagcaattacaagaactgatatttttgattttctggttgatattgtcccaagggaggatttgaaagatgaggtgttagcatcagtcccaagagggagtcttccagttggaggtccacctgatgctcttccctactattacatgccacatcagcttgctccccaggtctctgctccggggatgactgtaggaaagcctgtggtggatcaatctctttatggccaacagtctcgcccttatgtggcacagcagatttggccacagcaaacaccgcagccacctgaagattcctga

SEQ ID NO: 1499 - protein, 234 aa, Populus balsamifera subsp. trichocarpa
  misc_feature (1)..(234): Ceres ANNOT ID no. 1470275
  misc_feature (76)..(140): Pfam Name: CBFD_NFYB_HMF Pfam Description: Histone-like transcription factor CBF/NF-Y) and archaeal histone
  misc_feature: SWISSPROT Homolog: NFYC3_ARATH Nuclear transcription factor Y subunit C-3 (AtNF-YC-3) with e-value of 1.9e-118 and BLAST sequence identity of 100.0
  misc_feature: SWISSPROT Homolog: NFYC9_ARATH Nuclear transcription factor Y subunit C-9 (AtNF-YC-9) (Transcriptional activator HAP5C) with e-value of 5.7e-96 and BLAST sequence identity of 82.7
  misc_feature: SWISSPROT Homolog: NFYC1_ARATH Nuclear transcription factor Y subunit C-1 (AtNF-YC-1) (Transcriptional activator HAP5A) with e-value of 5.1e-56 and BLAST sequence identity of 58.6
  misc_feature: SWISSPROT Homolog: NFYC2_ARATH Nuclear transcription factor Y subunit C-2 (AtNF-YC-2) (Transcriptional activator HAP5B) with e-value of 2.5e-55 and BLAST sequence identity of 63.2
  misc_feature: SWISSPROT Homolog: NFYC4_ARATH Nuclear transcription factor Y subunit C-4 (AtNF-YC-4) with e-value of 1.4e-53 and BLAST sequence identity of 63.9
  misc_feature 162684:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(234): Functional Homolog of  Ceres CLONE ID no. 36272 at SEQ ID NO. 1537 with e-value of 1.30E-63 and BLAST sequence identity of 72.6
MASYQPNQMMGPSATGSVQSPTQPAVLAAASAQLAQHQLAYQHIHQQQQQQLQQQLQTFWANQYQEIEQTADFKNHSLPLARIKKIMKADEDVRMISAEAPVIFARACEMFILELTLRSWNHTEENKRRTLQKNDIAAAITRTDIFDFLVDIVPREDLKDEVLASVPRGSLPVGGPPDALPYYYMPHQLAPQVSAPGMTVGKPVVDQSLYGQQSRPYVAQQIWPQQTPQPPEDS

SEQ ID NO: 1500 - protein, 472 aa, Arabidopsis thaliana
  misc_feature (1)..(472): Ceres CLONE ID no. 36334
  misc_feature (205)..(467): Pfam Name: p450 Pfam Description: Cytochrome P450
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MAFTAFLLLLSSIAAGFLLLLRRTRYRRMGLPPGSLGLPLIGETFQLIGAYKTENPEPFIDERVARYGSVFMTHLFGEPTIFSADPETNRFVLQNEGKLFECSYPASICNLLGKHSLLLMKGSLHKRMHSLTMSFANSSIIKDHLMLDIDRLVRFNLDSWSSRVLLMEEAKKITFELTVKQLMSFDPGEWSESLRKEYLLVIEGFFSLPLPLFSTTYRKAIQARRKVAEALTVVVMKRREEEEEGAERKKDMLAALLAADDGFSDEEIVDFLVALLVAGYETTSTIMTLAVKFLTETPLALAQLKEEHEKIRAMKSDSYSLEWSDYKSMPFTQCVVNETLRVANIIGGVFRRAMTDVEIKGYKIPKGWKVFSSFRAVHLDPNHFKDARTFNPWRWQSNSVTTGPSNVFTPFGGGPRLCPGYELARVALSVFLHRLVTGFSWVPAEQDKLVFFPTTRTQKRYPIFVKRRDFAT

SEQ ID NO: 1501 - DNA, 1431 bp, Populus balsamifera subsp. trichocarpa
  misc_feature (1)..(1431): Ceres ANNOT ID no. 1464715
  misc_feature 162887:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcggttatttctctttatttggttttctttgtggttctcccggcgatagtccttatcgctcaccggagttcgcggtgccgacggctccggttgccgccggggagtttgggtctgccctttgttggggagactctacagttgatatctgcatacaagaccgagaaccctgaaccgtttatagatgagcgggtgagccggttcggttcgttgtttacgacccatgttttcggtgaacccactgttttttctgttgatccggaaacgaaccggttcatcatgcaaaatgaagggaagttgtttgagtgtagttacccgggttcgataagcaacttgctgggaaaacactccttgttgttgatgaagggcagtcttcacaaaagaatgcactctttgaccatgagttttgctaactcttcaatcattagagaccatcttctggttgatatagaccggttgatccgtctcaatttagattcctggtctgaccgggttcttctcatggaggaggccaagaagattacatttgagttgacaatgaagcagctaatgagctttgatccatgtgaatggaccgagagtctaagaaaagagtacgttcttgttattgaaggctttttcagtgtgccactacccatcttttcccccacttaccgcagagctatcaaagctaggactaaggtggcagaggctttgagcttggtagtgaagcaaaggaggatagagagtgagtcaggagagaaaaggaaggacatgctggcagctcttgtagcttcagatgatcatggcagcttctcggacgaggaaatagtggatttcttggtagctttgcttgtcgcaggctatgaaactacatctactagcatgactcttgctgtcaagttcctcactgagacacctctcgctttggctcagatcacggaggagcatgaacagattagagcaaagaagggtgagggggaagctcttgagtggagtgattacaagtcaatgaccttcactcaatgcgttgttaatgagacgctgagaatcgcgaacattataggtgggatatttagacgaacgatgacagatatcaatgtaaaaggctatacaattcctaaaggatggaaggtttttgcatcctttcgtggtgtgcatttagaccacgaatactttaaagatgctcggactttcaatccatggagatggcagaacaactcgggggcaacatgcccagcaaatgtgttcactccatttggaggagggcaacggctatgcccaggatatgagcttgctagagtagaactctctgttttccttcaccacctagtcacccgtttcagttggactccagctggagaagataagctggttttctttccaactacacggacacagaagcgatatcccatcaatgtgcagcgtcgagatcgtgtccaagccatgtaa

SEQ ID NO: 1502 - protein, 476 aa, Populus balsamifera subsp. trichocarpa
  misc_feature (1)..(476): Ceres ANNOT ID no. 1464715
  misc_feature (33)..(101): Pfam Name: p450 Pfam Description: Cytochrome P450
  misc_feature: SWISSPROT Homolog: C90A1_ARATH Cytochrome P450 90A1 (EC 1.14.-.-) with e-value of 1.4e-252 and BLAST sequence identity of 100.0
  misc_feature: SWISSPROT Homolog: C90B1_ARATH Cytochrome P450 90B1 (EC 1.14.-.-) (Steroid 22-alpha-hydroxylase) (Dwarf4) (Dwarf protein 4) with e-value of 9.3e-99 and BLAST sequence identity of 39.3
  misc_feature: SWISSPROT Homolog: C90D2_ORYSA Cytochrome P450 90D2 (EC 1.14.-.-) (C6-oxidase) with e-value of 5.3e-93 and BLAST sequence identity of 42.1
  misc_feature: SWISSPROT Homolog: C90C1_ARATH Cytochrome P450 90C1 (EC 1.14.-.-) (ROTUNDIFOLIA3) with e-value of 2.4e-90 and BLAST sequence identity of 42.9
  misc_feature: SWISSPROT Homolog: C724B_ORYSA Cytochrome P450 724B1 (EC 1.14.-.-) (OsDWARF11) (Dwarf protein 11) with e-value of 6.8e-84 and BLAST sequence identity of 39.0
  misc_feature 163013:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(476): Functional Homolog of  Ceres CLONE ID no. 36334 at SEQ ID NO. 1544 with e-value of 2.09E-198 and BLAST sequence identity of 79.0
MAVISLYLVFFVVLPAIVLIAHRSSRCRRLRLPPGSLGLPFVGETLQLISAYKTENPEPFIDERVSRFGSLFTTHVFGEPTVFSVDPETNRFIMQNEGKLFECSYPGSISNLLGKHSLLLMKGSLHKRMHSLTMSFANSSIIRDHLLVDIDRLIRLNLDSWSDRVLLMEEAKKITFELTMKQLMSFDPCEWTESLRKEYVLVIEGFFSVPLPIFSPTYRRAIKARTKVAEALSLVVKQRRIESESGEKRKDMLAALVASDDHGSFSDEEIVDFLVALLVAGYETTSTSMTLAVKFLTETPLALAQITEEHEQIRAKKGEGEALEWSDYKSMTFTQCVVNETLRIANIIGGIFRRTMTDINVKGYTIPKGWKVFASFRGVHLDHEYFKDARTFNPWRWQNNSGATCPANVFTPFGGGQRLCPGYELARVELSVFLHHLVTRFSWTPAGEDKLVFFPTTRTQKRYPINVQRRDRVQAM

SEQ ID NO: 1503 - DNA, 1419 bp, Populus balsamifera subsp. trichocarpa
  misc_feature (1)..(1419): Ceres ANNOT ID no. 1511511
  misc_feature 163143:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcggtttctgtttgtcttgttctctttattgttctcccagcgatagtctttatcgttcacaggagttcccggttccggaggctccggctgccgccggggagtttgggtctgccctttgttggagagactctacagctgatatctgcatacaagactgagaaccctgaaccgtttatagatgagcgggtgaaccggttcggttcgttgtttaaaacccatatttttggtgaaccgaccgttttttctgttgacccggaaacgaacaggttcattttgcaaaatgaagggaagctgtttgagtgtagttaccccggttcgataagcaacctgctgggaaaacattctttgttgctaatgacgggtaatcttcacaaaaaaatgcattccttaaccatgagtttcgctaactcttcaatcatcagagaccatctcttggtcgatatagaccggttgatccgtctcaatttagattcttggtccgaccgggttcttctcatggaggaggccaagaagactacatttgagttgacaatgaagcagctaatgagctttgatccatgtgaatggaccgagagtctgagaagagagtacgtgcttgttattgaaggctttttcagcgtgcctctacccatcctttcccccacataccgcagagctatcaaagctaggactaaggtggcagaggctttgagtttggtagtgaagcaaaggaggatagagagtgagtcaggagagaaaaagaaagacatgcttggagctcttttagcttcagatgatcatggaggcttctcggacgaggagatagtagatttcttggtggctctgcttgttgcaggctatgaaactacatctacaagcatgactcttgctgttaagttcctcaccgagacacctctggctctggctcagatcaaggaggagcatgaacagattagaggaaagaagggcgaggagggagctcttgagtggagtgattacaagtcaatgaccttcactcagtgtgttgttaatgagactttgagaatagcaaacataataggtgggatatttagacgaacaatgacagatataaatgttaaaggttatacaattcctaaaggatggaaggtttttgcatcctttcgtggtgtacatttagaccatgaatacttcaaagatgctcgaactttcaatccgtggagatggcaggacgactcgggggcaacatgcccagcaaatgtgttcactccttttggaggagggcaacggttatgcccaggatatgaacttgctagagtagaactctctgttttccttcaccacctggtcacccgtttcagttggaccccagctgaacaagacaagctggttttctttccaactacgcggacacaaaagcgatatcccatcaatgtgcagcgtcgaaatcgtgtctaa

SEQ ID NO: 1504 - protein, 472 aa, Populus balsamifera subsp. trichocarpa
  misc_feature (1)..(472): Ceres ANNOT ID no. 1511511
  misc_feature (32)..(100): Pfam Name: p450 Pfam Description: Cytochrome P450
  misc_feature: SWISSPROT Homolog: C90A1_ARATH Cytochrome P450 90A1 (EC 1.14.-.-) with e-value of 1.4e-252 and BLAST sequence identity of 100.0
  misc_feature: SWISSPROT Homolog: C90B1_ARATH Cytochrome P450 90B1 (EC 1.14.-.-) (Steroid 22-alpha-hydroxylase) (Dwarf4) (Dwarf protein 4) with e-value of 9.3e-99 and BLAST sequence identity of 39.3
  misc_feature: SWISSPROT Homolog: C90D2_ORYSA Cytochrome P450 90D2 (EC 1.14.-.-) (C6-oxidase) with e-value of 5.3e-93 and BLAST sequence identity of 42.1
  misc_feature: SWISSPROT Homolog: C90C1_ARATH Cytochrome P450 90C1 (EC 1.14.-.-) (ROTUNDIFOLIA3) with e-value of 2.4e-90 and BLAST sequence identity of 42.9
  misc_feature: SWISSPROT Homolog: C724B_ORYSA Cytochrome P450 724B1 (EC 1.14.-.-) (OsDWARF11) (Dwarf protein 11) with e-value of 6.8e-84 and BLAST sequence identity of 39.0
  misc_feature 163269:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(472): Functional Homolog of  Ceres CLONE ID no. 36334 at SEQ ID NO. 1544 with e-value of 1.49E-197 and BLAST sequence identity of 77.7
MAVSVCLVLFIVLPAIVFIVHRSSRFRRLRLPPGSLGLPFVGETLQLISAYKTENPEPFIDERVNRFGSLFKTHIFGEPTVFSVDPETNRFILQNEGKLFECSYPGSISNLLGKHSLLLMTGNLHKKMHSLTMSFANSSIIRDHLLVDIDRLIRLNLDSWSDRVLLMEEAKKTTFELTMKQLMSFDPCEWTESLRREYVLVIEGFFSVPLPILSPTYRRAIKARTKVAEALSLVVKQRRIESESGEKKKDMLGALLASDDHGGFSDEEIVDFLVALLVAGYETTSTSMTLAVKFLTETPLALAQIKEEHEQIRGKKGEEGALEWSDYKSMTFTQCVVNETLRIANIIGGIFRRTMTDINVKGYTIPKGWKVFASFRGVHLDHEYFKDARTFNPWRWQDDSGATCPANVFTPFGGGQRLCPGYELARVELSVFLHHLVTRFSWTPAEQDKLVFFPTTRTQKRYPINVQRRNRV

SEQ ID NO: 1505 - protein, 368 aa, Arabidopsis thaliana
  misc_feature (1)..(368): Ceres CLONE ID no. 36518
  misc_feature (215)..(357): Pfam Name: S-AdoMet_synt_C Pfam Description: S-adenosylmethionine synthetase C-terminal domain
  misc_feature (62)..(77): Pfam Name: S-AdoMet_synt_N Pfam Description: S-adenosylmethionine synthetase N-terminal domain
  misc_feature (91)..(213): Pfam Name: S-AdoMet_synt_M Pfam Description: S-adenosylmethionine synthetase, central domain
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (294)..(294): Xaa is any aa, unknown, or other
MQSLMPALSKTLIAKLLVRHAPRPTWSWFSVRSPPRLRLTTRRLSVTLAVPLDSSLTMLVLMHKCKVLVNIEQQSPDIAQGVHGHFTKRPEDIGAGDQGHMFGYATDETPELMPLSHVLATKIGARLTEVRKNGTCRWLRPDGKTQVTVEYYNDNGAMVPVRVHTVLISTQHDETVTNDEIARDLKEHVIKPIIPEKYLDDKTIFHLNPSGRFVIGGPHGDAGLTGRKIIIDTYGGWGAHGGGAFSGKDPTKVDRSGAYIVRQAAKSVVANGMARRALVQVSYAIGVPEPLSVXVDTYGTGLIPDKEILKIVKETFDFRPGMMTINLDLKRGGNGRFQKTAAYGHFGRDDPDFTWEVVKPLKWDKPQA

SEQ ID NO: 1506 - DNA, 1179 bp, Populus balsamifera subsp. trichocarpa
  misc_feature (1)..(1179): Ceres ANNOT ID no. 1471507
  misc_feature 163546:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggaaacctttctattcacatccgagtcagtgaacgagggccaccccgacaaactatgcgaccagatctctgatgcggtgctcgatgcttgccttgagcaggacccagacagcaaggttgcttgcgagacatgtacaaagaccaacatggtcatggtctttggagagatcacgaccaagggcaagatagactatgaaaagattgttcgtgacacatgccgtaacattggatttatttctgatgatgttggtcttgatgctgacaagtgcaaagtcttggttaacattgagcagcagagccctgatattgcccagggtgtccacggtcactttaccaagcggccagaggagattggtgctggtgaccagggccatatgtttggttatgccaccgatgagacccctgagtatatgcctttgagccatgtacttgccaccaagctcggggctcgcctcactgaagttaggaagaatggcacctgcccttggctaagacctgatggcaagacgcaggttactgttgaatactacaatgacaacggtgcaatggtccctgtccgtgtccacactgttctcatctccactcagcatgatgagactgtcacaaatgatgaaattgctgctgatctaaaggagcatgtcattaagcctgtcatccctgagaagtaccttgatgagaaaactatcttccacctaaacccatctggccgttttgttattggtggccctcatggtgatgcaggtctcactggacgcaagatcattattgacacctacggtggctggggagcccatggtggtggtgctttctcagggaaggacccaactaaggtggatagaagtggtgcttacattgttaggcaggctgccaagagcatcgtagcaaatggtcttgctcgtaggtgcattgtgcaagtctcctatgctattggtgtacccgagcctttgtctgtctttgtggacacctatggcactggaaaaattcctgacaaggagatccttaagattgtgaaggagaactttgactttaggcctggaatgatgaccatcaacctggatctcaagaggggtggcaataggttcttgaagacagccgcatacggacattttggaagggatgacccagacttcacctgggaggttgtcaagcccctcaaatgggagaagccccaagcttga

SEQ ID NO: 1507 - protein, 341 aa, Populus balsamifera subsp. trichocarpa
  misc_feature (1)..(341): Ceres ANNOT ID no. 1471507
  misc_feature (1)..(51): Pfam Name: S-AdoMet_synt_N Pfam Description: S-adenosylmethionine synthetase N-terminal domain
  misc_feature (189)..(330): Pfam Name: S-AdoMet_synt_C Pfam Description: S-adenosylmethionine synthetase C-terminal domain
  misc_feature (65)..(187): Pfam Name: S-AdoMet_synt_M Pfam Description: S-adenosylmethionine synthetase, central domain
  misc_feature: SWISSPROT Homolog: METL_ARATH S-adenosylmethionine synthetase 2 (EC 2.5.1.6) (Methionine adenosyltransferase 2) (AdoMet synthetase 2) with e-value of 7.3e-167 and BLAST sequence identity of 99.7
  misc_feature: SWISSPROT Homolog: METK_BRAJU S-adenosylmethionine synthetase (EC 2.5.1.6) (Methionine adenosyltransferase) (AdoMet synthetase) with e-value of 2.9e-163 and BLAST sequence identity of 97.4
  misc_feature: SWISSPROT Homolog: METK_ARATH S-adenosylmethionine synthetase 1 (EC 2.5.1.6) (Methionine adenosyltransferase 1) (AdoMet synthetase 1) with e-value of 1.8e-161 and BLAST sequence identity of 96.1
  misc_feature: SWISSPROT Homolog: METL_LYCES S-adenosylmethionine synthetase 2 (EC 2.5.1.6) (Methionine adenosyltransferase 2) (AdoMet synthetase 2) with e-value of 8.5e-157 and BLAST sequence identity of 92.4
  misc_feature: SWISSPROT Homolog: METK_LYCES S-adenosylmethionine synthetase 1 (EC 2.5.1.6) (Methionine adenosyltransferase 1) (AdoMet synthetase 1) with e-value of 1.6e-155 and BLAST sequence identity of 92.4
  misc_feature 163699:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(341): Functional Homolog of  Ceres CLONE ID no. 36518 at SEQ ID NO. 1549 with e-value of 7.09E-159 and BLAST sequence identity of 94.7
MVFGEITTKGKIDYEKIVRDTCRNIGFISDDVGLDADKCKVLVNIEQQSPDIAQGVHGHFTKRPEEIGAGDQGHMFGYATDETPEYMPLSHVLATKLGARLTEVRKNGTCPWLRPDGKTQVTVEYYNDNGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIVRQAAKSIVANGLARRCIVQVSYAIGVPEPLSVFVDTYGTGKIPDKEILKIVKENFDFRPGMMTINLDLKRGGNRFLKTAAYGHFGRDDPDFTWEVVKPLKWEKPQA

SEQ ID NO: 1508 - DNA, 1179 bp, Populus balsamifera subsp. trichocarpa
  misc_feature (1)..(1179): Ceres ANNOT ID no. 1444893
  misc_feature 163826:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggaaacctttctattcacctctgagtcagtgaatgagggccaccctgacaaactatgtgaccagatctctgatgcagtgctcgatgcctgccttgagcaggacccagacagcaaggttgcttgcgagacatgtacaaagacaaacatggtcatggtctttggagagatcaccaccaagggaaagatagactatgaaaagattgttcgtgacacatgccgtaacattggatttgtttctgacgacgttggtcttgatgctgacaagtgcaaagtattggttaacattgagcaacagagcccggatattgcccagggtgtccacggtcactttaccaagcgcccagaggagattggtgctggtgaccagggccatatgtttggttatgccactgatgagacccccgagtatatgcctttgagccatgttcttgccaccaagcttggtgctcgcctcaccgaggttaggaagaatggaacctgcccttggttaagacctgatggcaagactcaagttactgttgagtacttcaatgacaatggtgcaatggtccctgttcgtgtccacactgttctcatctctactcagcatgatgagactgtcacaaatgatgaaattgccgctgatctaaaggagtatgtcatcaagcctgttatcccggagaagtaccttgatgagaaaactatctttcacctcaacccatctggccgttttgttattggtggtcctcatggtgatgcaggtctcactggacgcaagatcattattgacacctatggtggctggggagcccatggtggtggtgctttctcagggaaggacccaactaaggtggataggagtggtgcttacattgttaggcaagctgccaagagcatcgtagcaaatggtcttgctcgtaggtgcattgtgcaagtttcctatgctattggtgtacctgagcctttgtcagtctttgtggacacctatggcactggaaaaattcctgacaaggagatccttaagattgtgaaggagagctttgactttaggcctggaatgatgaccatcaacctggatctcaagagggggggtaataggttcttgaagacagctgcatacggacattttggaagggatgacccagacttcacctgggaagttgtcaagcccctcaaatgggagaagcctcaagcttaa

SEQ ID NO: 1509 - protein, 341 aa, Populus balsamifera subsp. trichocarpa
  misc_feature (1)..(341): Ceres ANNOT ID no. 1444893
  misc_feature (1)..(51): Pfam Name: S-AdoMet_synt_N Pfam Description: S-adenosylmethionine synthetase N-terminal domain
  misc_feature (189)..(330): Pfam Name: S-AdoMet_synt_C Pfam Description: S-adenosylmethionine synthetase C-terminal domain
  misc_feature (65)..(187): Pfam Name: S-AdoMet_synt_M Pfam Description: S-adenosylmethionine synthetase, central domain
  misc_feature: SWISSPROT Homolog: METL_ARATH S-adenosylmethionine synthetase 2 (EC 2.5.1.6) (Methionine adenosyltransferase 2) (AdoMet synthetase 2) with e-value of 7.3e-167 and BLAST sequence identity of 99.7
  misc_feature: SWISSPROT Homolog: METK_BRAJU S-adenosylmethionine synthetase (EC 2.5.1.6) (Methionine adenosyltransferase) (AdoMet synthetase) with e-value of 2.9e-163 and BLAST sequence identity of 97.4
  misc_feature: SWISSPROT Homolog: METK_ARATH S-adenosylmethionine synthetase 1 (EC 2.5.1.6) (Methionine adenosyltransferase 1) (AdoMet synthetase 1) with e-value of 1.8e-161 and BLAST sequence identity of 96.1
  misc_feature: SWISSPROT Homolog: METL_LYCES S-adenosylmethionine synthetase 2 (EC 2.5.1.6) (Methionine adenosyltransferase 2) (AdoMet synthetase 2) with e-value of 8.5e-157 and BLAST sequence identity of 92.4
  misc_feature: SWISSPROT Homolog: METK_LYCES S-adenosylmethionine synthetase 1 (EC 2.5.1.6) (Methionine adenosyltransferase 1) (AdoMet synthetase 1) with e-value of 1.6e-155 and BLAST sequence identity of 92.4
  misc_feature 163979:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(341): Functional Homolog of  Ceres CLONE ID no. 36518 at SEQ ID NO. 1549 with e-value of 6.39E-158 and BLAST sequence identity of 94.0
MVFGEITTKGKIDYEKIVRDTCRNIGFVSDDVGLDADKCKVLVNIEQQSPDIAQGVHGHFTKRPEEIGAGDQGHMFGYATDETPEYMPLSHVLATKLGARLTEVRKNGTCPWLRPDGKTQVTVEYFNDNGAMVPVRVHTVLISTQHDETVTNDEIAADLKEYVIKPVIPEKYLDEKTIFHLNPSGRFVIGGPHGDAGLTGRKIIIDTYGGWGAHGGGAFSGKDPTKVDRSGAYIVRQAAKSIVANGLARRCIVQVSYAIGVPEPLSVFVDTYGTGKIPDKEILKIVKESFDFRPGMMTINLDLKRGGNRFLKTAAYGHFGRDDPDFTWEVVKPLKWEKPQA

SEQ ID NO: 1510 - DNA, 1188 bp, Populus balsamifera subsp. trichocarpa
  misc_feature (1)..(1188): Ceres ANNOT ID no. 1458642
  misc_feature 164106:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggcagagactttcctattcacatctgaatcagtgaatgagggacacccagataagctctgtgaccagatctctgatgccgtactcgatgcttgcttggcgcaagaccctgacagcaaggtggcatgcgagacttgcactaagaccaacatggtcatggtttttggcgagatcaccaccaaggctgatgtagattacgagaagattgtgcgtgatacttgcagaaacattggattcacatctgccgatgtgggtcttgatgccgacaattgcaaggttctagttaacattgagcaacaaagtcctgatattgcccagggtgtacatggtcatttctccaagagaccggaagagattggtgctggtgatcaaggccatatgtttggctatgccactgacgagacccctgaattgatgcctttgagccacgttttggctaccaagcttggtgctcgcctcactgaggttcgtaagaatggaacttgcgcatggttgaggcctgatggaaaaacccaagttactgttgagtactacaatgaaaatggagccatggttcctatccgcgtccacactgttctcatttctactcaacatgatgagactgtgacaaatgatgagattgcggctgatctcaaggagcatgtcatcaagcccgtgatccctgaaaagtacttggatgagaagactatcttccatcttaacccttctggccgtttcgtcattggtggtcctcatggtgatgctggtctcaccgggcgtaagatcattattgacacttatggtggatggggtgctcatggtggtggtgccttctctggaaaagacccaaccaaggtggataggagcggagcttacattgtcaggcaagccgccaagagtattgttgccagtgggcttgctaggaggtgcattgttcaggtctcctatgccattggtgttcctgagcctctgtcagtatttgtagacacttatggcactggaaagattcctgacaaagagatccttcagatcgtgaaggagagctttgatttcagacctggtatgatttccatcaatcttgacctcaagagaggtggcaatagcaggttcttgaagactgcagcatatggacactttggcagagatgaccccgacttcacatgggaggtggtgaagcccctcaagtgggacaataaggtccaagcttaa

SEQ ID NO: 1511 - protein, 343 aa, Populus balsamifera subsp. trichocarpa
  misc_feature (1)..(343): Ceres ANNOT ID no. 1458642
  misc_feature (1)..(51): Pfam Name: S-AdoMet_synt_N Pfam Description: S-adenosylmethionine synthetase N-terminal domain
  misc_feature (189)..(331): Pfam Name: S-AdoMet_synt_C Pfam Description: S-adenosylmethionine synthetase C-terminal domain
  misc_feature (65)..(187): Pfam Name: S-AdoMet_synt_M Pfam Description: S-adenosylmethionine synthetase, central domain
  misc_feature: SWISSPROT Homolog: METL_ARATH S-adenosylmethionine synthetase 2 (EC 2.5.1.6) (Methionine adenosyltransferase 2) (AdoMet synthetase 2) with e-value of 7.3e-167 and BLAST sequence identity of 99.7
  misc_feature: SWISSPROT Homolog: METK_BRAJU S-adenosylmethionine synthetase (EC 2.5.1.6) (Methionine adenosyltransferase) (AdoMet synthetase) with e-value of 2.9e-163 and BLAST sequence identity of 97.4
  misc_feature: SWISSPROT Homolog: METK_ARATH S-adenosylmethionine synthetase 1 (EC 2.5.1.6) (Methionine adenosyltransferase 1) (AdoMet synthetase 1) with e-value of 1.8e-161 and BLAST sequence identity of 96.1
  misc_feature: SWISSPROT Homolog: METL_LYCES S-adenosylmethionine synthetase 2 (EC 2.5.1.6) (Methionine adenosyltransferase 2) (AdoMet synthetase 2) with e-value of 8.5e-157 and BLAST sequence identity of 92.4
  misc_feature: SWISSPROT Homolog: METK_LYCES S-adenosylmethionine synthetase 1 (EC 2.5.1.6) (Methionine adenosyltransferase 1) (AdoMet synthetase 1) with e-value of 1.6e-155 and BLAST sequence identity of 92.4
  misc_feature 164259:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(343): Functional Homolog of  Ceres CLONE ID no. 36518 at SEQ ID NO. 1549 with e-value of 8.39E-156 and BLAST sequence identity of 92.4
MVFGEITTKADVDYEKIVRDTCRNIGFTSADVGLDADNCKVLVNIEQQSPDIAQGVHGHFSKRPEEIGAGDQGHMFGYATDETPELMPLSHVLATKLGARLTEVRKNGTCAWLRPDGKTQVTVEYYNENGAMVPIRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIVRQAAKSIVASGLARRCIVQVSYAIGVPEPLSVFVDTYGTGKIPDKEILQIVKESFDFRPGMISINLDLKRGGNSRFLKTAAYGHFGRDDPDFTWEVVKPLKWDNKVQA

SEQ ID NO: 1512 - DNA, 1182 bp, Populus balsamifera subsp. trichocarpa
  misc_feature (1)..(1182): Ceres ANNOT ID no. 1522497
  misc_feature 164386:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggaaacctttttgttcacttctgaatctgtgaacgagggtcaccccgacaagctctgtgatcaagtttcggatgcaatcctagatgcctgccttgagcaagatccagacagcaaggttgcatgtgagacttgcaccaagacgaacatggtcatggtctttggagaaatcaccacaaaagcgaatgtagattatgagaagattgtgcgcagcacttgccgttcaataggatttgtctctgatgatgttggtcttgatgcggacaaatgcaatgtcttggttaacattgagcagcagagccctgatattgcacagggtgtccatggtcatcttacaaagcgccctgaggagattggtgctggtgaccaaggtcacatgtttggctatgccaccgatgagacccctgagcttatgccccttagtcatgttcttgccaccaagctcggtgcccgccttactgaagttcgcaagaatggaacctgcccttggttgagacctgatggcaaaacacaagtcacggtcgagtacttcaatgaaaatggtgctatggttccaatacgggtgcacactgttctaatctctacgcaacatgatgaaactgttactaatgatgagattgctgctgacctcaaagagcacgttattaagcctgtcatccctgagaagtatcttgacgagaagaccattttccacctcaacccatcagggcggtttgtcattggtggaccacacggtgatgctggacttactggtcgtaaaattattatcgatacttatggtggttggggagcacatggtggtggtgccttctccggcaaggaccctactaaggtagacaggagtggtgcctacattgttagacaggcagcaaagagcattgttgcaagtggccttgctcgccgatgcattgttcaggtctcttatgctatcggtgtgccagaacctctgtcagtttttgttgacacatatgggactggaaagatcccagacaaggagattctcaacatcgtgaaggaaaaatttgacttcaggcctggaatgatagccattagcttggatcttaagaggggtggcaatggcaggttcttgaagacagctgcttatggtcactttggaagggacgaccctgacttcacatgggaggtagtgaagcccctcaaatctgagaagccccaacagtaa

SEQ ID NO: 1513 - protein, 342 aa, Populus balsamifera subsp. trichocarpa
  misc_feature (1)..(342): Ceres ANNOT ID no. 1522497
  misc_feature (1)..(51): Pfam Name: S-AdoMet_synt_N Pfam Description: S-adenosylmethionine synthetase N-terminal domain
  misc_feature (189)..(331): Pfam Name: S-AdoMet_synt_C Pfam Description: S-adenosylmethionine synthetase C-terminal domain
  misc_feature (65)..(187): Pfam Name: S-AdoMet_synt_M Pfam Description: S-adenosylmethionine synthetase, central domain
  misc_feature: SWISSPROT Homolog: METL_ARATH S-adenosylmethionine synthetase 2 (EC 2.5.1.6) (Methionine adenosyltransferase 2) (AdoMet synthetase 2) with e-value of 7.3e-167 and BLAST sequence identity of 99.7
  misc_feature: SWISSPROT Homolog: METK_BRAJU S-adenosylmethionine synthetase (EC 2.5.1.6) (Methionine adenosyltransferase) (AdoMet synthetase) with e-value of 2.9e-163 and BLAST sequence identity of 97.4
  misc_feature: SWISSPROT Homolog: METK_ARATH S-adenosylmethionine synthetase 1 (EC 2.5.1.6) (Methionine adenosyltransferase 1) (AdoMet synthetase 1) with e-value of 1.8e-161 and BLAST sequence identity of 96.1
  misc_feature: SWISSPROT Homolog: METL_LYCES S-adenosylmethionine synthetase 2 (EC 2.5.1.6) (Methionine adenosyltransferase 2) (AdoMet synthetase 2) with e-value of 8.5e-157 and BLAST sequence identity of 92.4
  misc_feature: SWISSPROT Homolog: METK_LYCES S-adenosylmethionine synthetase 1 (EC 2.5.1.6) (Methionine adenosyltransferase 1) (AdoMet synthetase 1) with e-value of 1.6e-155 and BLAST sequence identity of 92.4
  misc_feature 164539:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(342): Functional Homolog of  Ceres CLONE ID no. 36518 at SEQ ID NO. 1549 with e-value of 2.59E-154 and BLAST sequence identity of 91.4
MVFGEITTKANVDYEKIVRSTCRSIGFVSDDVGLDADKCNVLVNIEQQSPDIAQGVHGHLTKRPEEIGAGDQGHMFGYATDETPELMPLSHVLATKLGARLTEVRKNGTCPWLRPDGKTQVTVEYFNENGAMVPIRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIVRQAAKSIVASGLARRCIVQVSYAIGVPEPLSVFVDTYGTGKIPDKEILNIVKEKFDFRPGMIAISLDLKRGGNGRFLKTAAYGHFGRDDPDFTWEVVKPLKSEKPQQ

SEQ ID NO: 1514 - DNA, 1242 bp, Populus balsamifera subsp. trichocarpa
  misc_feature (1)..(1242): Ceres ANNOT ID no. 1469105
  misc_feature 164666:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggttgtttatgcatctctagagataagagtagcttttgttgatcctctaatcgagagaatggaaacctttttgttcacttctgaatctgtgaacgagggtcaccccgacaagctctgtgatcaagtttcggatgcaatcctagatgcctgccttgagcaagatccagacagcaaggttgcatgtgagacttgcaccaagacgaacatggtcatggtctttggagaaatcaccacaaaagcgaatgtagattatgagaagattgtgcgcagcacttgccgttcaataggatttgtctctgatgatgttggtcttgatgcggacaaatgcaatgtcttggttaacattgagcagcagagccctgatattgcacagggtgtccatggtcatcttacaaagcgccctgaggagattggtgctggtgaccaaggtcacatgtttggctatgccaccgatgagacccctgagcttatgccccttagtcatgttcttgccaccaagctcggtgcccgccttactgaagttcgcaagaatggaacctgcccttggttgagacctgatggcaaaacacaagtcacggtcgagtacttcaatgaaaatggtgctatggttccaatacgggtgcacactgttctaatctctacgcaacatgatgaaactgttactaatgatgagattgctgctgacctcaaagagcacgttattaagcctgtcatccctgagaagtatcttgacgagaagaccattttccacctcaacccatcagggcggtttgtcattggtggaccacacggtgatgctggacttactggtcgtaaaattattatcgatacttatggtggttggggagcacatggtggtggtgccttctccggcaaggaccctactaaggtagacaggagtggtgcctacattgttagacaggcagcaaagagcattgttgcaagtggccttgctcgccgatgcattgttcaggtctcttatgctatcggtgtgccagaacctctgtcagtttttgttgacacatatgggactggaaagatcccagacaaggagattctcaacatcgtgaaggaaaaatttgacttcaggcctggaatgatagccattagcttggatcttaagaggggtggcaatggcaggttcttgaagacagctgcttatggtcactttggaagggacgaccctgacttcacatgggaggtagtgaagcccctcaaatctgagaagccccaacagtaa

SEQ ID NO: 1515 - protein, 344 aa, Populus balsamifera subsp. trichocarpa
  misc_feature (1)..(344): Ceres ANNOT ID no. 1469105
  misc_feature (1)..(53): Pfam Name: S-AdoMet_synt_N Pfam Description: S-adenosylmethionine synthetase N-terminal domain
  misc_feature (191)..(333): Pfam Name: S-AdoMet_synt_C Pfam Description: S-adenosylmethionine synthetase C-terminal domain
  misc_feature (67)..(189): Pfam Name: S-AdoMet_synt_M Pfam Description: S-adenosylmethionine synthetase, central domain
  misc_feature: SWISSPROT Homolog: METL_ARATH S-adenosylmethionine synthetase 2 (EC 2.5.1.6) (Methionine adenosyltransferase 2) (AdoMet synthetase 2) with e-value of 7.3e-167 and BLAST sequence identity of 99.7
  misc_feature: SWISSPROT Homolog: METK_BRAJU S-adenosylmethionine synthetase (EC 2.5.1.6) (Methionine adenosyltransferase) (AdoMet synthetase) with e-value of 2.9e-163 and BLAST sequence identity of 97.4
  misc_feature: SWISSPROT Homolog: METK_ARATH S-adenosylmethionine synthetase 1 (EC 2.5.1.6) (Methionine adenosyltransferase 1) (AdoMet synthetase 1) with e-value of 1.8e-161 and BLAST sequence identity of 96.1
  misc_feature: SWISSPROT Homolog: METL_LYCES S-adenosylmethionine synthetase 2 (EC 2.5.1.6) (Methionine adenosyltransferase 2) (AdoMet synthetase 2) with e-value of 8.5e-157 and BLAST sequence identity of 92.4
  misc_feature: SWISSPROT Homolog: METK_LYCES S-adenosylmethionine synthetase 1 (EC 2.5.1.6) (Methionine adenosyltransferase 1) (AdoMet synthetase 1) with e-value of 1.6e-155 and BLAST sequence identity of 92.4
  misc_feature 164821:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(344): Functional Homolog of  Ceres CLONE ID no. 36518 at SEQ ID NO. 1549 with e-value of 2.59E-154 and BLAST sequence identity of 91.4
MVMVFGEITTKANVDYEKIVRSTCRSIGFVSDDVGLDADKCNVLVNIEQQSPDIAQGVHGHLTKRPEEIGAGDQGHMFGYATDETPELMPLSHVLATKLGARLTEVRKNGTCPWLRPDGKTQVTVEYFNENGAMVPIRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIVRQAAKSIVASGLARRCIVQVSYAIGVPEPLSVFVDTYGTGKIPDKEILNIVKEKFDFRPGMIAISLDLKRGGNGRFLKTAAYGHFGRDDPDFTWEVVKPLKSEKPQQ

SEQ ID NO: 1516 - DNA, 1173 bp, Populus balsamifera subsp. trichocarpa
  misc_feature (1)..(1173): Ceres ANNOT ID no. 1484993
  misc_feature 164948:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atggataccttcctattcacctctgagtctgtaaatgaaggccacccagacaagctttgtgaccaggtctcggatgccatccttgatgcctgccttgcgcaagaccctgagagcaaggttgcctgtgagacctgctcaaagactaacatggtcatggtctttggtgagatcacaaccaaggctaacgtggactacgagaaaattgtccgggatacttgcagaggcattggcttcacatcagctgacgttggcctcgatgctgacaactgcaaggtccttgtcaacattgaacagcagagtcctgacatagcccaaggagttcatggacacctcaccaagaagcctgaggaaattggtgctggtgaccaaggccatatgtttggctatgctactgatgaaacacctgagctcatgccattaactcacgtcctcgccaccaagcttggtgccaagctaactgaggtgagaaagaacaagacatgcccatggttaaggcctgatgggaagacccaggttactgttgagtacaagaatgaaggtggagccatggtgcctatccgggttcacacgattcttatctcaacacaacatgatgagaatgtcactaatgagcagattgcagcggacctgaaagagcatgtgattaagcctgttatcccagttcaatatcttgatgacaagaccatcttccacctcaacccttctggtcggtttgttattggtgggcctcatggagatgcaggactcactggccgtaagattatcattgacacttatggtggatggggtgctcatggtggaggcgctttctcaggcaaggaccccacaaaggtggacagaagtggtgcatacattgttaggcaggctgccaagagtgtggtggcctctggtcttgctcggcgctgtattgtgcaggtctcttacgcaattggtgtgccagaaccattgtcagtttttgtggacacttacaagactggcaagattccagacagggatatcttggaattgatcaaggagaatttcgacttcaggcctggaatgattgctatcaacctcgacttgatgagaggaggcaattccaggtaccagaagactgctgcttatggccattttggacgtgatgacccagatttcacatgggagactgtcaagcttctcaagcccaatgcctaa

SEQ ID NO: 1517 - protein, 339 aa, Populus balsamifera subsp. trichocarpa
  misc_feature (1)..(339): Ceres ANNOT ID no. 1484993
  misc_feature (1)..(51): Pfam Name: S-AdoMet_synt_N Pfam Description: S-adenosylmethionine synthetase N-terminal domain
  misc_feature (189)..(331): Pfam Name: S-AdoMet_synt_C Pfam Description: S-adenosylmethionine synthetase C-terminal domain
  misc_feature (65)..(187): Pfam Name: S-AdoMet_synt_M Pfam Description: S-adenosylmethionine synthetase, central domain
  misc_feature: SWISSPROT Homolog: METL_ARATH S-adenosylmethionine synthetase 2 (EC 2.5.1.6) (Methionine adenosyltransferase 2) (AdoMet synthetase 2) with e-value of 7.3e-167 and BLAST sequence identity of 99.7
  misc_feature: SWISSPROT Homolog: METK_BRAJU S-adenosylmethionine synthetase (EC 2.5.1.6) (Methionine adenosyltransferase) (AdoMet synthetase) with e-value of 2.9e-163 and BLAST sequence identity of 97.4
  misc_feature: SWISSPROT Homolog: METK_ARATH S-adenosylmethionine synthetase 1 (EC 2.5.1.6) (Methionine adenosyltransferase 1) (AdoMet synthetase 1) with e-value of 1.8e-161 and BLAST sequence identity of 96.1
  misc_feature: SWISSPROT Homolog: METL_LYCES S-adenosylmethionine synthetase 2 (EC 2.5.1.6) (Methionine adenosyltransferase 2) (AdoMet synthetase 2) with e-value of 8.5e-157 and BLAST sequence identity of 92.4
  misc_feature: SWISSPROT Homolog: METK_LYCES S-adenosylmethionine synthetase 1 (EC 2.5.1.6) (Methionine adenosyltransferase 1) (AdoMet synthetase 1) with e-value of 1.6e-155 and BLAST sequence identity of 92.4
  misc_feature 165101:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(339): Functional Homolog of  Ceres CLONE ID no. 36518 at SEQ ID NO. 1549 with e-value of 3.00E-144 and BLAST sequence identity of 86.5
MVFGEITTKANVDYEKIVRDTCRGIGFTSADVGLDADNCKVLVNIEQQSPDIAQGVHGHLTKKPEEIGAGDQGHMFGYATDETPELMPLTHVLATKLGAKLTEVRKNKTCPWLRPDGKTQVTVEYKNEGGAMVPIRVHTILISTQHDENVTNEQIAADLKEHVIKPVIPVQYLDDKTIFHLNPSGRFVIGGPHGDAGLTGRKIIIDTYGGWGAHGGGAFSGKDPTKVDRSGAYIVRQAAKSVVASGLARRCIVQVSYAIGVPEPLSVFVDTYKTGKIPDRDILELIKENFDFRPGMIAINLDLMRGGNSRYQKTAAYGHFGRDDPDFTWETVKLLKPNA

SEQ ID NO: 1518 - protein, 362 aa, Arabidopsis thaliana
  misc_feature (1)..(362): Ceres CLONE ID no. 36632
  misc_feature (30)..(342): Pfam Name: Lipase_GDSL Pfam Description: GDSL-like Lipase/Acylhydrolase
  misc_feature: Utility: Mannitol Useful for making plants with enhanced tolerance to drought
  misc_feature: Phenotype: WHOLE PLANT - Mannitol Useful for making plants with enhanced tolerance to drought
MARMSLMIMMIMVAVTMINIAKSDPIAPCYFIFGDSLVDNGNNNQLQSLARANYFPYGIDFAAGPTGRFSNGLTTVDVIAQLLGFEDYITPYASARGQDILRGVNYASAAAGIRDETGRQLRGRIAFAGQVANHVNTVSQVVNILGDQNEASNYLSKCIYSIGLGSNDYLNNYFMPTFYSTGNQFSPESYADDLVARYTEQLRVLYTNGARKFALIGVGAIGCSPNELAQNSRDGRTCDERINSANRIFNSKLISIVDAFNQNTPDAKFTYINAYGIFQDIITNPARYGFRVTNAGCCGVGRNNGQITCLPGQAPCLNRNEYVFWDAFHPGEAANIVIGRRSFKREAASDAHPYDIQQLASL

SEQ ID NO: 1519 - DNA, 1098 bp, Populus balsamifera subsp. trichocarpa; identical to SEQ ID NO: 918
  misc_feature (1)..(1098): Ceres ANNOT ID no. 1519418
  misc_feature: Utility: Mannitol Useful for making plants with enhanced tolerance to drought
  misc_feature 165337:<222: Transcription Factor
  misc_feature: Phenotype: WHOLE PLANT - Mannitol Useful for making plants with enhanced tolerance to drought

SEQ ID NO: 1520 - protein, 365 aa, Populus balsamifera subsp. trichocarpa; identical to SEQ ID NO: 919
  misc_feature (1)..(365): Ceres ANNOT ID no. 1519418
  misc_feature (33)..(345): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 3.5e-41 and BLAST sequence identity of 32.2
  misc_feature: SWISSPROT Homolog: APG_BRANA Anter-specific proline-rich protein APG (Protein CEX) (Fragment) with e-value of 5.1e-40 and BLAST sequence identity of 31.3
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 9.3e-22 and BLAST sequence identity of 26.9
  misc_feature: SWISSPROT Homolog: EST_HEVBR Esterase precursor (EC 3.1.1.-) Early nodule-specific protein homolog  (Latex allergen Hev b 13) with e-value of 2.5e-20 and BLAST sequence identity of 26.1
  misc_feature: Utility: Mannitol Useful for making plants with enhanced tolerance to drought
  misc_feature 165443:<222: Transcription Factor
  misc_feature: Phenotype: WHOLE PLANT - Mannitol Useful for making plants with enhanced tolerance to drought
  misc_feature (1)..(365): Functional Homolog of  Ceres CLONE ID no. 36632 at SEQ ID NO. 1562 with e-value of 1.20E-140 and BLAST sequence identity of 71.7

SEQ ID NO: 1521 - DNA, 1104 bp, Populus balsamifera subsp. trichocarpa; identical to SEQ ID NO: 920
  misc_feature (1)..(1104): Ceres ANNOT ID no. 1448924
  misc_feature: Utility: Mannitol Useful for making plants with enhanced tolerance to drought
  misc_feature 165551:<222: Transcription Factor
  misc_feature: Phenotype: WHOLE PLANT - Mannitol Useful for making plants with enhanced tolerance to drought

SEQ ID NO: 1522 - protein, 367 aa, Populus balsamifera subsp. trichocarpa; identical to SEQ ID NO: 921
  misc_feature (1)..(367): Ceres ANNOT ID no. 1448924
  misc_feature (34)..(347): Pfam Name: Lipase_GDSL Pfam Description: GDSL-like Lipase/Acylhydrolase
  misc_feature: SWISSPROT Homolog: APG_ARATH Anter-specific proline-rich protein APG precursor with e-value of 3.5e-41 and BLAST sequence identity of 32.2
  misc_feature: SWISSPROT Homolog: APG_BRANA Anter-specific proline-rich protein APG (Protein CEX) (Fragment) with e-value of 5.1e-40 and BLAST sequence identity of 31.3
  misc_feature: SWISSPROT Homolog: FUCO2_ARATH Alpha-L-fucosidase 2 precursor (EC 3.2.1.51) (Alpha-L-fucoside fucohydrolase 2) (AtFXG1) with e-value of 9.3e-22 and BLAST sequence identity of 26.9
  misc_feature: SWISSPROT Homolog: EST_HEVBR Esterase precursor (EC 3.1.1.-) Early nodule-specific protein homolog  (Latex allergen Hev b 13) with e-value of 2.5e-20 and BLAST sequence identity of 26.1
  misc_feature: Utility: Mannitol Useful for making plants with enhanced tolerance to drought
  misc_feature 165657:<222: Transcription Factor
  misc_feature: Phenotype: WHOLE PLANT - Mannitol Useful for making plants with enhanced tolerance to drought
  misc_feature (1)..(367): Functional Homolog of  Ceres CLONE ID no. 36632 at SEQ ID NO. 1562 with e-value of 4.49E-134 and BLAST sequence identity of 69.8

SEQ ID NO: 1523 - protein, 408 aa, Arabidopsis thaliana
  misc_feature (1)..(408): Ceres CLONE ID no. 36681
  misc_feature (140)..(325): Pfam Name: Pec_lyase_C Pfam Description: Pectate lyase
  misc_feature: Utility: Mannitol Useful for making plants with enhanced tolerance to drought
  misc_feature: Phenotype: WHOLE PLANT - Mannitol Useful for making plants with enhanced tolerance to drought
MKMQTKKLFITIVSFLLYAPLFLSSPVPDPESVVEEVHKSINASVAGRRKLGYLSCTTGNPIDDCWRCDPHWEQHRQRLADCAIGFGKNAIGGRDGRIYVVTDSGNYNPVSPKPGTLRHAVVQDEPLWIIFQRDMTIQLKEELIMNSFKTIDGRGASVHISGGPCITIQYVTNIIIHGIHIHDCKQGGNAMVRSSPRHFGWRTISDGDGVSIFGGSHVWVDHCSFSNCEDGLIDAIMGSTAITLSNNHMTHHDKVMLLGHSDTYSRDKNMQVTIAFNHFGEGLVQRMPRCRHGYFHVVNNDYTHWEMYAIGGSANPTINSQGNRFLAPNIRFSKEVTKDEDAPESEWKRWNWRSSGDLLLNGAFFTPSGGAASSSYAKASSLGAKPSSLVGPLTSTSGALNCRKGSRC

SEQ ID NO: 1524 - DNA, 1212 bp, Populus balsamifera subsp. trichocarpa
  misc_feature (1)..(1212): Ceres ANNOT ID no. 1527156
  misc_feature: Utility: Mannitol Useful for making plants with enhanced tolerance to drought
  misc_feature 165877:<222: Transcription Factor
  misc_feature: Phenotype: WHOLE PLANT - Mannitol Useful for making plants with enhanced tolerance to drought
atggcaaacccttctctctgtctcctcttcctcctctctctcctaaccccagccctcatttcctcttccccagttcaggacccggaacttgtagtacaagaagtgcatagggccatcaatgcttctaggaggaagttgggctatctctcttgcgggactggcaaccccattgatgactgctggaggtgtgatcccaattgggagaagaaccgtcagaggctagcggattgtgcaattgggttcggtaagaatgccattgggggaagagatggtaagatttatgtggtcacagactctggtaatgatgatcccgtgaaccctaggccagggactctcaggcatgctgtgatccaggaggagccattgtggatcattttcgctcgagacatgacaattcaactgaaggaagaattgatcatgaactcgttcaagacgattgatggtagaggtgctagtgtccatattgctggcggcccgtgcatcaccatacagtatgtgaccaacattattatacatggactacacatacacgattgcaagcaaggagggaatgctatggtgagagactccccaaagcactttggctggaggactgtatccgatggtgacggtgtgtccatcttcggcggtactcacgtatgggtggaccataattcgttgtcaaattgtaacgatggacttgtcgatgccattcatgggtcctcggccatcaccatttcgaacaattacatgacccaccatgataaagtcatgcttctggggcacagcgattcctacactcaagacaagaacatgcaagtcaccatagcctttaatcactttggagaagggcttgtccagagaatgccaagatgcagacacgggtatttccatgtggtcaacaatgactacacccattgggaaatgtacgccattggagggagtgctaacccgaccatcaacagccaaggcaatagatttgttgcgcccgacatcaggttcagtaaggaggtaacaaaacatgaagacgcaccagagagtgaatggaagcactggaattggagatccgaaggagacctactaatgaatggtgcgtttttcacagcatctggtgcaggtgcttcttcaagttatgccagggcatcaagcttgggtgcaagaccatcttcgcttgtcggtacaataacagtgggagcgggtgcacttggttgcaggaaaggggctcgttgctag

SEQ ID NO: 1525 - protein, 403 aa, Populus balsamifera subsp. trichocarpa
  misc_feature (1)..(403): Ceres ANNOT ID no. 1527156
  misc_feature (135)..(320): Pfam Name: Pec_lyase_C Pfam Description: Pectate lyase
  misc_feature: SWISSPROT Homolog: PEL18_ARATH Probable pectate lyase 18 precursor (EC 4.2.2.2) (Pectate lyase A10) with e-value of 1.1e-227 and BLAST sequence identity of 99.5
  misc_feature: SWISSPROT Homolog: PEL22_ARATH Probable pectate lyase 22 precursor (EC 4.2.2.2) with e-value of 2.5e-180 and BLAST sequence identity of 77.8
  misc_feature: SWISSPROT Homolog: PEL5_ARATH Probable pectate lyase 5 precursor (EC 4.2.2.2) with e-value of 2.1e-178 and BLAST sequence identity of 77.9
  misc_feature: SWISSPROT Homolog: PEL_ZINEL Pectate lyase precursor (EC 4.2.2.2) (ZePel) with e-value of 6.2e-170 and BLAST sequence identity of 74.2
  misc_feature: SWISSPROT Homolog: PEL18_LYCES Probable pectate lyase P18 precursor (EC 4.2.2.2) (Style development-specific protein 9612) with e-value of 1.4e-165 and BLAST sequence identity of 72.7
  misc_feature: Utility: Mannitol Useful for making plants with enhanced tolerance to drought
  misc_feature 165996:<222: Transcription Factor
  misc_feature: Phenotype: WHOLE PLANT - Mannitol Useful for making plants with enhanced tolerance to drought
  misc_feature (1)..(403): Functional Homolog of  Ceres CLONE ID no. 36681 at SEQ ID NO. 1567 with e-value of 1.49E-190 and BLAST sequence identity of 83.1
MANPSLCLLFLLSLLTPALISSSPVQDPELVVQEVHRAINASRRKLGYLSCGTGNPIDDCWRCDPNWEKNRQRLADCAIGFGKNAIGGRDGKIYVVTDSGNDDPVNPRPGTLRHAVIQEEPLWIIFARDMTIQLKEELIMNSFKTIDGRGASVHIAGGPCITIQYVTNIIIHGLHIHDCKQGGNAMVRDSPKHFGWRTVSDGDGVSIFGGTHVWVDHNSLSNCNDGLVDAIHGSSAITISNNYMTHHDKVMLLGHSDSYTQDKNMQVTIAFNHFGEGLVQRMPRCRHGYFHVVNNDYTHWEMYAIGGSANPTINSQGNRFVAPDIRFSKEVTKHEDAPESEWKHWNWRSEGDLLMNGAFFTASGAGASSSYARASSLGARPSSLVGTITVGAGALGCRKGARC

SEQ ID NO: 1526 - DNA, 1212 bp, Populus balsamifera subsp. trichocarpa
  misc_feature (1)..(1212): Ceres ANNOT ID no. 1468540
  misc_feature: Utility: Mannitol Useful for making plants with enhanced tolerance to drought
  misc_feature 166113:<222: Transcription Factor
  misc_feature: Phenotype: WHOLE PLANT - Mannitol Useful for making plants with enhanced tolerance to drought
atggcaaacccttctctctgtctcctcctcctcctctctctcctgaccccagccctcgtctcctcttccccggttcaggacccagaatttgtagtacaagaagtacatagggccatcaatgcctctaggaggaagttgggatatctctcttgtggaaccggcaaccccattgatgactgctggagatgcgatcccaattgggagaagaaccgccagaggctagctgattgtgcaattgggtttggtaagaatgccattggtggaagaaatggtaagatttatgtggttacagaatctggtaatgatgatcccgtgaaccctaagccagggactctcaggcatgctgtcattcaagaagagcctttgtggatcatttttgctcgtgacatgacaattcaattgaaggaagaactgatcatgaactcgttcaagactatcgatggtagaggtgcaagtgtccatattgccggtggcccatgcattactatacagtatgtgaccaacattattatacatggactaaacatacacgattgcaagagaggagggaatgctatggtgagggactccccaaaccactttggatggaggactgtatcagatggtgatggtgtgtccatctttggtggtgctcacatctgggtggaccataattcattgtcaaattgtaacgatggactcgttgatgccatccatgggtcctcagccatcaccatttcgaacaattacatgacccaccatgataaagtcatgcttctggggcatagtgattcctacactcaagacaagaacatgcaagtcaccatagccttcaatcactttggagaaggtcttgtccagagaatgccaagatgtagacatggatatttccatgtggtcaacaatgactacacccattgggaaatgtacgccattggagggagtgctagcccaaccatcaacagccaaggcaacagatttgtagcacctgacatcaggttcagtaaagaggtaacaaaacatgaagatgcaccagagagtgaatggaagaattggaattggaggtctgaaggagatctactattgaatggagcatttttcgtagcatctggcgcaggcgcttcatcaagctatgctagggcatcaagcttgggtgcaagaccatcttcacttgtcggtccaatcacgatgggggcaggtgcacttaactgcaggaaggggggtcgttgctag

SEQ ID NO: 1527 - protein, 403 aa, Populus balsamifera subsp. trichocarpa
  misc_feature (1)..(403): Ceres ANNOT ID no. 1468540
  misc_feature (135)..(320): Pfam Name: Pec_lyase_C Pfam Description: Pectate lyase
  misc_feature: SWISSPROT Homolog: PEL18_ARATH Probable pectate lyase 18 precursor (EC 4.2.2.2) (Pectate lyase A10) with e-value of 1.1e-227 and BLAST sequence identity of 99.5
  misc_feature: SWISSPROT Homolog: PEL22_ARATH Probable pectate lyase 22 precursor (EC 4.2.2.2) with e-value of 2.5e-180 and BLAST sequence identity of 77.8
  misc_feature: SWISSPROT Homolog: PEL5_ARATH Probable pectate lyase 5 precursor (EC 4.2.2.2) with e-value of 2.1e-178 and BLAST sequence identity of 77.9
  misc_feature: SWISSPROT Homolog: PEL_ZINEL Pectate lyase precursor (EC 4.2.2.2) (ZePel) with e-value of 6.2e-170 and BLAST sequence identity of 74.2
  misc_feature: SWISSPROT Homolog: PEL18_LYCES Probable pectate lyase P18 precursor (EC 4.2.2.2) (Style development-specific protein 9612) with e-value of 1.4e-165 and BLAST sequence identity of 72.7
  misc_feature: Utility: Mannitol Useful for making plants with enhanced tolerance to drought
  misc_feature 166232:<222: Transcription Factor
  misc_feature: Phenotype: WHOLE PLANT - Mannitol Useful for making plants with enhanced tolerance to drought
  misc_feature (1)..(403): Functional Homolog of  Ceres CLONE ID no. 36681 at SEQ ID NO. 1567 with e-value of 3.50E-189 and BLAST sequence identity of 82.3
MANPSLCLLLLLSLLTPALVSSSPVQDPEFVVQEVHRAINASRRKLGYLSCGTGNPIDDCWRCDPNWEKNRQRLADCAIGFGKNAIGGRNGKIYVVTESGNDDPVNPKPGTLRHAVIQEEPLWIIFARDMTIQLKEELIMNSFKTIDGRGASVHIAGGPCITIQYVTNIIIHGLNIHDCKRGGNAMVRDSPNHFGWRTVSDGDGVSIFGGAHIWVDHNSLSNCNDGLVDAIHGSSAITISNNYMTHHDKVMLLGHSDSYTQDKNMQVTIAFNHFGEGLVQRMPRCRHGYFHVVNNDYTHWEMYAIGGSASPTINSQGNRFVAPDIRFSKEVTKHEDAPESEWKNWNWRSEGDLLLNGAFFVASGAGASSSYARASSLGARPSSLVGPITMGAGALNCRKGGRC

SEQ ID NO: 1528 - DNA, 1209 bp, Populus balsamifera subsp. trichocarpa
  misc_feature (1)..(1209): Ceres ANNOT ID no. 1512959
  misc_feature: Utility: Mannitol Useful for making plants with enhanced tolerance to drought
  misc_feature 166349:<222: Transcription Factor
  misc_feature: Phenotype: WHOLE PLANT - Mannitol Useful for making plants with enhanced tolerance to drought
atggcaatcccactctctctttcgatcctcctgcttattctagctccaaattttatttcctgttcgccagttcaagatcctgaattggtagtggaggaagtacacaggagcatcaacgcctctagaagaaaattgggtttcctttcttgtggaaccggcaatccaatagacgattgctggaggtgtgaccccaaatgggagaagaatcggcagagattagcagattgtgcaattgggttcggtaagcatgcgatcggtggcagggatggtaagatatatgtagtgacagaccccgggaatgatgaccctgtgaatcccaagccaggcactcttaggtatgctgttatacaagaagagcctttatggatcattttcgctcgagacatggtgatcaagcttaaggaagagctgatcatgaactctttcaagacgatcgatgggagaggagccagtgtgcacattgctggtggtccatgcatcactgtacagtatgtgaccaacattataattcacggtataaatattcatgattgtaagcaaggagggaatgcttatgtgagggattccccaggtcattatggatggaggactatatcggacggtgatggagtgtctatattcggaggcagccatgtgtgggtggatcattgctctttatccaattgcaatgatgggttgattgatgcgattcatggatccacagccataacaatctcaaacaattacttgacccatcacaacaaggtcatgctcttgggccatagtgatagctataaacaagacaagaacatgcaagtcaccattgccttcaaccactttggagaagggcttgtgcagagaatgccaaggtgtagacatggatatttccacgtggtaaacaacgactactcacattggaaaatgtacgcaattggaggcagtgccgatcctacaattaacagccaaggcaataggtttcttgctcccaatgacagatttaataaagaggtaactaaacatgaggatgcacctcaaagtgaatggaagggttggaactggaggtctgaaggggatttgctgttaaacggggcattcttcacagcatctggagctggagcttcctctagttacgccaaggcatccagcttaggtgcaagaccatcttccttggttagctccatcacagcaggagcaggttcacttgcttgcaagaagggttcccgttgctga

SEQ ID NO: 1529 - protein, 402 aa, Populus balsamifera subsp. trichocarpa
  misc_feature (1)..(402): Ceres ANNOT ID no. 1512959
  misc_feature (134)..(319): Pfam Name: Pec_lyase_C Pfam Description: Pectate lyase
  misc_feature: SWISSPROT Homolog: PEL18_ARATH Probable pectate lyase 18 precursor (EC 4.2.2.2) (Pectate lyase A10) with e-value of 1.1e-227 and BLAST sequence identity of 99.5
  misc_feature: SWISSPROT Homolog: PEL22_ARATH Probable pectate lyase 22 precursor (EC 4.2.2.2) with e-value of 2.5e-180 and BLAST sequence identity of 77.8
  misc_feature: SWISSPROT Homolog: PEL5_ARATH Probable pectate lyase 5 precursor (EC 4.2.2.2) with e-value of 2.1e-178 and BLAST sequence identity of 77.9
  misc_feature: SWISSPROT Homolog: PEL_ZINEL Pectate lyase precursor (EC 4.2.2.2) (ZePel) with e-value of 6.2e-170 and BLAST sequence identity of 74.2
  misc_feature: SWISSPROT Homolog: PEL18_LYCES Probable pectate lyase P18 precursor (EC 4.2.2.2) (Style development-specific protein 9612) with e-value of 1.4e-165 and BLAST sequence identity of 72.7
  misc_feature: Utility: Mannitol Useful for making plants with enhanced tolerance to drought
  misc_feature 166468:<222: Transcription Factor
  misc_feature: Phenotype: WHOLE PLANT - Mannitol Useful for making plants with enhanced tolerance to drought
  misc_feature (1)..(402): Functional Homolog of  Ceres CLONE ID no. 36681 at SEQ ID NO. 1567 with e-value of 1.80E-185 and BLAST sequence identity of 83.2
MAIPLSLSILLLILAPNFISCSPVQDPELVVEEVHRSINASRRKLGFLSCGTGNPIDDCWRCDPKWEKNRQRLADCAIGFGKHAIGGRDGKIYVVTDPGNDDPVNPKPGTLRYAVIQEEPLWIIFARDMVIKLKEELIMNSFKTIDGRGASVHIAGGPCITVQYVTNIIIHGINIHDCKQGGNAYVRDSPGHYGWRTISDGDGVSIFGGSHVWVDHCSLSNCNDGLIDAIHGSTAITISNNYLTHHNKVMLLGHSDSYKQDKNMQVTIAFNHFGEGLVQRMPRCRHGYFHVVNNDYSHWKMYAIGGSADPTINSQGNRFLAPNDRFNKEVTKHEDAPQSEWKGWNWRSEGDLLLNGAFFTASGAGASSSYAKASSLGARPSSLVSSITAGAGSLACKKGSRC

SEQ ID NO: 1530 - DNA, 1209 bp, Populus balsamifera subsp. trichocarpa
  misc_feature (1)..(1209): Ceres ANNOT ID no. 1463128
  misc_feature: Utility: Mannitol Useful for making plants with enhanced tolerance to drought
  misc_feature 166585:<222: Transcription Factor
  misc_feature: Phenotype: WHOLE PLANT - Mannitol Useful for making plants with enhanced tolerance to drought
atggcaattccactctctctttcagtactcctgcttattctagctccaagttttatttcctgtttgccagttcaagatcctgaattggtagtggaagaagtacacaggagcatcaatgcctctcggagaaacttggccttcctttcttgtggaaccggcaaccccatagacgactgctggcggtgtgaccccaattgggagaagaatcggcaaagattagccaattgtgcaattgggttcggtaagaatgctatcggtggcagggatggtaagatatatgtagtgacagactccggtcatgatgacccagtgaatcccaagccaggcactcttaggcatgctgttatacaagatgagcctctatggatcactttcgctcgtgacatggtgatcaggctcaaggaagaattgatcatgaactctttcaagacaatcgacggaagaggagctaatgtgcacattgctggaggtccatgcatcactatacaatatgtgaccaacattatcattcatggtataaatattcatgattgcaagcaaggagggaatgcctatgtgagggattctcctagccattacgggtggaggactatatcggacggcgacggggtatcgatattcggaggtagccaggtgtgggtggatcattgctctttatccaattgcaatgatgggttgattgatgcaattcatggctccacagccataacaatctccaacagttacttcactcgtcataacaaggtcatgctcttgggccacagtgatagctataaacaagacaagaatatgcaagtcaccattgccttcaaccacttcggagaagggcttgtgcagagaatgccaagatgtagacatggatattttcacgtggtaaacaatgactatacacactggaaaatgtatgcaattggtggcagtgctgcccctacaattaatagccaaggcaatagatttcttgctcccaatgatagatttaaaaaagaggtaactaaacatgaggctgcaccacaaagccaatggaagcgttggaattggaggtccgacggggatttgatgttaaatggagcgttcttcacaccatctggtgctggagcttcttctagttacgccagggcatccagcttaagtgcaagaccatcttccctggtgagctccatcacagcaggagcaggtgcacttgtttgcaagaagggttcacgctgctga

SEQ ID NO: 1531 - protein, 402 aa, Populus balsamifera subsp. trichocarpa
  misc_feature (1)..(402): Ceres ANNOT ID no. 1463128
  misc_feature (134)..(319): Pfam Name: Pec_lyase_C Pfam Description: Pectate lyase
  misc_feature: SWISSPROT Homolog: PEL18_ARATH Probable pectate lyase 18 precursor (EC 4.2.2.2) (Pectate lyase A10) with e-value of 1.1e-227 and BLAST sequence identity of 99.5
  misc_feature: SWISSPROT Homolog: PEL22_ARATH Probable pectate lyase 22 precursor (EC 4.2.2.2) with e-value of 2.5e-180 and BLAST sequence identity of 77.8
  misc_feature: SWISSPROT Homolog: PEL5_ARATH Probable pectate lyase 5 precursor (EC 4.2.2.2) with e-value of 2.1e-178 and BLAST sequence identity of 77.9
  misc_feature: SWISSPROT Homolog: PEL_ZINEL Pectate lyase precursor (EC 4.2.2.2) (ZePel) with e-value of 6.2e-170 and BLAST sequence identity of 74.2
  misc_feature: SWISSPROT Homolog: PEL18_LYCES Probable pectate lyase P18 precursor (EC 4.2.2.2) (Style development-specific protein 9612) with e-value of 1.4e-165 and BLAST sequence identity of 72.7
  misc_feature: Utility: Mannitol Useful for making plants with enhanced tolerance to drought
  misc_feature 166704:<222: Transcription Factor
  misc_feature: Phenotype: WHOLE PLANT - Mannitol Useful for making plants with enhanced tolerance to drought
  misc_feature (1)..(402): Functional Homolog of  Ceres CLONE ID no. 36681 at SEQ ID NO. 1567 with e-value of 1.20E-181 and BLAST sequence identity of 81.9
MAIPLSLSVLLLILAPSFISCLPVQDPELVVEEVHRSINASRRNLAFLSCGTGNPIDDCWRCDPNWEKNRQRLANCAIGFGKNAIGGRDGKIYVVTDSGHDDPVNPKPGTLRHAVIQDEPLWITFARDMVIRLKEELIMNSFKTIDGRGANVHIAGGPCITIQYVTNIIIHGINIHDCKQGGNAYVRDSPSHYGWRTISDGDGVSIFGGSQVWVDHCSLSNCNDGLIDAIHGSTAITISNSYFTRHNKVMLLGHSDSYKQDKNMQVTIAFNHFGEGLVQRMPRCRHGYFHVVNNDYTHWKMYAIGGSAAPTINSQGNRFLAPNDRFKKEVTKHEAAPQSQWKRWNWRSDGDLMLNGAFFTPSGAGASSSYARASSLSARPSSLVSSITAGAGALVCKKGSRC

SEQ ID NO: 1532 - DNA, 1212 bp, Populus balsamifera subsp. trichocarpa
  misc_feature (1)..(1212): Ceres ANNOT ID no. 1440644
  misc_feature: Utility: Mannitol Useful for making plants with enhanced tolerance to drought
  misc_feature 166821:<222: Transcription Factor
  misc_feature: Phenotype: WHOLE PLANT - Mannitol Useful for making plants with enhanced tolerance to drought
atgtcaagacttgcaatccttctgattttctttttctctgctccagcaccacattttgttttctcttcatcaattcaggaccctgagctagtggtgcaggaggtgcataggagcatcaatgcttcaagaagaaaccttggctatttatcatgtggaactggcaaccctatagatgattgctggaggtgtgaccccaattgggagaggaatcgccagcggctagctgattgtgctattgggtttggcaagaacgctattgggggtagaaatggtcgaatttatgttgtgaccgactctggtaatgatgatgcggtgaaccctaagccaggaactcttaggcatgctgtaattcaggacgagcccttgtggatcatcttcaagagagacatggtaattcagctgaggcaagagctggtcatgaattcttacaagactattgatggtaggggtgctagtgttcacattgccgggggaccatgcattactattcattatgctactaacattatcatacatggcatacatatacatgactgtaagcaaggagggaatggtgatatacgagactctcctcgccactccggttggtggactccctcggacggtgatggggtttccatctttgctagcaagcatatatgggttgaccattgctcattgtctaactgtcatgatggacttattgatgccattcatggatcgacagccatcactatctccaacaacttcatgacccatcatgacaaggtcatgctgttgggccatagcgactcgtatacacaagacaaagacatgcaagtgactatagcctttaatcattttggcgaagggctggtgcaaagaatgccaaggtgcaggcatgggtactttcatgttgtgaacaatgactacacccactgggaaatgtatgccattggcgggagcgcttctcctacaatcaacagtcaaggaaatagatttcttgcaccaaatagaagatttaacaaggaggtgactaaacatgaggatgcacccgagagtgagtggaggcactggaactggaggtcagaaggagacttaatgttgaatggtgcctatttccggcaatcaggcgctggtgcatcttcaagctatgcaagggcttatagcctgagtgcaagaccatcttctcttgtgggttcaatgaccctgacttccggtgtacttaactgcaggaagggctctcgatgctga

SEQ ID NO: 1533 - protein, 403 aa, Populus balsamifera subsp. trichocarpa
  misc_feature (1)..(403): Ceres ANNOT ID no. 1440644
  misc_feature (135)..(320): Pfam Name: Pec_lyase_C Pfam Description: Pectate lyase
  misc_feature: SWISSPROT Homolog: PEL18_ARATH Probable pectate lyase 18 precursor (EC 4.2.2.2) (Pectate lyase A10) with e-value of 1.1e-227 and BLAST sequence identity of 99.5
  misc_feature: SWISSPROT Homolog: PEL22_ARATH Probable pectate lyase 22 precursor (EC 4.2.2.2) with e-value of 2.5e-180 and BLAST sequence identity of 77.8
  misc_feature: SWISSPROT Homolog: PEL5_ARATH Probable pectate lyase 5 precursor (EC 4.2.2.2) with e-value of 2.1e-178 and BLAST sequence identity of 77.9
  misc_feature: SWISSPROT Homolog: PEL_ZINEL Pectate lyase precursor (EC 4.2.2.2) (ZePel) with e-value of 6.2e-170 and BLAST sequence identity of 74.2
  misc_feature: SWISSPROT Homolog: PEL18_LYCES Probable pectate lyase P18 precursor (EC 4.2.2.2) (Style development-specific protein 9612) with e-value of 1.4e-165 and BLAST sequence identity of 72.7
  misc_feature: Utility: Mannitol Useful for making plants with enhanced tolerance to drought
  misc_feature 166940:<222: Transcription Factor
  misc_feature: Phenotype: WHOLE PLANT - Mannitol Useful for making plants with enhanced tolerance to drought
  misc_feature (1)..(403): Functional Homolog of  Ceres CLONE ID no. 36681 at SEQ ID NO. 1567 with e-value of 2.40E-181 and BLAST sequence identity of 80.4
MSRLAILLIFFFSAPAPHFVFSSSIQDPELVVQEVHRSINASRRNLGYLSCGTGNPIDDCWRCDPNWERNRQRLADCAIGFGKNAIGGRNGRIYVVTDSGNDDAVNPKPGTLRHAVIQDEPLWIIFKRDMVIQLRQELVMNSYKTIDGRGASVHIAGGPCITIHYATNIIIHGIHIHDCKQGGNGDIRDSPRHSGWWTPSDGDGVSIFASKHIWVDHCSLSNCHDGLIDAIHGSTAITISNNFMTHHDKVMLLGHSDSYTQDKDMQVTIAFNHFGEGLVQRMPRCRHGYFHVVNNDYTHWEMYAIGGSASPTINSQGNRFLAPNRRFNKEVTKHEDAPESEWRHWNWRSEGDLMLNGAYFRQSGAGASSSYARAYSLSARPSSLVGSMTLTSGVLNCRKGSRC

SEQ ID NO: 1534 - DNA, 1206 bp, Populus balsamifera subsp. trichocarpa
  misc_feature (1)..(1206): Ceres ANNOT ID no. 1493523
  misc_feature: Utility: Mannitol Useful for making plants with enhanced tolerance to drought
  misc_feature 167057:<222: Transcription Factor
  misc_feature: Phenotype: WHOLE PLANT - Mannitol Useful for making plants with enhanced tolerance to drought
atgtcaagacttgcaatccttctgattttctttttctctgctccagcaccacattttgttttctcttcatcaattcaggaccctgagctagtggtgcaggaggtgcataggagcatcaatgcttcaagaagaaaccttggctatttatcatgtggaactggcaaccctatagatgattgctggaggtgtgaccccaattgggagaggaatcgccagcggctagctgattgtgctattgggtttggcaagaacgctattgggggtagaaatggtcgaatttatgttgtgaccgactctggtaatgatgatgcggtgaaccctaagccaggaactcttaggcatgctgtaattcaggacgagcccttgtggatcatcttcaagagagacatggtaattcagctgaggcaagagctggtcatgaattcttacaagactattgatggtaggggtgctagtgttcacattgccgggggaccatgcattactattcattatgctactaacattatcatacatggcatacatatacatgactgtaagcaaggagggaatggtgatatacgagactctcctcgccactccggttggtggactccctcggacggtgatggggtttccatctttgctagcaagcatatatgggttgaccattgctcattgtctaactgtcatgatggacttattgatgccattcatggatcgacagccatcactatctccaacaacttcatgacccatcatgacaaggtcatgctgttgggccatagcgactcgtatacacaagacaaagacatgcaagtgactatagcctttaatcattttggcgaagggctggtgcaaagaatgccaaggcatgggtactttcatgttgtgaacaatgactacacccactgggaaatgtatgccattggcgggagcgcttctcctacaatcaacagtcaaggaaatagatttcttgcaccaaatagaagatttaacaaggaggtgactaaacatgaggatgcacccgagagtgagtggaggcactggaactggaggtcagaaggagacttaatgttgaatggtgcctatttccggcaatcaggcgctggtgcatcttcaagctatgcaagggcttatagcctgagtgcaagaccatcttctcttgtgggttcaatgaccctgacttccggtgtacttaactgcaggaagggctctcgatgctga

SEQ ID NO: 1535 - protein, 401 aa, Populus balsamifera subsp. trichocarpa
  misc_feature (1)..(401): Ceres ANNOT ID no. 1493523
  misc_feature (135)..(318): Pfam Name: Pec_lyase_C Pfam Description: Pectate lyase
  misc_feature: SWISSPROT Homolog: PEL18_ARATH Probable pectate lyase 18 precursor (EC 4.2.2.2) (Pectate lyase A10) with e-value of 1.1e-227 and BLAST sequence identity of 99.5
  misc_feature: SWISSPROT Homolog: PEL22_ARATH Probable pectate lyase 22 precursor (EC 4.2.2.2) with e-value of 2.5e-180 and BLAST sequence identity of 77.8
  misc_feature: SWISSPROT Homolog: PEL5_ARATH Probable pectate lyase 5 precursor (EC 4.2.2.2) with e-value of 2.1e-178 and BLAST sequence identity of 77.9
  misc_feature: SWISSPROT Homolog: PEL_ZINEL Pectate lyase precursor (EC 4.2.2.2) (ZePel) with e-value of 6.2e-170 and BLAST sequence identity of 74.2
  misc_feature: SWISSPROT Homolog: PEL18_LYCES Probable pectate lyase P18 precursor (EC 4.2.2.2) (Style development-specific protein 9612) with e-value of 1.4e-165 and BLAST sequence identity of 72.7
  misc_feature: Utility: Mannitol Useful for making plants with enhanced tolerance to drought
  misc_feature 167176:<222: Transcription Factor
  misc_feature: Phenotype: WHOLE PLANT - Mannitol Useful for making plants with enhanced tolerance to drought
  misc_feature (1)..(401): Functional Homolog of  Ceres CLONE ID no. 36681 at SEQ ID NO. 1567 with e-value of 1.09E-178 and BLAST sequence identity of 80.3
MSRLAILLIFFFSAPAPHFVFSSSIQDPELVVQEVHRSINASRRNLGYLSCGTGNPIDDCWRCDPNWERNRQRLADCAIGFGKNAIGGRNGRIYVVTDSGNDDAVNPKPGTLRHAVIQDEPLWIIFKRDMVIQLRQELVMNSYKTIDGRGASVHIAGGPCITIHYATNIIIHGIHIHDCKQGGNGDIRDSPRHSGWWTPSDGDGVSIFASKHIWVDHCSLSNCHDGLIDAIHGSTAITISNNFMTHHDKVMLLGHSDSYTQDKDMQVTIAFNHFGEGLVQRMPRHGYFHVVNNDYTHWEMYAIGGSASPTINSQGNRFLAPNRRFNKEVTKHEDAPESEWRHWNWRSEGDLMLNGAYFRQSGAGASSSYARAYSLSARPSSLVGSMTLTSGVLNCRKGSRC

SEQ ID NO: 1536 - protein, 371 aa, Arabidopsis thaliana
  misc_feature (1)..(371): Ceres CLONE ID no. 36701
  misc_feature (103)..(367): Pfam Name: polyprenyl_synt Pfam Description: Polyprenyl synthetase
  misc_feature: Phenotype: FLOWER - Reduced fertility Useful for sterility, genetic confinement systems
  misc_feature: Phenotype: WHOLE PLANT - Other Useful for making bigger plants
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLRAIVGGGSDDEIERLRKFARCIGLLFQVVDDILYVTKSSKELGKTAGKDLIADKLTYPKIMGLEKSREFAEKLNREARDQLLGFDSDKVAPLLALANYIAYRQN

SEQ ID NO: 1537 - DNA, 1101 bp, Populus balsamifera subsp. trichocarpa; identical to SEQ ID NO: 1157
  misc_feature (1)..(1101): Ceres ANNOT ID no. 1487885
  misc_feature 167394:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants

SEQ ID NO: 1538 - protein, 366 aa, Populus balsamifera subsp. trichocarpa
  misc_feature (1)..(366): Ceres ANNOT ID no. 1487885
  misc_feature (102)..(362): Pfam Name: polyprenyl_synt Pfam Description: Polyprenyl synthetase
  misc_feature: SWISSPROT Homolog: GGPP1_ARATH Geranylgeranyl pyrophosphate synthetase 1, with e-value of 2.2e-190 and BLAST sequence identity of 99.5
  misc_feature: SWISSPROT Homolog: GGPP1_ARATH GGPP synthetase 1 (GGPS1)
  misc_feature: SWISSPROT Homolog: GGPP1_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_SINAL Geranylgeranyl pyrophosphate synthetase, with e-value of 4.9e-161 and BLAST sequence identity of 86.8
  misc_feature: SWISSPROT Homolog: GGPPS_SINAL GGPP synthetase (GGPS)
  misc_feature: SWISSPROT Homolog: GGPPS_SINAL Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_HEVBR Geranylgeranyl pyrophosphate synthetase, with e-value of 1.5e-127 and BLAST sequence identity of 67.6
  misc_feature: SWISSPROT Homolog: GGPPS_HEVBR GGPP synthetase
  misc_feature: SWISSPROT Homolog: GGPPS_HEVBR Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_CATRO Geranylgeranyl pyrophosphate synthetase, with e-value of 7.4e-126 and BLAST sequence identity of 70.3
  misc_feature: SWISSPROT Homolog: GGPPS_CATRO GGPP synthetase (GGPS)
  misc_feature: SWISSPROT Homolog: GGPPS_CATRO Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPP3_ARATH Geranylgeranyl pyrophosphate synthetase 3, with e-value of 5.9e-117 and BLAST sequence identity of 65.1
  misc_feature: SWISSPROT Homolog: GGPP3_ARATH GGPP synthetase 3 (GGPS3)
  misc_feature: SWISSPROT Homolog: GGPP3_ARATH Dimethylallyltranstransferase (EC 2.5.1.1); Geranyltranstransferase (EC 2.5.1.10); Farnesyltranstransferase (EC 2.5.1.29);
  misc_feature 167581:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature (1)..(366): Functional Homolog of  Ceres CLONE ID no. 36701 at SEQ ID NO. 1580 with e-value of 2.39E-126 and BLAST sequence identity of 72.6
MTSVNLGPWVQITSIINKKTRSRSRPMSNFLSPGLKTLQIASTHQRQRKPMSSICAVLTEEETLQEDQHKPTFDFKSYMIQKANSVNKALDTAVTLKEPAKIHESMRYSLLAGGKRVRPVLCLAACELVGGSESMAMPAACAVEMIHTMSLIHDDLPCMDNDDLRRGKSTNHIVFGEDVAVLAGDALLAFAFEHIAVSTLNVSPLRIVRAVGELAKVIGAEGLVAGQVVDICSEGLSEVGLEQLEFIHIHKTAKLLEGAVVLGAILGGGTDEEVEKLRRYARSIGLLFQVVDDILDVTKSSQELGKTAGKDLVADKVTYPKLMGIEKSREFAEKLLNEARELLAGFDQEKAAPLIALANYIAYRQN

SEQ ID NO: 1539 - DNA, 1098 bp, Populus balsamifera subsp. trichocarpa; identical to SEQ ID NO: 1159
  misc_feature (1)..(1098): Ceres ANNOT ID no. 1457156
  misc_feature 167690:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants

SEQ ID NO: 1540 - protein, 365 aa, Populus balsamifera subsp. trichocarpa; identical to SEQ ID NO: 1160
  misc_feature (1)..(365): Ceres ANNOT ID no. 1457156
  misc_feature (101)..(361): Pfam Name: polyprenyl_synt Pfam Description: Polyprenyl synthetase
  misc_feature: SWISSPROT Homolog: GGPP1_ARATH Geranylgeranyl pyrophosphate synthetase 1, with e-value of 2.2e-190 and BLAST sequence identity of 99.5
  misc_feature: SWISSPROT Homolog: GGPP1_ARATH GGPP synthetase 1 (GGPS1)
  misc_feature: SWISSPROT Homolog: GGPP1_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_SINAL Geranylgeranyl pyrophosphate synthetase, with e-value of 4.9e-161 and BLAST sequence identity of 86.8
  misc_feature: SWISSPROT Homolog: GGPPS_SINAL GGPP synthetase (GGPS)
  misc_feature: SWISSPROT Homolog: GGPPS_SINAL Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_HEVBR Geranylgeranyl pyrophosphate synthetase, with e-value of 1.5e-127 and BLAST sequence identity of 67.6
  misc_feature: SWISSPROT Homolog: GGPPS_HEVBR GGPP synthetase
  misc_feature: SWISSPROT Homolog: GGPPS_HEVBR Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_CATRO Geranylgeranyl pyrophosphate synthetase, with e-value of 7.4e-126 and BLAST sequence identity of 70.3
  misc_feature: SWISSPROT Homolog: GGPPS_CATRO GGPP synthetase (GGPS)
  misc_feature: SWISSPROT Homolog: GGPPS_CATRO Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPP3_ARATH Geranylgeranyl pyrophosphate synthetase 3, with e-value of 5.9e-117 and BLAST sequence identity of 65.1
  misc_feature: SWISSPROT Homolog: GGPP3_ARATH GGPP synthetase 3 (GGPS3)
  misc_feature: SWISSPROT Homolog: GGPP3_ARATH Dimethylallyltranstransferase (EC 2.5.1.1); Geranyltranstransferase (EC 2.5.1.10); Farnesyltranstransferase (EC 2.5.1.29);
  misc_feature 167876:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature (1)..(365): Functional Homolog of  Ceres CLONE ID no. 36701 at SEQ ID NO. 1580 with e-value of 5.20E-124 and BLAST sequence identity of 68.8

SEQ ID NO: 1541 - DNA, 1098 bp, Populus balsamifera subsp. trichocarpa
  misc_feature (1)..(1098): Ceres ANNOT ID no. 1449371
  misc_feature 167985:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
atggccttctctacaacaatctctttctatgacaattcgcttctcctcaaaaaacccatcaatggcctcataaacaaccagccgagaaccccattaggccacctcaaatttgcgcccttgaaaattcaagccacctatgttgcaagcccatctttcaaacagtcatttcaatcccaagaagtgggcaacaagtcacagaaggtctcttttccagcattcgaatttaaggagtacatgatcaacaaggcaaatcaagtgaacaaagcactagatgaggcagtacccttgcaacatccccagaaaatcaatgaagccatgagatattctctgctcgcgggtggaaagcgtgtacgtccaattttatgcattgcttcgtgtgaattagtgggaggagatgaggggttagcaatgccagcggcttgtgcactggagatgatccacaccatgtcattaatccatgatgatcttccctgtatggacaacgatgatctccgacgaggtaagcccacaagtcataaaatattcggcgaagatactgcagttcttgctggcgatgcactcctatcacttgcctttgagcacgtagctaggaacaccaagaatgtttcatcggaccgtgtggtccaagccattgctgagcttggatcaacagttggatcaaaaggtcttgtggcaggtcagattgtggacattgacagtgaaggtaaagaagtgagtttgagcacattggagtatattcatgtccataaaacagcaaagctcttagaggcagcggttgtttgtggggcgataatgggaggtgcagatgctacaagtgtcgaaagacttaggaaatatgctaggtctatcgggttgctgtttcaggtggtggatgatatactggatgtgaccaagtcctcagaggaactggggaagacagccggaaaggatctggcgagtgacaaggcgacctaccccaagctgatgggcatagacgaggccaagaaatttgctgcccaattggtcgatgaagccaatcaaggtcttgctttcttcgatcatgtcaaggctgccccattataccattttgctaactatattgctactcgacaaaattaa

SEQ ID NO: 1542 - protein, 365 aa, Populus balsamifera subsp. trichocarpa
  misc_feature (1)..(365): Ceres ANNOT ID no. 1449371
  misc_feature (102)..(361): Pfam Name: polyprenyl_synt Pfam Description: Polyprenyl synthetase
  misc_feature: SWISSPROT Homolog: GGPP1_ARATH Geranylgeranyl pyrophosphate synthetase 1, with e-value of 2.2e-190 and BLAST sequence identity of 99.5
  misc_feature: SWISSPROT Homolog: GGPP1_ARATH GGPP synthetase 1 (GGPS1)
  misc_feature: SWISSPROT Homolog: GGPP1_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_SINAL Geranylgeranyl pyrophosphate synthetase, with e-value of 4.9e-161 and BLAST sequence identity of 86.8
  misc_feature: SWISSPROT Homolog: GGPPS_SINAL GGPP synthetase (GGPS)
  misc_feature: SWISSPROT Homolog: GGPPS_SINAL Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_HEVBR Geranylgeranyl pyrophosphate synthetase, with e-value of 1.5e-127 and BLAST sequence identity of 67.6
  misc_feature: SWISSPROT Homolog: GGPPS_HEVBR GGPP synthetase
  misc_feature: SWISSPROT Homolog: GGPPS_HEVBR Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_CATRO Geranylgeranyl pyrophosphate synthetase, with e-value of 7.4e-126 and BLAST sequence identity of 70.3
  misc_feature: SWISSPROT Homolog: GGPPS_CATRO GGPP synthetase (GGPS)
  misc_feature: SWISSPROT Homolog: GGPPS_CATRO Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPP3_ARATH Geranylgeranyl pyrophosphate synthetase 3, with e-value of 5.9e-117 and BLAST sequence identity of 65.1
  misc_feature: SWISSPROT Homolog: GGPP3_ARATH GGPP synthetase 3 (GGPS3)
  misc_feature: SWISSPROT Homolog: GGPP3_ARATH Dimethylallyltranstransferase (EC 2.5.1.1); Geranyltranstransferase (EC 2.5.1.10); Farnesyltranstransferase (EC 2.5.1.29);
  misc_feature 168171:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature (1)..(365): Functional Homolog of  Ceres CLONE ID no. 36701 at SEQ ID NO. 1580 with e-value of 1.19E-103 and BLAST sequence identity of 65.5
MAFSTTISFYDNSLLLKKPINGLINNQPRTPLGHLKFAPLKIQATYVASPSFKQSFQSQEVGNKSQKVSFPAFEFKEYMINKANQVNKALDEAVPLQHPQKINEAMRYSLLAGGKRVRPILCIASCELVGGDEGLAMPAACALEMIHTMSLIHDDLPCMDNDDLRRGKPTSHKIFGEDTAVLAGDALLSLAFEHVARNTKNVSSDRVVQAIAELGSTVGSKGLVAGQIVDIDSEGKEVSLSTLEYIHVHKTAKLLEAAVVCGAIMGGADATSVERLRKYARSIGLLFQVVDDILDVTKSSEELGKTAGKDLASDKATYPKLMGIDEAKKFAAQLVDEANQGLAFFDHVKAAPLYHFANYIATRQN

SEQ ID NO: 1543 - DNA, 1059 bp, Populus balsamifera subsp. trichocarpa
  misc_feature (1)..(1059): Ceres ANNOT ID no. 1445504
  misc_feature 168280:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
atggccttctctgcaatattccggagctttaacagttcattttttctcaaaaactccatcaatcaccttaaaaatccaccaaaaaccccacgaggccacctctatctttccaccatgaaatttgcaagctcgaatctgaagcaaacgaatcaagcccaagaggtcccttcacttgcatttcagttcaaagaatacatgctcaccaagttgaagcaagtgaacgaagcactagaagaggcagtgcccttgcaacaccccattaaaatccatgaagcaatgagatattctctccttggtaatggaaaacgaatgtgtccgattttatgcattgcttcatgtgagttggtcggaggggatgaagaactagcgatgccattggcatgtgctctagagatggtgcatgccatgtcactaatccacgatgatcttccttgcatggacaatgatgatcttagacgaggcaaacccacaaaccataaagtatttggtgaatgtattgcaattcttgcaggtgatgcactcctatcacttgcttttgagcacatagctagcaagaccaagaacgtttcgccagactgcgtggttcgagccattgcggagcttggttcagctattgggtcaagaggtgtagtagcaggccagattgtggacattgatagtgaaggaaaagaagtaagcatgaagacgctagagtatattcatgtccataaaacagcaaagcttctagaggcatctgctgtttgtggggcaataatgggaggggcagatgatgcaagcattgaaaggcttagaaaatatgctaggtctattgggttgttgtatcaggtggtggatgatatattagatgcaaccaagtcctcagaggagctaggaaagacagccgggaaggatttggcaagtaacaaggctacatatcccaagttgatgggcatagatgaggccaagaaatttgctgctgagttggttgagcaagccaaaaaagaaattgctagctttgattctgccaaggctgtcccattgttccatttagctgactacattgctaggcgacagagttag

SEQ ID NO: 1544 - protein, 352 aa, Populus balsamifera subsp. trichocarpa
  misc_feature (1)..(352): Ceres ANNOT ID no. 1445504
  misc_feature (89)..(349): Pfam Name: polyprenyl_synt Pfam Description: Polyprenyl synthetase
  misc_feature: SWISSPROT Homolog: GGPP1_ARATH Geranylgeranyl pyrophosphate synthetase 1, with e-value of 2.2e-190 and BLAST sequence identity of 99.5
  misc_feature: SWISSPROT Homolog: GGPP1_ARATH GGPP synthetase 1 (GGPS1)
  misc_feature: SWISSPROT Homolog: GGPP1_ARATH Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_SINAL Geranylgeranyl pyrophosphate synthetase, with e-value of 4.9e-161 and BLAST sequence identity of 86.8
  misc_feature: SWISSPROT Homolog: GGPPS_SINAL GGPP synthetase (GGPS)
  misc_feature: SWISSPROT Homolog: GGPPS_SINAL Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_HEVBR Geranylgeranyl pyrophosphate synthetase, with e-value of 1.5e-127 and BLAST sequence identity of 67.6
  misc_feature: SWISSPROT Homolog: GGPPS_HEVBR GGPP synthetase
  misc_feature: SWISSPROT Homolog: GGPPS_HEVBR Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPPS_CATRO Geranylgeranyl pyrophosphate synthetase, with e-value of 7.4e-126 and BLAST sequence identity of 70.3
  misc_feature: SWISSPROT Homolog: GGPPS_CATRO GGPP synthetase (GGPS)
  misc_feature: SWISSPROT Homolog: GGPPS_CATRO Dimethylallyltranstransferase (EC 2.5.1.1); Geranyltranstransferase (EC 2.5.1.10); Farnesyltranstransferase (EC 2.5.1.29);
  misc_feature: SWISSPROT Homolog: GGPP3_ARATH Geranylgeranyl pyrophosphate synthetase 3, with e-value of 5.9e-117 and BLAST sequence identity of 65.1
  misc_feature: SWISSPROT Homolog: GGPP3_ARATH GGPP synthetase 3 (GGPS3)
  misc_feature: SWISSPROT Homolog: GGPP3_ARATH Dimethylallyltranstransferase (EC 2.5.1.1); Geranyltranstransferase (EC 2.5.1.10); Farnesyltranstransferase (EC 2.5.1.29);
  misc_feature 168464:<222: Transcription Factor
  misc_feature: Phenotype: FLOWER - Reduced fertility Useful for sterility, genetic confinement systems
  misc_feature: Phenotype: WHOLE PLANT - Other Useful for making bigger plants
  misc_feature (1)..(352): Functional Homolog of  Ceres CLONE ID no. 36701 at SEQ ID NO. 1580 with e-value of 3.90E-103 and BLAST sequence identity of 64.4
MAFSAIFRSFNSSFFLKNSINHLKNPPKTPRGHLYLSTMKFASSNLKQTNQAQEVPSLAFQFKEYMLTKLKQVNEALEEAVPLQHPIKIHEAMRYSLLGNGKRMCPILCIASCELVGGDEELAMPLACALEMVHAMSLIHDDLPCMDNDDLRRGKPTNHKVFGECIAILAGDALLSLAFEHIASKTKNVSPDCVVRAIAELGSAIGSRGVVAGQIVDIDSEGKEVSMKTLEYIHVHKTAKLLEASAVCGAIMGGADDASIERLRKYARSIGLLYQVVDDILDATKSSEELGKTAGKDLASNKATYPKLMGIDEAKKFAAELVEQAKKEIASFDSAKAVPLFHLADYIARRQS

SEQ ID NO: 1545 - protein, 149 aa, Arabidopsis thaliana
  misc_feature (1)..(149): Ceres CLONE ID no. 36709
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
MALNFFSTSLHPISNPSSSSRSKQSHHLLLQLSSPPATRVRSERSEIGVTDDNNNNNDTSSSSFSGSSSSSSVRTQLDLLEQLTSTSDGYLSDGGGSRGLTIRDQLAGLVGDRDDDFSIPLGKNLKKVSPLGTPPDFQLTPRHSQGTVS

SEQ ID NO: 1546 - DNA, 456 bp, Populus balsamifera subsp. trichocarpa
  misc_feature (1)..(456): Ceres ANNOT ID no. 1495936
  misc_feature 168646:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
atggccttgaatttcagtgcctcttctctttcccatgtatcctcttctaccaccggccctcagtttctaatcccagcacacaagcacctcctcaagctctacccctcttccttctcttgtactaaaacctctgctcaatcagaaggtgctgcaagtggagttacagagcaagacccttcttccttttcagggtctctgtcttccacacgcacacagctcgatctcctggaacaactcacctctgccaccccatccgctgatggttatgagagtgatggtggttctggtaaacttacaattcgtgagcagctggctcaattggttggagaaggagataatgatttcagcattccattgggtaaaaaaaacttgaagaaagttagtgccaagttcttaactgtttcacagaagagaaacattagaagacaagcttacctaaatcaactttttccatga

SEQ ID NO: 1547 - protein, 151 aa, Populus balsamifera subsp. trichocarpa
  misc_feature (1)..(151): Ceres ANNOT ID no. 1495936
  misc_feature 168708:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature (1)..(151): Functional Homolog of  Ceres CLONE ID no. 36709 at SEQ ID NO. 1589 with e-value of 3.19E-21 and BLAST sequence identity of 60.5
MALNFSASSLSHVSSSTTGPQFLIPAHKHLLKLYPSSFSCTKTSAQSEGAASGVTEQDPSSFSGSLSSTRTQLDLLEQLTSATPSADGYESDGGSGKLTIREQLAQLVGEGDNDFSIPLGKKNLKKVSAKFLTVSQKRNIRRQAYLNQLFP

SEQ ID NO: 1548 - protein, 444 aa, Arabidopsis thaliana
  misc_feature (1)..(444): Ceres CLONE ID no. 36891
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
MREILHIQGGQCGNQIGAKFWEVICGEHGIDQTGQSCGDTDLQLERINVYFNEASGGKYVPRAVLMDLEPGTMDSLRSGPFGQIFRPDNFVFGQSGAGNNWAKGHYTEGAELIDSVLDVVRKEAENCDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKMSTKEVDEQMMNVQNKNSSYFVEWIPNNVKSSVCDIAPTGLKMASTFIGNSTSIQEMFRRVSEQFTAMFRRKAFLHWYTGEGMDEMEFTEAESNMNDLVAEYQQYQDATVGEEEYEEDEEEEEA

SEQ ID NO: 1549 - DNA, 1338 bp, Populus balsamifera subsp. trichocarpa
  misc_feature (1)..(1338): Ceres ANNOT ID no. 1480518
  misc_feature 168938:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagaaatccttcacattcaagggggtcaatgtgggaatcaaattggggccaagttttgggaggtgatctgtgatgaacatgggattgatcagtcagggaggtacagtggagactcagatcttcaattggagaggattaatgtgtattacaatgaagcaagtggtggaagatatgtgccacgtgctgttcttatggatcttgaacctggtaccatggattcagtcagatctggtccttttggacagatttttaggcctgataacttcgtttttggccaatccggtgctggtaataactgggctaaagggcattacactgaaggagctgaattgattgattctgttcttgatgttgtcaggaaagaagctgaaaattgtgattgcttgcaaggatttcaagtttgccattctttgggtggaggcactggttctggcatgggaactcttcttatttctaaaattcgtgaggagtatcctgatcgcatgatgttgacattttccgtcttcccttcacctaaggtatctgacactgttgttgaaccatacaatgcaactctttctgtccaccagcttgtagaaaacgctgatgaatgcatggttttggacaatgaagctttgtatgacatctgcttccgcactctcaagcttgctacccccacttttggggatcttaaccatctcatttctgccaccatgagcggtgtcacatgctgccttcgcttcccaggacagctgaactctgacctacgaaagcttgcagttaaccttatcccattccctcgtcttcatttcttcatggttggatttgcacccttgacatcaagaggatcacagcaataccgtgctctgactgtgcctgaactaacccagcaaatgtgggatgccaagaacatgatgtgtgctgccgacccacgtcatggccgttatctaactgcttcagccatgttccgtggtaagatgagcactaaagaggtcgatgaacaaatgataaatgtccagaacaagaactcgtcatactttgttgagtggattcccaacaatgtaaagtccagtgtatgtgacatcccaccaaagggtctgaagatggcatccactttcatagggaattcaacttcaatccaggagatgttcaggcgtgtcagtgaacaattcacagctatgttcaggcgcaaggctttcttgcactggtacactggcgagggaatggacgagatggaatttaccgaggctgagagtaacatgaacgatctggttgctgagtatcagcaataccaggatgcaactatcgatgaagaggagtacgaggaggaagaggaagaggaacatgatacttaa

SEQ ID NO: 1550 - protein, 445 aa, Populus balsamifera subsp. trichocarpa
  misc_feature (1)..(445): Ceres ANNOT ID no. 1480518
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 169089:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(445): Functional Homolog of  Ceres CLONE ID no. 36891 at SEQ ID NO. 1592 with e-value of 4.10E-234 and BLAST sequence identity of 95.4
MREILHIQGGQCGNQIGAKFWEVICDEHGIDQSGRYSGDSDLQLERINVYYNEASGGRYVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPKGLKMASTFIGNSTSIQEMFRRVSEQFTAMFRRKAFLHWYTGEGMDEMEFTEAESNMNDLVAEYQQYQDATIDEEEYEEEEEEEHDT

SEQ ID NO: 1551 - DNA, 1608 bp, Populus balsamifera subsp. trichocarpa
  misc_feature (1)..(1608): Ceres ANNOT ID no. 1442194
  misc_feature 169234:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atggcctcattggctagtgaccacatttgtgacaagtgtccggaccagcttacgcgcacctcgactaatcccacagtccctgaagtaaacgaccatgttctcgaaaaagcaaccaataaaaacaacccaaaggcgaaggacacaaagaaccgtcctttatatcctcctttcccattccttcctcctcaatcccctctccccttaagatccaccaagaacaccaaaaccccatttctgaaacctgaaaaaggtccgaactttggtgccaaaatgagagaaattcttcacattcaaggaggtcaatgtgggaaccaaattggggccaagttttgggaggtgatctgtgatgaacatgggattgatcaaacagggaaatacagtggagactcggatcttcaattggagagaatcaatgtgtattacaatgaagcaagtggtggaagatatgttccacgtgctgttcttatggatcttgaacctggtactatggattcactcagatctggtccttatggacaaatttttaggcctgataactttgtttttggccaatctggtgctggtaataactgggctaaagggcattatactgaaggagctgaattgattgactctgttcttgatgttgtcaggaaagaagctgagaattgtgattgcttgcaaggatttcaagtttgccattctttgggtggaggcactggttctggcatgggaactcttcttatctctaaaatccgggaggagtatcctgaccgcatgatgttgacattttctgttttcccttctcctaaggtatctgacactgttgttgagccatacaacgccaccctttccgtccaccagctcgtggaaaatgccgatgaatgtatggttttggacaatgaagctttgtatgacatctgcttccgcactctcaagctcgctacccccacttttggtgatcttaaccacctcatttctgctaccatgagtggtgtcacatgctgccttcgcttccctggacagctgaactctgacctccgaaagcttgcagttaaccttatcccattccctcgccttcatttcttcatggtcggatttgcacccctgacatcaagaggatcacagcaataccgttctctgactgtgcctgaactaacccagcaaatgtgggatgccaagaacatgatgtgtgccgccgacccacgtcatggccgctacctaactgcttcagccatgttccgtggtaagatgagcacgaaagaggtcgatgaacaaatgataaatgtccagaacaagaactcttcatacttcgttgaatggatccccaacaacgttaagtccagtgtctgtgacatcccacctagaggtcttaagatggcatccactttcattggcaattcaacttcaatccaggagatgttcaggcgtgtcagtgagcaattcacagctatgttcaggcggaaagctttcttgcactggtacactggtgagggtatggatgagatggaatttaccgaggctgagagtaacatgaatgatctggtagctgagtaccagcaataccaggatgcaactgctgatgacgaggagtacgaggaggaggaagaagaggaaattggtgcttaa

SEQ ID NO: 1552 - protein, 445 aa, Populus balsamifera subsp. trichocarpa
  misc_feature (1)..(445): Ceres ANNOT ID no. 1442194
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 169393:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(445): Functional Homolog of  Ceres CLONE ID no. 36891 at SEQ ID NO. 1592 with e-value of 1.40E-233 and BLAST sequence identity of 95.2
MREILHIQGGQCGNQIGAKFWEVICDEHGIDQTGKYSGDSDLQLERINVYYNEASGGRYVPRAVLMDLEPGTMDSLRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRSLTVPELTQQMWDAKNMMCAADPRHGRYLTASAMFRGKMSTKEVDEQMINVQNKNSSYFVEWIPNNVKSSVCDIPPRGLKMASTFIGNSTSIQEMFRRVSEQFTAMFRRKAFLHWYTGEGMDEMEFTEAESNMNDLVAEYQQYQDATADDEEYEEEEEEEIGA

SEQ ID NO: 1553 - DNA, 1335 bp, Populus balsamifera subsp. trichocarpa
  misc_feature (1)..(1335): Ceres ANNOT ID no. 1454127
  misc_feature 169538:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgcgtgagattcttcacatccaaggaggccaatgcggcaatcaaattggtgcaaaattctgggaggtggtttgtgcagaacacggaattgatgcaactgggaaatggaatggagattctgagctgcagattgaaaggatcaatgtttattacaacgaggcaggtaatggccggtatgttccaagggctgtccttatggaccttgaacctggtactatggatagtgtcaggtccggtccttatggccagatcttcagacctgataattttgttttcggacaatctggtgccggaaacaactgggctaaaggccattacaccgagggtgccgagttgattgattctgtcctcgatgttgtccgaaaagaagcagagaattgtgattgcttgcagggatttcaggtgtgccattctttaggaggagggactggatccggtatgggaactcttttgatatcgaagatcagagaggaatatccagaccggatgatgcttaccttctccgtctttccctctcccaaggtttctgatacggttgttgagccttataatgcaaccctttctgtgcatcagcttgttgaaaatgcagatgaatgtatggtccttgataatgaagctctctatgacatctgcttccgtaccctcaaactcactactccaagctttggtgatttgaatcatttgatttctgctacaatgtctggggtcacatgttgcctgagatttccaggacagcttaactctgacctgagaaagcttgctgtgaatctgatccccttccctcggctccatttcttcatggtgggctttgctcctctgacctcacgtggttcgcagcagtacagtgccttgactgtcccagagctcacccagcaaatgtgggatgcaaagaacatgatgtgtgcagcagacccgcgccacggtcggtatctgacagcctcagcaatgttcaggggcaaaatgagtaccaaggaagttgatgagcagatgatcaatgttcaaaacaagaactcttcatactttgttgaatggatcccaaacaatgtcaaatcaactgtttgtgatattcctcctacaggactgaaaatggcatcgacattcattggaaactcgacatcaattcaggaaatgttccgtcgtgtgagcgagcagtttactgccatgtttaggaggaaggctttcttgcattggtacactggggaaggaatggatgagatggagttcacagaggcagagagcaacatgaatgatttggtttctgagtatcagcagtaccaagatgccacagccgatgaggactatgaggatgaagaggaggaactccatgacatgtga

SEQ ID NO: 1554 - protein, 444 aa, Populus balsamifera subsp. trichocarpa
  misc_feature (1)..(444): Ceres ANNOT ID no. 1454127
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 169689:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(444): Functional Homolog of  Ceres CLONE ID no. 36891 at SEQ ID NO. 1592 with e-value of 1.29E-228 and BLAST sequence identity of 93.1
MREILHIQGGQCGNQIGAKFWEVVCAEHGIDATGKWNGDSELQIERINVYYNEAGNGRYVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYSALTVPELTQQMWDAKNMMCAADPRHGRYLTASAMFRGKMSTKEVDEQMINVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEDYEDEEEELHDM

SEQ ID NO: 1555 - DNA, 1356 bp, Populus balsamifera subsp. trichocarpa
  misc_feature (1)..(1356): Ceres ANNOT ID no. 1461716
  misc_feature 169834:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgcgcgagatccttcacattcaaggcgggcaatgcggcaaccaaataggagccaagttctgggaagtcgtctgcgcagaacacggcatagactccaccggccgttaccaaggcgactcccctctccagcttgaaagaatcaatgtgtattacaatgaagctagttgcggtcggtttgttcctcgtgctgtcctcatggatttggagcctggaaccatggacagcgtcagatctggtccctatggtcagatcttcagacctgacaacttcgttttcggccaatctggtgctggaaacaactgggctaaaggtcactacactgaaggcgctgaactcatcgattctgtcctcgatgttgttcgaaaagaagccgagaattgtgactgcttacaagggtttcaagtgtgtcattctcttggaggtggaaccgggtctggaatgggaaccctattgatatcgaagattagagaagaatacccagatagaatgatgttgacattctccgtgtttccttctccaaaggtgtctgatacagttgttgagccttataatgctactttgtctgttcatcaacttgtcgagaatgctgacgagtgtatggttctcgataacgaggccttgtatgatatctgtttcaggactctgaaactcaccactcctagctttggtgacttgaatcatctgatatctgcaacaatgtctggggttacatgctgcttgaggttccctggtcagttgaactctgacctgagaaaacttgcagtgaacttgataccgttccctcgtcttcactttttcatggtgggttttgcaccactcacatcccgtggctcgcagcagtacagagctttgacagttccagaactcactcaacaaatgtgggattcgaagaacatgatgtgtgcggctgatccgcgacatggacgctatctaacagcatcagccatgttccgtggcaagatgagtacaaaagaagtagatgagcagatgctgaacgtgcagaacaagaactcttcttactttgttgagtggattccaaacaatgtaaagtcaactgtgtgtgatatcccgcctactggtcttcagatggcatccacatttattggcaattcaacatctatacaggagatgtttaggagggttagtgagcaatttactgccatgtttaggaggaaggctttcttgcattggtatactggggaaggaatggatgagatggagttcactgaggcggagagtaacatgaatgatctggtttctgagtatcagcaataccaagatgcaacagctgatgaggaaggagagtacgaggaggaggaggaggaaggagatgaatatcagcaagactatcagtag

SEQ ID NO: 1556 - protein, 451 aa, Populus balsamifera subsp. trichocarpa
  misc_feature (1)..(451): Ceres ANNOT ID no. 1461716
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 169985:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(451): Functional Homolog of  Ceres CLONE ID no. 36891 at SEQ ID NO. 1592 with e-value of 4.50E-228 and BLAST sequence identity of 93.1
MREILHIQGGQCGNQIGAKFWEVVCAEHGIDSTGRYQGDSPLQLERINVYYNEASCGRFVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSTVCDIPPTGLQMASTFIGNSTSIQEMFRRVSEQFTAMFRRKAFLHWYTGEGMDEMEFTEAESNMNDLVSEYQQYQDATADEEGEYEEEEEEGDEYQQDYQ

SEQ ID NO: 1557 - DNA, 1338 bp, Populus balsamifera subsp. trichocarpa
  misc_feature (1)..(1338): Ceres ANNOT ID no. 1440277
  misc_feature 170133:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagaaatccttcacattcaaggaggacagtgcggtaaccaaatcggctccaagttctgggaggttgtttgcgctgagcatggaattgatcccactggaaaatacactggatcctctgaccttcaattggagcgcgtcaatgtttattacaatgaggcttcatgcggacgatttgtccctcgcgctgtgcttatggatcttgagcctggtactatggacagtgtgaggactggtccctatggccagatctttaggcctgataactttgtgtttggacagtctggcgctggaaataactgggccaagggtcattatactgagggtgcggagttgattgattcggttcttgatgttgtgaggaaggaggcagagaattgtgattgtcttcaaggatttcaagtttgccactcactcggtggaggaactggttctgggatggggactcttttgatttctaagatcagagaggaataccctgatagaatgatgcttactttctctgtgttcccatcacctaaggtttctgatactgttgtggagccatataatgccaccctttctgttcatcagttggttgagaacgctgatgagtgtatggtgcttgacaatgaggccttgtatgatatctgcttcaggactctcaagttgactactcctagctttggtgacctcaatcatctgatctctgcaacaatgagtggggttacctgctgcctcaggtttcctggccagctgaattctgatcttaggaagcttgctgtgaaccttatccccttcccccgcctgcacttcttcatggttggatttgctcctctgacctctcgtggctctcagcagtacaggtcactaactgtcccagaactcacccagcagatgtgggattccaagaacatgatgtgcgccgcagacccacgccacggtcgctatctgactgcctctgccatgttcaggggtaagatgagcactaaagaagttgatgaacaaatgatgaatgtccaaaacaagaattcctcctactttgtggagtggattccaaacaatgtcaagtccagtgtgtgtgatattcctccaatagggcttgctatggcatccaccttcattggaaactcaacctccatccaggagatgttcaggcgtgtgagtgagcaattcacagctatgttcaggaggaaggctttcttgcactggtacaccggggaaggcatggatgagatggagttcaccgaggctgaaagcaacatgaatgatctcgtgtctgaatatcagcaataccaggatgcaaccgttgatgaagaacttgagtacgaggatgaggaggaggaagaggctgcctag

SEQ ID NO: 1558 - protein, 445 aa, Populus balsamifera subsp. trichocarpa
  misc_feature (1)..(445): Ceres ANNOT ID no. 1440277
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 170284:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(445): Functional Homolog of  Ceres CLONE ID no. 36891 at SEQ ID NO. 1592 with e-value of 5.80E-228 and BLAST sequence identity of 92.3
MREILHIQGGQCGNQIGSKFWEVVCAEHGIDPTGKYTGSSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRSLTVPELTQQMWDSKNMMCAADPRHGRYLTASAMFRGKMSTKEVDEQMMNVQNKNSSYFVEWIPNNVKSSVCDIPPIGLAMASTFIGNSTSIQEMFRRVSEQFTAMFRRKAFLHWYTGEGMDEMEFTEAESNMNDLVSEYQQYQDATVDEELEYEDEEEEEAA

SEQ ID NO: 1559 - DNA, 1341 bp, Populus balsamifera subsp. trichocarpa
  misc_feature (1)..(1341): Ceres ANNOT ID no. 1461415
  misc_feature 170429:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagggaaatccttcacattcaaggaggacaatgcgggaaccagatcggttccaagttctgggaggttgtttgcgatgagcatggaattgatcccactggaaaatacgttggaacctctgaccttcaattggagcgtgtcaatgtttactacaatgaggcttcgtgtgggagatttgtccctcgtgctgtgcttatggatcttgagcctggtaccatggacagtttgaggactggtccttatggccagatcttcaggcctgataactttgtgtttgggcagtctggtgctggaaataactgggccaaagggcattacactgagggtgcggagttgattgattcagttcttgatgttgtgaggaaggaagcagaaaattgtgattgtcttcaaggttttcaagtttgccactcgctcggtggaggaactggatctggaatggggactctactgatttctaagatcagagaggaataccctgatagaatgatgcttactttctctgtgttcccatcacctaaggtttctgatactgtcgtggagccatacaatgctaccctttctgttcatcagttggttgagaatgctgatgagtgtatggtgcttgacaacgaggcattgtatgatatttgtttcaggattctcaagttgactactcctagctttggcgacctgaatcatctgatctctgcaacaatgagcggtgtcacctgctgtctcaggttccctggtcagctcaactctgatcttaggaagcttgcagtgaacctcatccccttcccccgtctgcactttttcatggttggatttgctcctctgacctcacgtggttctcagcagtacagggctctgactgtcccagaactcacccagcagatgtgggatgccaagaacatgatgtgcgctgctgacccacgccatggtcgctacctgactgcctccgctatgttccggggtaagatgagcactaaggaagttgatgaacaaatgatcaatgtccagaacaagaattcatcctactttgttgagtggatccccaacaatgtgaagtctagtgtgtgtgatattcctccgagaggacttgctatggcatccaccttcattggaaactcaacctccatccaggagatgttcaggcgtgtaagtgagcaattcacagctatgttcaggaggaaggctttcttgcactggtacaccggagaaggcatggatgaaatggaattcactgaagctgagagcaacatgaatgacctcgtgtctgaatatcagcagtaccaggatgcaacagctgatgaagaagttgattatgaggatgaggaggaagaagaggctgagatgtga

SEQ ID NO: 1560 - protein, 446 aa, Populus balsamifera subsp. trichocarpa
  misc_feature (1)..(446): Ceres ANNOT ID no. 1461415
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 170580:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(446): Functional Homolog of  Ceres CLONE ID no. 36891 at SEQ ID NO. 1592 with e-value of 5.19E-227 and BLAST sequence identity of 92.3
MREILHIQGGQCGNQIGSKFWEVVCDEHGIDPTGKYVGTSDLQLERVNVYYNEASCGRFVPRAVLMDLEPGTMDSLRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRILKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLAMASTFIGNSTSIQEMFRRVSEQFTAMFRRKAFLHWYTGEGMDEMEFTEAESNMNDLVSEYQQYQDATADEEVDYEDEEEEEAEM

SEQ ID NO: 1561 - DNA, 1344 bp, Populus balsamifera subsp. trichocarpa
  misc_feature (1)..(1344): Ceres ANNOT ID no. 1461414
  misc_feature 170725:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagaaatccttcacgttcagggaggacaatgtggtaaccaaattggatcgaagttttgggaggtggtttgcgatgagcatggaattgatcccactggaaaatacgttggaacctctgaccttcaattggagcgtgtcaatgtttactacaatgaggcttcgtgtgggagatttgtccctcgtgctgtgcttatggatcttgagcctggtaccatggacagtgtgaggaccggtccctatggccagatctttaggcctgataactttgtgtttgggcagtctggtgctggaaataattgggctaaggggcattacactgagggtgcagagttgattgattcggttcttgatgttgtgaggaaggaggcggagaattgtgattgtcttcaaggtttccaagtttgccactcgctcggtggaggaactggttccgggatggggactctgctgatttctaagatcagagaggagtaccctgatagaatgatgcttacgttctctgtgttcccatcccccaaggtttcagatactgttgttgagccttacaatgctaccctttcagttcatcagttagttgagaatgctgatgaatgtatggtgctagataacgaggccttgtatgatatctgcttcaggactctcaagttaacaactcctagctttggcgacctgaaccacctgatctctgcaacaatgagcggtgtcacctgctgcctcaggttccctggtcagctcaactctgatcttaggaagcttgcagtgaacctcatccccttcccccgtctgcactttttcatggttggatttgctcctctgacctcacgtggttctcagcagtacagggctctgactgtcccagaactcacccagcagatgtgggatgccaagaacatgatgtgcgctgctgacccacgccatggtcgctacctgactgcctccgctatgttccggggtaagatgagcactaaggaagttgatgaacaaatgatcaatgtccagaacaagaattcatcctactttgttgagtggatccccaacaatgtgaagtctagtgtgtgtgatattcctccaagaggacttgctatggcatccaccttcattggaaactcaacctccatccaggagatgttcaggcgtgtaagtgagcaattcacagctatgttcaggaggaaggctttcttgcactggtacaccggagaaggcatggatgaaatggaattcactgaagctgagagcaacatgaatgacctcgtttctgaatatcagcagtaccaggatgcaacagctgatgaagaagttgattatgaggacgaggaggaagaagatgctgccgggatgtaa

SEQ ID NO: 1562 - protein, 447 aa, Populus balsamifera subsp. trichocarpa
  misc_feature (1)..(447): Ceres ANNOT ID no. 1461414
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 170876:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(447): Functional Homolog of  Ceres CLONE ID no. 36891 at SEQ ID NO. 1592 with e-value of 6.59E-227 and BLAST sequence identity of 91.8
MREILHVQGGQCGNQIGSKFWEVVCDEHGIDPTGKYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLAMASTFIGNSTSIQEMFRRVSEQFTAMFRRKAFLHWYTGEGMDEMEFTEAESNMNDLVSEYQQYQDATADEEVDYEDEEEEDAAGM

SEQ ID NO: 1563 - DNA, 1341 bp, Populus balsamifera subsp. trichocarpa
  misc_feature (1)..(1341): Ceres ANNOT ID no. 1447424
  misc_feature 171021:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagaaatccttcacatccaaggaggccaatgcggcaaccaaataggagcaaagttttgggaagtagtatgtgcagaacacgggattgactcaaccggtcggtatcatggtgactcggctctccaactcgagcgagttaatgtttactataatgaagccagctgtggaaggtttgtccctcgtgctgttttaatggatcttgaaccgggtactatggatagtgttagatccggtccttatggacagatttttagaccggataattttgtgtttggccaatctggtgctggtaacaactgggctaaagggcattatacggagggcgcggagttgattgattctgttcttgatgttgttaggaaggaggctgagaactgtgactgcttgcaaggatttcaggtatgccactcactggggggtggcacagggtctggaatgggaacactcttgatctcgaaaataagagaggaatacccagatcgaatgatgctaacattctctgtcttcccatctccaaaggtctcagacactgtcgttgagccttacaatgcaactctctctgttcaccagcttgttgagaatgctgatgagtgtatggttcttgataatgaggctctttatgatatctgcttccgtactctcaagctcacaactcccagctttggggatctgaaccacctgatttcagccaccatgagtggtgttacatgctgccttcgtttccctggtcagctcaattcagaccttcgcaaacttgctgtgaacctcatcccattcccccgtcttcactttttcatggttggctttgcacctctcacatcccgtggctcacagcaataccgtgccctaactgtacctgaactcacccaacaaatgtgggatgccaagaatatgatgtgtgctgctgatcctcgccatggcagatatctcacagcctctgcgatgtttcgtggcaaaatgagcacgaaggaagttgatgagcagatgatcaacgttcaaaacaagaactcatcctactttgttgaatggatccccaacaacgtcaagtccactgtctgtgacattcctcctacaggcttgacaatggcttccactttcattggcaactcaacatcaatccaagagatgttcagaagagttagtgagcagttcactgccatgttccgcaggaaggctttcttgcattggtacactggagagggaatggatgagatggaatttacagaggctgagagcaacatgaatgatttggtctcagagtaccagcaataccaggacgcaactgctgatgaggaaggcgagtatgaagatgaggaagcataccaggacgaggattaa

SEQ ID NO: 1564 - protein, 446 aa, Populus balsamifera subsp. trichocarpa
  misc_feature (1)..(446): Ceres ANNOT ID no. 1447424
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 171172:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(446): Functional Homolog of  Ceres CLONE ID no. 36891 at SEQ ID NO. 1592 with e-value of 1.40E-226 and BLAST sequence identity of 92.0
MREILHIQGGQCGNQIGAKFWEVVCAEHGIDSTGRYHGDSALQLERVNVYYNEASCGRFVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSTVCDIPPTGLTMASTFIGNSTSIQEMFRRVSEQFTAMFRRKAFLHWYTGEGMDEMEFTEAESNMNDLVSEYQQYQDATADEEGEYEDEEAYQDED

SEQ ID NO: 1565 - DNA, 1353 bp, Populus balsamifera subsp. trichocarpa
  misc_feature (1)..(1353): Ceres ANNOT ID no. 1528127
  misc_feature 171317:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagagatccttcacgtgcaaggtggtcagtgcggtaaccagattggttccaagttctgggaagttgtgtgtgatgagcatggaatagacccgactggaaggtatgttggttcatcagatctgcagttggagcgtgtgaatgtgtactacaatgaggcttcttgtgggaggtttgttccacgtgcagtgcttatggacttggagcctggtaccatggacagtgttcgtactggtccgtatgggcagattttcaggccggataactttgtgtttggacaatctggtgctggaaacaactgggctaaggggcattacactgagggagcagagcttattgattctgttcttgatgttgtaaggaaggaggcagagaactgtgactgtcttcaaggtttccaagtgtgccactcattgggtggtggaactggttcgggaatgggcaccttgctcatctcaaaaatacgtgaggagtaccctgacaggatgatgttgaccttctctgtttttccctccccaaaggtttcagatactgtggttgagccatacaatgccaccctgtctgtgcatcaacttgttgagaatgctgatgagtgcatggttctggataacgaggctttgtatgatatctgcttcaggactcttaaattgactactccaagctttggtgatcttaaccacttgatttctgcaaccatgagtggtgtcacttgctgcctgaggttccctggtcagctcaactcggacctccgaaagcttgctgtgaatctcattccctttcctcgtctccacttcttcatggttggttttgctcctttgacctctcgtggatcccagcaataccgtgccctcactgttccagaactgacccagcaaatgtgggattccaagaatatgatgtgcgctgctgacccaaggcatggtcgctatctcactgcctctgctatgttccgtggcaagatgagcaccaaggaagtggatgagcagatgatcaatgtccaaaacaagaattcgtcatactttgttgagtggattccaaacaatgtgaaatccagtgtctgtgacatcccaccaaggggactcgccatggcatccaccttcattggaaattccacctccatccaggaaatgttcaggagagtcagcgagcaattcactgctatgttcaggagaaaagctttcttgcattggtacactggtgaaggtatggatgagatggagttcacagaagctgagagcaacatgaatgatctcgtgtccgagtaccagcagtaccaggatgccactgctgacgaggagggtgagtacgatgacgaggaggaagaggagggtcagtatgcggagcagatgtga

SEQ ID NO: 1566 - protein, 450 aa, Populus balsamifera subsp. trichocarpa
  misc_feature (1)..(450): Ceres ANNOT ID no. 1528127
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 171468:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(450): Functional Homolog of  Ceres CLONE ID no. 36891 at SEQ ID NO. 1592 with e-value of 1.40E-226 and BLAST sequence identity of 91.8
MREILHVQGGQCGNQIGSKFWEVVCDEHGIDPTGRYVGSSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMINVQNKNSSYFVEWIPNNVKSSVCDIPPRGLAMASTFIGNSTSIQEMFRRVSEQFTAMFRRKAFLHWYTGEGMDEMEFTEAESNMNDLVSEYQQYQDATADEEGEYDDEEEEEGQYAEQM

SEQ ID NO: 1567 - DNA, 1344 bp, Populus balsamifera subsp. trichocarpa
  misc_feature (1)..(1344): Ceres ANNOT ID no. 1438717
  misc_feature 171616:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagggaaatccttcacatccaaggaggtcaatgtggaaaccaaataggagcaaagttttgggaagtggtatgtgcagaacacgggattgactcaacgggtcggtaccaaggtgactcagctcttcaaatagagcgagttaatgtttactataacgaagccagttgtggaaggtttgtgcctcgcgctgttttaatggatcttgaaccgggcactatggatagtgttagatctggtccgtatgggcagatatttagaccggataattttgtgtttgggcaatctggtgccggtaataactgggctaaagggcattatactgagggagccgagttgattgattctgttcttgatgttgtgagaaaggaggctgagaactgtgactgcttgcaagggtttcaggtatgccactcattgggaggtggtacagggtccgggatgggaacactattgatctcgaaaataagagaggaatacccagatcgaatgatgctcacattctcagtgttcccatccccaaaggtctcggacactgtggtcgagccttacaatgcaactctctctgttcaccagcttgttgaaaatgcagatgagtgtatggttcttgataatgaagccctttacgatatctgcttccgtactctcaagctcacaactcccagctttggggatctgaaccacctgatttctgctaccatgagtggtgttacatgctgccttcgtttccccggtcagctcaactcagaccttcgcaaacttgctgtgaacctcatcccattcccccggcttcattttttcatggttggctttgcgcctctcacatcccgtggctctcagcaataccgtgccctgactgtacctgaactcacccaacaaatgtgggatgccaagaacatgatgtgtgctgctgatcctcgccatggcagatatctcacagcatctgcaatgtttcgtggcaaaatgagcacaaaggaagttgacgagcagatgatcaatgtccaaaacaagaactcgtcctactttgttgaatggatccccaacaatgtcaagtccacggtctgtgacatccctcctacaggcttgacaatggcttccacattcattggcaactccacatcaatccaagaaatgtttagaagagttagtgagcagttcactgccatgttccgcaggaaggccttcttgcattggtacactggagagggaatggatgagatggaatttacagaggctgagagcaacatgaatgatttggtctcagagtaccagcaataccaggatgcaactgctgatgaagaaggcgagtttgaagatgaggaggaagcatacggggatgaggcctaa

SEQ ID NO: 1568 - protein, 447 aa, Populus balsamifera subsp. trichocarpa
  misc_feature (1)..(447): Ceres ANNOT ID no. 1438717
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 171767:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(447): Functional Homolog of  Ceres CLONE ID no. 36891 at SEQ ID NO. 1592 with e-value of 1.80E-226 and BLAST sequence identity of 92.5
MREILHIQGGQCGNQIGAKFWEVVCAEHGIDSTGRYQGDSALQIERVNVYYNEASCGRFVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSTVCDIPPTGLTMASTFIGNSTSIQEMFRRVSEQFTAMFRRKAFLHWYTGEGMDEMEFTEAESNMNDLVSEYQQYQDATADEEGEFEDEEEAYGDEA

SEQ ID NO: 1569 - DNA, 1344 bp, Populus balsamifera subsp. trichocarpa
  misc_feature (1)..(1344): Ceres ANNOT ID no. 1440276
  misc_feature 171912:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagaaatccttcacattcaaggaggacagtgcggcaaccaaatcggttccaagttctgggaggttgtttgcgctgagcatggaattgatcctactggaaaatacactggatcctctgaccttcaattggagcgtgtcaatgtttattacaatgaggcctcgtgcgggcgatttgtccctcgcgctgtgcttatggatcttgagcctggtactatggacagtgtgaggactggtccctatggccagatctttaggcctgataactttgtgtttggacagtctggcgctggaaataactgggccaagggtcattacacggagggtgcggagttgattgattcggttcttgatgttgtgaggaaggaagcagagaattgtgattgtcttcaaggatttcaagtttgccactcactcggtggaggaactggttctgggatggggactcttttgatttctaagatcagagaggaataccctgatagaatgatgctcactttctctgtgttcccatcacccaaggtttctgatactgttgtggagccatataatgccaccctttctgttcatcagttggttgagaacgctgatgagtgtatggtgcttgacaatgaggccttgtatgatatctgcttcaggactctcaagttgactactcctagctttggtgacctcaatcatctgatttctgcaacaatgagtggtgtcacctgctgcctcaggtttcctgggcagcttaactctgatcttaggaagcttgcagtgaacctcatccccttcccccgtttgcacttcttcatggttggatttgctcctctgacttcacgaggttctcagcagtaccgggcactaactgtcccagaactcacccagcagatgtgggattccaagaacatgatgtgcgctgcagacccgcgccacggtcgctatctgactgcctctgccatgttcaggggtaagatgagcactaaagaagttgatgaacagatgatcaatgtccaaaacaagaattcctcctactttgtggagtggattccaaacaatgtcaagtccagtgtgtgtgatattcctccaatagggcttgcaatggcatccaccttcatcggaaactcaacctccatccaggagatgttcaggcgtgtgagcgagcaattcacagctatgttcaggaggaaggctttcttgcactggtacaccggggaaggcatggatgaaatggagttcaccgaggctgaaagcaacatgaatgacctcgtgtctgaatatcagcaataccaggatgcaactgctgaggatgatattgactacgaggatgaggaggaggaagaggctgctgagatgtaa

SEQ ID NO: 1570 - protein, 447 aa, Populus balsamifera subsp. trichocarpa
  misc_feature (1)..(447): Ceres ANNOT ID no. 1440276
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 172063:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(447): Functional Homolog of  Ceres CLONE ID no. 36891 at SEQ ID NO. 1592 with e-value of 2.20E-226 and BLAST sequence identity of 91.6
MREILHIQGGQCGNQIGSKFWEVVCAEHGIDPTGKYTGSSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMINVQNKNSSYFVEWIPNNVKSSVCDIPPIGLAMASTFIGNSTSIQEMFRRVSEQFTAMFRRKAFLHWYTGEGMDEMEFTEAESNMNDLVSEYQQYQDATAEDDIDYEDEEEEEAAEM

SEQ ID NO: 1571 - DNA, 1350 bp, Populus balsamifera subsp. trichocarpa
  misc_feature (1)..(1350): Ceres ANNOT ID no. 1442556
  misc_feature 172208:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagagatccttcatattcaaggaggccaatgcggtaaccaaatcggtgccaaattctgggaagttatatgcgacgagcacggaatcgatcaaaacggaaagtactccggcgacgcggcgtcttctgatcttcaactggaaaggatcaatgtgtattacaatgaagcttcaggtggaaaatatgtgccgagggcggtccttatggatcttgaaccgggtactatggagagtattagatccggtccgtatggacagatctttagacctgataattttgtgcatggacagtccggcgctggtaataattgggctaaaggtcattacactgaaggagctgagctgattgatgctgttcttgacgttgtcagaaaagaggctgagaattgtgattgcttgcaaggctttcaggtgtgccactcgcttggaggtggtacaggttctggcatgggaacacttctaatttcaaagatccgagaggaatatcctgacaggatgatgcttacattctctgttttcccttcaccaaaggtctcggacacggttgtggagccatataatgctaccctctcagtgcatcagttggtagagaatgctgacgaatgcatggttcttgacaatgaagcactgtatgacatatgcttccggactctaaagcttagcactccaagctttggtgaccttaaccatttgatctctgcaactatgagcggtgtaacttgctgtctgaggttccctggtcagctcaactctgaccttcgcaagctggctgtaaacctgatcccatttccccgtcttcacttcttcatggtagggtttgcaccactcacatctcgtggttcccaggggtatatctccctcactgtcccagagctgacccagcagatgtgggattctaagaacatgatgtgtgctgctgacccccgccatggccgctacttgacagcctcagccatgttcaggggcaagatgagcaccaaagaggtggatgaacagatgattaatgtgcagaacaagaattcatcatattttgtggagtggattcccaacaatgtgaagtctagcgtgtgtgatattgcaccaaaaggtctgacgatggcatcgacttttgtggggaactccacgtcaatccaggagatgttcaggagggtgagtgagcagttcacagccatgttccgtcgcaaggccttcttgcactggtatactggggaagggatggatgagatggagttcactgaagcagagagcaacatgaacgatctcgtggcagagtaccagcaataccaggatgcaacaattgaggaagatggtgaatatgaggaggaaggtgaagagaactatgatgcctag

SEQ ID NO: 1572 - protein, 449 aa, Populus balsamifera subsp. trichocarpa
  misc_feature (1)..(449): Ceres ANNOT ID no. 1442556
  misc_feature (249)..(386): Pfam Name: Tubulin_C Pfam Description: Tubulin/FtsZ family, C-terminal domain
  misc_feature (48)..(247): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 172359:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(449): Functional Homolog of  Ceres CLONE ID no. 36891 at SEQ ID NO. 1592 with e-value of 3.70E-226 and BLAST sequence identity of 92.9
MREILHIQGGQCGNQIGAKFWEVICDEHGIDQNGKYSGDAASSDLQLERINVYYNEASGGKYVPRAVLMDLEPGTMESIRSGPYGQIFRPDNFVHGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCCLRFPGQLNSDLRKLAVNLIPFPRLHFFMVGFAPLTSRGSQGYISLTVPELTQQMWDSKNMMCAADPRHGRYLTASAMFRGKMSTKEVDEQMINVQNKNSSYFVEWIPNNVKSSVCDIAPKGLTMASTFVGNSTSIQEMFRRVSEQFTAMFRRKAFLHWYTGEGMDEMEFTEAESNMNDLVAEYQQYQDATIEEDGEYEEEGEENYDA

SEQ ID NO: 1573 - DNA, 1350 bp, Populus balsamifera subsp. trichocarpa
  misc_feature (1)..(1350): Ceres ANNOT ID no. 1452873
  misc_feature 172507:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagagatccttcacattcaaggaggccaatgcggaaaccaaatcggttccaaattctgggaagttatttgcggcgaacatggaattgatactaccgggaagtactcaggcgacgccgcgtcgtctgatcttcaactggaaagaattaatgtatattacaacgaggcttccggcggaaaatatgtgccgagggcggtcctcatggatcttgaaccgggtacaatggagagtattagatccggaccgtacggacagatctttaggcctgataattttgtgcatggacagtctggtgctggtaataattgggctaaaggtcattacactgaaggagctgagttgattgatgctgttcttgatgttgtcagaaaagaggccgagaattgtgattgcttgcaaggctttcaggtatgccactcgcttggaggtggtacaggttctggcatgggaacacttctgatttcaaagattcgagaggaatatcctgacaggatgatgcttacattctctgttttcccttcaccaaaggtctcagacacagttgtggagccatataatgccaccctctcagtgcatcagttggtagagaatgctgacgaatgcatggttcttgacaatgaagcactttatgacatctgcttccggactctaaagcttagcactccaagctttggtgaccttaaccatttgatctctgaaactatgagtggtgtgacatgctgtctgaggttcccgggccagctcaactctgaccttcgcaagctagctgtaaacctgatcccatttccacgtcttcacttcttcatggtagggtttgcacctctcacatctcgcggttcccaggggtatatctccctcaccgtcccagagctgacccagcagatgtgggattccaagaacatgatgtgtgctgctgacccccgccatggccgctacttgacagcttcagccatgttcaggggcaagatgagcaccaaagaggtggatgaacagatgattaatgtgcagaacaaaaattcatcgtattttgtggagtggattccaaacaatgtgaagtctagtgtgtgtgatattccaccaaagggtctgaagatgtcatcaacttttgtggggaactccacgtcaatccaggagatgttcaggagggtgagtgagcaattcacagccatgttccgtcgcaaggcctttttgcactggtataccggggaagggatggatgagatggagttcactgaagcagagagcaacatgaacgatctagtggcagagtaccagcagtaccaggatgcaacagttgaggaagatggtgaatacgaggaggaaggtgaggagaactatgatgactga

SEQ ID NO: 1574 - protein, 449 aa, Populus balsamifera subsp. trichocarpa
  misc_feature (1)..(449): Ceres ANNOT ID no. 1452873
  misc_feature (249)..(386): Pfam Name: Tubulin_C Pfam Description: Tubulin/FtsZ family, C-terminal domain
  misc_feature (48)..(247): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 172658:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(449): Functional Homolog of  Ceres CLONE ID no. 36891 at SEQ ID NO. 1592 with e-value of 7.59E-226 and BLAST sequence identity of 92.7
MREILHIQGGQCGNQIGSKFWEVICGEHGIDTTGKYSGDAASSDLQLERINVYYNEASGGKYVPRAVLMDLEPGTMESIRSGPYGQIFRPDNFVHGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISETMSGVTCCLRFPGQLNSDLRKLAVNLIPFPRLHFFMVGFAPLTSRGSQGYISLTVPELTQQMWDSKNMMCAADPRHGRYLTASAMFRGKMSTKEVDEQMINVQNKNSSYFVEWIPNNVKSSVCDIPPKGLKMSSTFVGNSTSIQEMFRRVSEQFTAMFRRKAFLHWYTGEGMDEMEFTEAESNMNDLVAEYQQYQDATVEEDGEYEEEGEENYDD

SEQ ID NO: 1575 - DNA, 1347 bp, Populus balsamifera subsp. trichocarpa
  misc_feature (1)..(1347): Ceres ANNOT ID no. 1453483
  misc_feature 172806:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagagatccttcacatacagggtggtcagtgcggtaaccagattggttcaaagttctgggaagttgtttgtgatgagcatggaatagacccgacaggaaggtacattggttcatcagatctgcagttggagcgtgtgaatgtgtactacaatgaggcttcgtgtgggaggtttgttcctcgtgcagtgctcatggacttggagcctggtactatggacagtgttcgtactggtccttatgggcagattttcaggcctgataactttgtatttggacaatctggtgctggaaacaactgggcgaaggggcattatactgagggagcggagcttattgattctgttcttgatgttgtaaggaaggaggcagagaattgtgactgtctccaaggtttccaagtgtgccactccctgggtggtggaactggatcaggaatgggtaccttgctcatctcgaaaatccgtgaggagtaccctgataggatgatgctgacattctctgtgtttccctccccaaaggtttcagatacagtggttgagccatacaatgccacactttctgtacatcagcttgttgagaatgctgatgagtgcatggttctggataacgaggctttatatgatatttgcttcaggactcttaaattgactactcccagctttggtgatcttaaccacttgatttctgcaactatgagtggtgtcacttgctgcctgaggttccctggtcagctcaactctgacctccgaaagcttgctgtgaatctcatccccttccctcgtctccacttcttcatggttggctttgctcctctgacctcccgtggatcccagcaatatcgtgccctcactgttcctgaactgacccagcaaatgtgggatgccaagaacatgatgtgtgctgctgacccaaggcatggtcgctaccttactgcctctgccatgttccgtggcaagatgagcaccaaggaagtagacgagcagatgatcaatgtccaaaacaagaactcatcatactttgttgagtggattccacacaacgtgaaatccagtgtctgtgacatcccaccaaggggacttgccatggcatccaccttcattggaaactccacctccatccaggaaatgttcaggagagtcagtgagcaattcactgccatgttcaggagaaaagctttcttgcattggtacactggtgaaggaatggacgaaatggaattcacagaagcggagagtaacatgaatgatcttgtgtccgagtatcagcagtatcaagatgccactgctgatgaggagggtgagtacgaagacgaggaagatggccagtacgcggagcagatgtga

SEQ ID NO: 1576 - protein, 448 aa, Populus balsamifera subsp. trichocarpa
  misc_feature (1)..(448): Ceres ANNOT ID no. 1453483
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 172957:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(448): Functional Homolog of  Ceres CLONE ID no. 36891 at SEQ ID NO. 1592 with e-value of 1.20E-225 and BLAST sequence identity of 91.4
MREILHIQGGQCGNQIGSKFWEVVCDEHGIDPTGRYIGSSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPHNVKSSVCDIPPRGLAMASTFIGNSTSIQEMFRRVSEQFTAMFRRKAFLHWYTGEGMDEMEFTEAESNMNDLVSEYQQYQDATADEEGEYEDEEDGQYAEQM

SEQ ID NO: 1577 - DNA, 1335 bp, Populus balsamifera subsp. trichocarpa
  misc_feature (1)..(1335): Ceres ANNOT ID no. 1473384
  misc_feature 173105:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgcgtgagattcttcacattcaaggagggcaatgtgggaaccaaattggatcaaaattctgggaggtggtttgtgatgaacatgggattgatccaaccggccagtacatcggaaagacggacttacagctagagagagtgaatgtgtattacaatgaggctagtaacggccggtatgtgccacgggctgttcttatggaccttgagcctggcactatggacagcgtcaggaccggtccatacgggcagattttccggcctgataatttcgttttcgggcaatcgggggcaggaaacaattgggctaaaggccattacaccgagggtgctgagcttattgactcggtcctggatgttgtcaggaaagaggctgagaattgtgactgcttacaaggatttcaagtatgccactcccttggtgggggaactgggtctggaatgggaactttgctgatttcaaaaatcagagaagagttcccggatagaatgatgctcacattctctgtgttcccatctcccaaagtgtcggacacagtcgtggagccttacaatgctaccctttctgttcatcaacttgtggagaatgctgatgaatgtatggttcttgacaatgaagcactatatgatatctgcttcaggactctcaaactcactaccccaagctttggagacttgaatcatctgatttcaggaacgatgagtggtgttacttgttgcttgcgctttccgggtcagcttaactcagacctgagaaaactagctgtgaacttaatcccattcccaaggcttcactttttcatggtggggtttgctcctctgacatctagaggatcacagcagtaccgctctctcactgtccctgagctcacccaacaaatgtgggatgccaagaacatgatgtgtgcagctgatcctcgacacgggcgttacctcacagcatcagctatgtttagaggcaaaatgagtacaaaagaagtcgatgagcaaattatcaatgtgcagaacaaaaactcatcttactttgtggaatggataccaaacaatgtgaagtctagtgtttgcgatatcccaccaaaagggctttcaatggcttcaactttcgttggcaattcaacttccatacaggagatgtttaggagagcgagtgagcagttcacagcaatgtttaggagaaaggccttcttgcattggtacacaggagaaggaatggatgaaatggagttcactgaagctgagagcaacatgaatgatcttgttgctgagtatcaacagtaccaagatgccactactgaagaagatattgagtatgaggaggaggatggagtcgaaaactga

SEQ ID NO: 1578 - protein, 444 aa, Populus balsamifera subsp. trichocarpa
  misc_feature (1)..(444): Ceres ANNOT ID no. 1473384
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 173256:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(444): Functional Homolog of  Ceres CLONE ID no. 36891 at SEQ ID NO. 1592 with e-value of 3.29E-225 and BLAST sequence identity of 91.4
MREILHIQGGQCGNQIGSKFWEVVCDEHGIDPTGQYIGKTDLQLERVNVYYNEASNGRYVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEFPDRMMLTFSVFPSPKVSDTVVEPYNATLSVHQLVENADECMVLDNEALYDICFRTLKLTTPSFGDLNHLISGTMSGVTCCLRFPGQLNSDLRKLAVNLIPFPRLHFFMVGFAPLTSRGSQQYRSLTVPELTQQMWDAKNMMCAADPRHGRYLTASAMFRGKMSTKEVDEQIINVQNKNSSYFVEWIPNNVKSSVCDIPPKGLSMASTFVGNSTSIQEMFRRASEQFTAMFRRKAFLHWYTGEGMDEMEFTEAESNMNDLVAEYQQYQDATTEEDIEYEEEDGVEN

SEQ ID NO: 1579 - DNA, 1335 bp, Populus balsamifera subsp. trichocarpa
  misc_feature (1)..(1335): Ceres ANNOT ID no. 1475808
  misc_feature 173401:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgcgtgagattcttcacatccaaggaggccaatgtggcaatcaaattggtgcaaagttctgggaggtggtatgtgcagaacatgggattgatgcaacaggaaaatacaatggagattctgagctgcagcttgaaaggatcaatgtttattacaatgaggcaagtggtggcaggtttgtcccaagggctgtcctaatggaccttgaacctggtaccatggacagtgtcaggtcaggtccttatggtcagattttcagacctgataattttgttttcggacaatctggtgctggaaacaactgggctaaaggccattacaccgagggtgctgagatgattgattctgtcctcgatgttgtccgaaaagaagcagagaattgtgattgcttgcagggatttcaggtgtgccattcactaggaggaggaaccggatctggtatgggcactctattgatatcgaagatcagagaggaataccctgatcggatgatgcttacgttctctgtgtttccttctcctaaggtttctgatacagttgttgagccttataatgcaaccctttctgtgcatcagcttgttgaaaatgcagatgaatgcatggtccttgataatgaagctctccacaacatctgcttccgtaccctcaaactcacctcgccaagctttggtgatctaaatcatttgatctctgctaccatgtccggggtcacatgttgcttgagatttcctggacagcttaactctgacctgagaaagcttgctgtgaatctgatccctttccctcggctacatttcttcatggtgggttttgctcctctgacctcacgtggttcacaacaatacagcaccttgtccgtcccagagctcacccagcaaatgtgggatgccaagaacatgatgtgcgcagcagacccacgccgcggtcggtatttgacagcctcggcaatgttcaggggcaaaatgagtaccaaggaagtggatgagcagatgatcaatgttcaaaacaagaactcatcatactttgttgaatggatcccacacaatgtcaaatcaactgtttgtgatagtcctcccacaggcctaaaaatggcatcgacattcattggaaactccacgtcaattcaggaaatgttccgtcgcgtgagtgagcagtttactgccatgtttaggaggaaggctttcttgcattggtacactggggaaggaatggatgagatggagttcacagaggcagagagcaacatgaatgatttggtgtccgagtatcagcagtaccaagatgccacaacttacgaggactgtgaggatgaagaggaggaactccatgacatgtga

SEQ ID NO: 1580 - protein, 444 aa, Populus balsamifera subsp. trichocarpa
  misc_feature (1)..(444): Ceres ANNOT ID no. 1475808
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 173552:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(444): Functional Homolog of  Ceres CLONE ID no. 36891 at SEQ ID NO. 1592 with e-value of 4.19E-225 and BLAST sequence identity of 92.5
MREILHIQGGQCGNQIGAKFWEVVCAEHGIDATGKYNGDSELQLERINVYYNEASGGRFVPRAVLMDLEPGTMDSVRSGPYGQIFRPDNFVFGQSGAGNNWAKGHYTEGAEMIDSVLDVVRKEAENCDCLQGFQVCHSLGGGTGSGMGTLLISKIREEYPDRMMLTFSVFPSPKVSDTVVEPYNATLSVHQLVENADECMVLDNEALHNICFRTLKLTSPSFGDLNHLISATMSGVTCCLRFPGQLNSDLRKLAVNLIPFPRLHFFMVGFAPLTSRGSQQYSTLSVPELTQQMWDAKNMMCAADPRRGRYLTASAMFRGKMSTKEVDEQMINVQNKNSSYFVEWIPHNVKSTVCDSPPTGLKMASTFIGNSTSIQEMFRRVSEQFTAMFRRKAFLHWYTGEGMDEMEFTEAESNMNDLVSEYQQYQDATTYEDCEDEEEELHDM

SEQ ID NO: 1581 - DNA, 1380 bp, Populus balsamifera subsp. trichocarpa
  misc_feature (1)..(1380): Ceres ANNOT ID no. 1474708
  misc_feature 173697:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagagatccttcacgtgcaaggtggtcagtgcggtaaccagattggttccaagttctgggaagttgtgtgtgatgagcatggaatagacccgactggaaggtatgttggttcatcagatctgcagttggagcgtgtgaatgtgtactacaatgaggcttcttgtgggaggtttgttccacgtgcagtgcttatggacttggagcctggtaccatggacagtgttcgtactggtccgtatgggcagattttcaggccggataactttgtgtttggacaatctggtgctggaaacaactgggctaaggggcattacactgagggagcagagcttattgattctgttcttgatgttgtaaggaaggaggcagagaactgtgactgtcttcaaggtttccaagtgtgccactcattgggtggtggaactggttcgggaatgggcaccttgctcatctcaaaaatacgtgaggagtaccctgacaggatgatgttgaccttctctgtttttccctccccaaaggtttcagatactgtggttgagccatacaatgccaccctgtctgtgcatcaacttgttgagaatgctgatgagtgcatggttctggataacgaggctttgtatgatatctgcttcaggactcttaaattgactactccaagctctcatttggatcattattctcttacagttggtgatcttaaccacttgatttctgcaaccatgagtggtgtcacttgctgcctgaggttccctggtcagctcaactcggacctccgaaagcttgctgtgaatctcattccctttcctcgtctccacttcttcatggttggttttgctcctttgacctctcgtggatcccagcaataccgtgccctcactgttccagaactgacccagcaaatgtgggattccaagaatatgatgtgcgctgctgacccaaggcatggtcgctatctcactgcctctgctatgttccgtggcaagatgagcaccaaggaagtggatgagcagatgatcaatgtccaaaacaagaattcgtcatactttgttgagtggattccaaacaatgtgaaatccagtgtctgtgacatcccaccaaggggactcgccatggcatccaccttcattggaaattccacctccatccaggaaatgttcaggagagtcagcgagcaattcactgctatgttcaggagaaaagctttcttgcattggtacactggtgaaggtatggatgagatggagttcacagaagctgagagcaacatgaatgatctcgtgtccgagtaccagcagtaccaggatgccactgctgacgaggagggtgagtacgatgacgaggaggaagaggagggtcagtatgcggagcagatgtga

SEQ ID NO: 1582 - protein, 459 aa, Populus balsamifera subsp. trichocarpa
  misc_feature (1)..(459): Ceres ANNOT ID no. 1474708
  misc_feature (255)..(392): Pfam Name: Tubulin_C Pfam Description: Tubulin/FtsZ family, C-terminal domain
  misc_feature (45)..(253): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 173850:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(459): Functional Homolog of  Ceres CLONE ID no. 36891 at SEQ ID NO. 1592 with e-value of 1.29E-223 and BLAST sequence identity of 91.8
MREILHVQGGQCGNQIGSKFWEVVCDEHGIDPTGRYVGSSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSSHLDHYSLTVGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMINVQNKNSSYFVEWIPNNVKSSVCDIPPRGLAMASTFIGNSTSIQEMFRRVSEQFTAMFRRKAFLHWYTGEGMDEMEFTEAESNMNDLVSEYQQYQDATADEEGEYDDEEEEEGQYAEQM

SEQ ID NO: 1583 - DNA, 1335 bp, Populus balsamifera subsp. trichocarpa
  misc_feature (1)..(1335): Ceres ANNOT ID no. 1438698
  misc_feature 173998:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
atgagagaaatccttcatgtccaagctggtcagtgtggtaaccaaattggtggcaagttttgggaggttgtgtgtgatgaacacgggattgatcccacagggaattatgctggcaactctaatgttcaacttgagagggttaatgtttactacaatgaggctagtggtggtcgctatgtgcctagagctgtgctaatggaccttgagccagggaccatggacagcttgaggactggtccctacgggcaaatctttaggcctgacaattttgttttcggccaaaatggagctggaaataactgggctaagggacattacactgaaggagctgaactgatcgattctgttcttgatgttgttcgaaaagaagctgagaattgtgattgcttacaaggcttccaaatctgtcattctctgggaggtggaactggatcaggaatggggactctgctcatatcaaagatcagggaagaataccctgataggatgatgttaactttctcagtatttccatctcccaaggtttctgatactgtggttgagccctacaatgcaaccctctctgtacaccaactagttgaaaatgctgatgagtgtatggtccttgacaatgaagctctctatgatatctgctttcgaactctcaagctcaccaatccaagctttggtgatcttaaccacttgatctcagcaaccatgagtggagtaacatgttgccttcggttcccgggccaattgaactctgatcttcggaaactagccgtgaacttaatccccttcccgcgtctccatttcttcatggttggttttgcaccattaacctcccaagtctcacaacagtaccgtgccttaaccatcccggagctgacacaacaaatgtgggatgctaaaaacatgatgtgtgcagctgaccctcggcacggtaggtacttgacagcctcagctatgttccgaggcaaaatgagcactaaggaagttgatgaacaaatgataaatgtgcaaaacaagaactcatcatattttgttgagtggattccaaataatgttaaatcaagtgtttgtgacattccaccaactgggttagcaatgtcatcaacatttatgggaaattctacgtctattcaagaaatgtttaagcgtgtttcggaacaatttacagtcatgtttaggagaaaggcgtttttgcactggtacactggggaaggaatggatgaaatggagtttactgaggctgaaagtaacatgaacgatttggtttctgaatatcaacaatatcaagatgccgcagccgataatgagggggagtatgacgaagaagagcctatggagaactaa

SEQ ID NO: 1584 - protein, 444 aa, Populus balsamifera subsp. trichocarpa
  misc_feature (1)..(444): Ceres ANNOT ID no. 1438698
  misc_feature (246)..(383): Pfam Name: Tubulin_C Pfam Description: Tubulin/FtsZ family, C-terminal domain
  misc_feature (45)..(244): Pfam Name: Tubulin Pfam Description: Tubulin/FtsZ family, GTPase domain
  misc_feature: SWISSPROT Homolog: TBB9_ARATH Tubulin beta-9 chain (Beta-9 tubulin) with e-value of 1.2e-244 and BLAST sequence identity of 100.0
  misc_feature: SWISSPROT Homolog: TBB4_ARATH Tubulin beta-4 chain (Beta-4 tubulin) with e-value of 7.5e-236 and BLAST sequence identity of 96.8
  misc_feature: SWISSPROT Homolog: TBB3_ORYSA Tubulin beta-3 chain (Beta-3 tubulin) with e-value of 3.4e-233 and BLAST sequence identity of 94.8
  misc_feature: SWISSPROT Homolog: TBB7_MAIZE Tubulin beta-7 chain (Beta-7 tubulin) with e-value of 8.9e-233 and BLAST sequence identity of 94.4
  misc_feature: SWISSPROT Homolog: TBB3_WHEAT Tubulin beta-3 chain (Beta-3 tubulin) with e-value of 2.4e-232 and BLAST sequence identity of 94.2
  misc_feature 174149:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Other Useful for making ornamental plants with modified flowers
  misc_feature (1)..(444): Functional Homolog of  Ceres CLONE ID no. 36891 at SEQ ID NO. 1592 with e-value of 5.49E-223 and BLAST sequence identity of 89.8
MREILHVQAGQCGNQIGGKFWEVVCDEHGIDPTGNYAGNSNVQLERVNVYYNEASGGRYVPRAVLMDLEPGTMDSLRTGPYGQIFRPDNFVFGQNGAGNNWAKGHYTEGAELIDSVLDVVRKEAENCDCLQGFQICHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSQVSQQYRALTIPELTQQMWDAKNMMCAADPRHGRYLTASAMFRGKMSTKEVDEQMINVQNKNSSYFVEWIPNNVKSSVCDIPPTGLAMSSTFMGNSTSIQEMFKRVSEQFTVMFRRKAFLHWYTGEGMDEMEFTEAESNMNDLVSEYQQYQDAAADNEGEYDEEEPMEN

SEQ ID NO: 1585 - protein, 421 aa, Arabidopsis thaliana
  misc_feature (1)..(421): Ceres CLONE ID no. 36904
  misc_feature (280)..(416): Pfam Name: Ligase_CoA Pfam Description: CoA-ligase
  misc_feature (69)..(232): Pfam Name: ATP-grasp Pfam Description: ATP-grasp domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVSLEGTNVEQGKRILKESGMKLITADDLDDAAEKAVKALAH

SEQ ID NO: 1586 - DNA, 1266 bp, Populus balsamifera subsp. trichocarpa
  misc_feature (1)..(1266): Ceres ANNOT ID no. 1526083
  misc_feature 174451:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
atgagaggattattaaacaagctcgtttcttgctctctttccgtcgctggcaaatggcaacaccaacagctccgccgcctcaacatccacgaatatcagggagctgaattgatgggcaaatatggggtcaatgtcccgaaaggtgtagctgtctcttctcttgatgaggttaaaaaggctatccaagatgtatttcctggcgaaagcgagttggtggttaagagtcaagtcctggctggtggacgtggattaggaaaatttaagaatggttttcagggtggagttcacattgttaaggcagacaagattgaagaaacagctggaaagatgcttggtcagatacttgttactaaacaaactggttcccaaggcaaaattgtcagcaaggtttacctgtgtgaaaagttatctcttgtcaatgagatgtactttgctatcatgctggatcgtacttcagctggtccacttatcattgcgtgtaaaaaggggggaaccagcattgaagaccttgctgagaaatttcctgacttgattattaaggtccctattgatgtatttaaaggaattactgatgaagatgctgcaaaagttgtagatggcttggctccaaaggttgctgatagaaataactcgattgagcaagtgaagaaattatataaactcttctgcgagtgcgactgcacattgttggaaatcaatcccattgcagagacttctgataagcagttggtagctgctgatgctaaattgaattttgatgataatgctgcatttcgtcagaaggagatatttgctctcagagatccaacacaggaggatcctagagaggtggctgctgccatggcagatctaaattatattggtttggatggagaaattggttgcatggtgaatggtgcaggattagcaatggctacaatggatatagttaaactgcatgggggaacccctgcaaattttctagatgtgggtgggaatgcttctgaaggacaggtggtcgaggcatttaagatattgacttctgatgacaaagtaaaggcaattttggtgaatatatttggaggaataatgaaatgtgatgtgatagcaagcggaattgtcaatgctgccaaacaggttgctctaaaagttccagtggttgtacgccttgagggcactaatgttgaccaaggaaagagaattctgaaggagagtggaatggcactaatcacagcagaagatttggatgatgctgcaaagaaagcagtaaaagcatcagctagctga

SEQ ID NO: 1587 - protein, 421 aa, Populus balsamifera subsp. trichocarpa
  misc_feature (1)..(421): Ceres ANNOT ID no. 1526083
  misc_feature (280)..(416): Pfam Name: Ligase_CoA Pfam Description: CoA-ligase
  misc_feature (58)..(232): Pfam Name: ATP-grasp Pfam Description: ATP-grasp domain
  misc_feature: SWISSPROT Homolog: SUCB_ARATH Succinyl-CoA ligase [GDP-forming] beta-chain, (EC 6.2.1.4) (Succinyl-CoA synthetase, beta chain) (SCS-beta) with e-value of 2.1e-217 and BLAST sequence identity of 99.8
  misc_feature: SWISSPROT Homolog: SUCB1_PIG Succinyl-CoA ligase [ADP-forming] beta-chain, mitochondrial precursor with e-value of 7.5e-110 and BLAST sequence identity of 52.6
  misc_feature: SWISSPROT Homolog: SUCB1_PIG EC 6.2.1.5 (Succinyl-CoA synthetase, betaA chain) (SCS-betaA) (ATP- specific succinyl-CoA synthetase beta subunit) (Fragment)
  misc_feature: SWISSPROT Homolog: SUCB1_HUMAN Succinyl-CoA ligase [ADP-forming] beta-chain, mitochondrial precursor with e-value of 1.2e-109 and BLAST sequence identity of 53.1
  misc_feature: SWISSPROT Homolog: SUCB1_HUMAN EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB1_MOUSE Succinyl-CoA ligase [ADP-forming] beta-chain, mitochondrial precursor with e-value of 2.3e-108 and BLAST sequence identity of 51.9
  misc_feature: SWISSPROT Homolog: SUCB1_MOUSE EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB_NEUCR Probable succinyl-CoA ligase [GDP-forming] beta-chain, (EC 6.2.1.4) (Succinyl-CoA synthetase, beta chain) (SCS-beta) with e-value of 1.2e-104 and BLAST sequence identity of 49.6
  misc_feature 174638:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
  misc_feature (1)..(421): Functional Homolog of  Ceres CLONE ID no. 36904 at SEQ ID NO. 1629 with e-value of 6.70E-195 and BLAST sequence identity of 88.3
MRGLLNKLVSCSLSVAGKWQHQQLRRLNIHEYQGAELMGKYGVNVPKGVAVSSLDEVKKAIQDVFPGESELVVKSQVLAGGRGLGKFKNGFQGGVHIVKADKIEETAGKMLGQILVTKQTGSQGKIVSKVYLCEKLSLVNEMYFAIMLDRTSAGPLIIACKKGGTSIEDLAEKFPDLIIKVPIDVFKGITDEDAAKVVDGLAPKVADRNNSIEQVKKLYKLFCECDCTLLEINPIAETSDKQLVAADAKLNFDDNAAFRQKEIFALRDPTQEDPREVAAAMADLNYIGLDGEIGCMVNGAGLAMATMDIVKLHGGTPANFLDVGGNASEGQVVEAFKILTSDDKVKAILVNIFGGIMKCDVIASGIVNAAKQVALKVPVVVRLEGTNVDQGKRILKESGMALITAEDLDDAAKKAVKASAS

SEQ ID NO: 1588 - DNA, 1266 bp, Populus balsamifera subsp. trichocarpa
  misc_feature (1)..(1266): Ceres ANNOT ID no. 1498856
  misc_feature 174794:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
atgagaggattcttaaacaagctcgtttctcgctctctctccgtcgccggcaaatggcaacaccaacaactccgccgcctcaacatccacgaatatcagggagctgggttgatggggaaatatgggatcaatgtgccaaaaggtgtagctgttgcttcccttcatcatgttcaaaaggctcttcaatatgtatttcctagcgaaagcgagttggtggttaagagccaggttttggctggtgggcgaggattaggaaagtttaagaatggttttcagggtggtgttcacattgttaagactgacaaggttgaagaaactgctggaaagatgcttggccagatccttgttactaaacaaactggttctcaaggcaaaattgttagcaaggtttacttgtgtgaaaagttatcactggtcaatgagatgtactttgctatcatgctggatcggacaactgctggtccacttatcatagcttgtaaaaaggggggaaccagcattgaagaccttgctgagaaatttcctgacttgattattaaggtacccattgatgtatttaaaggaattactgatgaagatgctgtaaaagttgttgatggcctggctccaaaggttgctgatagaaatgattcgattgagcaagtgaagaaattatataaactcttttgcgagagtgattgcacattgttggaaatcaatcccattgcagagacttctgataagcagttggtagctgctgatgctaaattgaattttgatgataatgctgcatttcgtcagaaggagatatttgctctcagagatccaacacaggaagatccaagagaggtggctgctgccaaggcagatctaaattatattggtttggatggggaaattggttgcatggtgaatggtgcaggattagcaatggctacaatggatattattaaactgcacggaggcactcctgcaaattttcttgatgtgggtggtaatgcttctgaagaacaggtggttgaagcatttaagatactgacttctgatgacaaagtaaaggcaattttggtgaatatatttggaggaataatgaaatgcgatgtgatagcaagcggaattgtcaacgccgccaaacaggtcgctctaaaagttccagttgttgtgcgtctcgaaggcactaatgttgaccaaggaaagagaattctgaaggagagtggaatggcactaatcacagcagaagatttggatgatgctgcagagaaagcagtaaaagcatcagctagttga

SEQ ID NO: 1589 - protein, 421 aa, Populus balsamifera subsp. trichocarpa
  misc_feature (1)..(421): Ceres ANNOT ID no. 1498856
  misc_feature (280)..(416): Pfam Name: Ligase_CoA Pfam Description: CoA-ligase
  misc_feature (58)..(232): Pfam Name: ATP-grasp Pfam Description: ATP-grasp domain
  misc_feature: SWISSPROT Homolog: SUCB_ARATH Succinyl-CoA ligase [GDP-forming] beta-chain, (EC 6.2.1.4) (Succinyl-CoA synthetase, beta chain) (SCS-beta) with e-value of 2.1e-217 and BLAST sequence identity of 99.8
  misc_feature: SWISSPROT Homolog: SUCB1_PIG Succinyl-CoA ligase [ADP-forming] beta-chain, mitochondrial precursor with e-value of 7.5e-110 and BLAST sequence identity of 52.6
  misc_feature: SWISSPROT Homolog: SUCB1_PIG EC 6.2.1.5 (Succinyl-CoA synthetase, betaA chain) (SCS-betaA) (ATP- specific succinyl-CoA synthetase beta subunit) (Fragment)
  misc_feature: SWISSPROT Homolog: SUCB1_HUMAN Succinyl-CoA ligase [ADP-forming] beta-chain, mitochondrial precursor with e-value of 1.2e-109 and BLAST sequence identity of 53.1
  misc_feature: SWISSPROT Homolog: SUCB1_HUMAN EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB1_MOUSE Succinyl-CoA ligase [ADP-forming] beta-chain, mitochondrial precursor with e-value of 2.3e-108 and BLAST sequence identity of 51.9
  misc_feature: SWISSPROT Homolog: SUCB1_MOUSE EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB_NEUCR Probable succinyl-CoA ligase [GDP-forming] beta-chain, (EC 6.2.1.4) (Succinyl-CoA synthetase, beta chain) (SCS-beta) with e-value of 1.2e-104 and BLAST sequence identity of 49.6
  misc_feature 174981:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
  misc_feature (1)..(421): Functional Homolog of  Ceres CLONE ID no. 36904 at SEQ ID NO. 1629 with e-value of 1.99E-193 and BLAST sequence identity of 87.1
MRGFLNKLVSRSLSVAGKWQHQQLRRLNIHEYQGAGLMGKYGINVPKGVAVASLHHVQKALQYVFPSESELVVKSQVLAGGRGLGKFKNGFQGGVHIVKTDKVEETAGKMLGQILVTKQTGSQGKIVSKVYLCEKLSLVNEMYFAIMLDRTTAGPLIIACKKGGTSIEDLAEKFPDLIIKVPIDVFKGITDEDAVKVVDGLAPKVADRNDSIEQVKKLYKLFCESDCTLLEINPIAETSDKQLVAADAKLNFDDNAAFRQKEIFALRDPTQEDPREVAAAKADLNYIGLDGEIGCMVNGAGLAMATMDIIKLHGGTPANFLDVGGNASEEQVVEAFKILTSDDKVKAILVNIFGGIMKCDVIASGIVNAAKQVALKVPVVVRLEGTNVDQGKRILKESGMALITAEDLDDAAEKAVKASAS

SEQ ID NO: 1590 - DNA, 1296 bp, Populus balsamifera subsp. trichocarpa
  misc_feature (1)..(1296): Ceres ANNOT ID no. 1445872
  misc_feature 175137:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
atgagaggattcttaaacaagctcgtttctcgctctctctccgtcgccggcaaatggcaacaccaacaactccgccgcctcaacatccacgaatatcagggagctgggttgatggggaaatatgggatcaatgtgccaaaaggtgtagctgttgcttcccttcatcatgttcaaaaggctcttcaatatgtatttcctagcgaaagcgagttggtggttaagagccaggttttggctggtgggcgaggattaggaaagtttaagaatggttttcagggtggtgttcacattgttaagactgacaaggttgaagaaactgctggaaagatgcttggccagatccttgttactaaacaaactggttctcaaggcaaaattgttagcaaggtttacttgtgtgaaaagttatcactggtcaatgagatgtactttgctatcatgctggatcggacaactgctggtccacttatcatagcttgtaaaaaggggggaaccagcattgaagaccttgctgagaaatttcctgacttgattattaaggtacccattgatgtatttaaaggaattactgatgaagatgctgtaaaagttgttgatggcctggctccaaaggttgctgatagaaatgattcgattgagcaagtgaagaaattatataaactcttttgcgagagtgattgcacattgttggaaatcaatcccattgcagagacttctgataagcagttggtagctgctgatgctaaattgaattttgatgataatgctgcatttcgtcagaaggagatatttgctctcagagatccaacacaggaagatccaagagaggtggctgctgccaaggcagatctaaattatattggtttggatggggaaattggttgcatggtgaatggtgcaggattagcaatggctacaatggatattattaaactgcacggaggcactcctgcaaattttcttgatgtgggtggtaatgcttctgaagaacaggtggttgaagcatttaagatactgacttctgatgacaaagtaaaggcaattttggtgaatatatttggaggaataatgaaatgcgatgtgatagcaagcggaattgtcaacgccgccaaacaggcattaactttcttaatcctccttgaaaaggtcgctctaaaagttccagttgttgtgcgtctcgaaggcactaatgttgaccaaggaaagagaattctgaaggagagtggaatggcactaatcacagcagaagatttggatgatgctgcagagaaagcagtaaaagcatcagctagttga

SEQ ID NO: 1591 - protein, 431 aa, Populus balsamifera subsp. trichocarpa
  misc_feature (1)..(431): Ceres ANNOT ID no. 1445872
  misc_feature (280)..(426): Pfam Name: Ligase_CoA Pfam Description: CoA-ligase
  misc_feature (58)..(232): Pfam Name: ATP-grasp Pfam Description: ATP-grasp domain
  misc_feature: SWISSPROT Homolog: SUCB_ARATH Succinyl-CoA ligase [GDP-forming] beta-chain, (EC 6.2.1.4) (Succinyl-CoA synthetase, beta chain) (SCS-beta) with e-value of 2.1e-217 and BLAST sequence identity of 99.8
  misc_feature: SWISSPROT Homolog: SUCB1_PIG Succinyl-CoA ligase [ADP-forming] beta-chain, mitochondrial precursor with e-value of 7.5e-110 and BLAST sequence identity of 52.6
  misc_feature: SWISSPROT Homolog: SUCB1_PIG EC 6.2.1.5 (Succinyl-CoA synthetase, betaA chain) (SCS-betaA) (ATP- specific succinyl-CoA synthetase beta subunit) (Fragment)
  misc_feature: SWISSPROT Homolog: SUCB1_HUMAN Succinyl-CoA ligase [ADP-forming] beta-chain, mitochondrial precursor with e-value of 1.2e-109 and BLAST sequence identity of 53.1
  misc_feature: SWISSPROT Homolog: SUCB1_HUMAN EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB1_MOUSE Succinyl-CoA ligase [ADP-forming] beta-chain, mitochondrial precursor with e-value of 2.3e-108 and BLAST sequence identity of 51.9
  misc_feature: SWISSPROT Homolog: SUCB1_MOUSE EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB_NEUCR Probable succinyl-CoA ligase [GDP-forming] beta-chain, (EC 6.2.1.4) (Succinyl-CoA synthetase, beta chain) (SCS-beta) with e-value of 1.2e-104 and BLAST sequence identity of 49.6
  misc_feature 175324:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
  misc_feature (1)..(431): Functional Homolog of  Ceres CLONE ID no. 36904 at SEQ ID NO. 1629 with e-value of 1.49E-190 and BLAST sequence identity of 87.1
MRGFLNKLVSRSLSVAGKWQHQQLRRLNIHEYQGAGLMGKYGINVPKGVAVASLHHVQKALQYVFPSESELVVKSQVLAGGRGLGKFKNGFQGGVHIVKTDKVEETAGKMLGQILVTKQTGSQGKIVSKVYLCEKLSLVNEMYFAIMLDRTTAGPLIIACKKGGTSIEDLAEKFPDLIIKVPIDVFKGITDEDAVKVVDGLAPKVADRNDSIEQVKKLYKLFCESDCTLLEINPIAETSDKQLVAADAKLNFDDNAAFRQKEIFALRDPTQEDPREVAAAKADLNYIGLDGEIGCMVNGAGLAMATMDIIKLHGGTPANFLDVGGNASEEQVVEAFKILTSDDKVKAILVNIFGGIMKCDVIASGIVNAAKQALTFLILLEKVALKVPVVVRLEGTNVDQGKRILKESGMALITAEDLDDAAEKAVKASAS

SEQ ID NO: 1592 - DNA, 1281 bp, Populus balsamifera subsp. trichocarpa
  misc_feature (1)..(1281): Ceres ANNOT ID no. 1472663
  misc_feature 175480:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
atggcaacaccaacagctccgccgcctcaacatccacgaatatcaggtcacctctccctctcctcatcccctttatgcatcaccggagctgaattgatgggcaaatatggggtcaatgtcccgaaaggtgtagctgtctcttctcttgatgaggttaaaaaggctatccaagatgtatttcctggcgaaagcgagttggtggttaagagtcaagtcctggctggtggacgtggattaggaaaatttaagaatggttttcagggtggagttcacattgttaaggcagacaagattgaagaaacagctggaaagatgcttggtcagatacttgttactaaacaaactggttcccaaggcaaaattgtcagcaaggtttacctgtgtgaaaagttatctcttgtcaatgagatgtactttgctatcatgctggatcgtacttcagctggtccacttatcattgcgtgtaaaaaggggggaaccagcattgaagaccttgctgagaaatttcctgacttgattattaaggtccctattgatgtatttaaaggaattactgatgaagatgctgcaaaagttgtagatggcttggctccaaaggttgctgatagaaataactcgattgagcaagtgaagaaattatataaactcttctgcgagtgcgactgcacattgttggaaatcaatcccattgcagagacttctgataagcagttggtagctgctgatgctaaattgaattttgatgataatgctgcatttcgtcagaaggagatatttgctctcagagatccaacacaggaggatcctagagaggtggctgctgccatggcagatctaaattatattggtttggatggagaaattggttgcatggtgaatggtgcaggattagcaatggctacaatggatatagttaaactgcatgggggaacccctgcaaattttctagatgtgggtgggaatgcttctgaaggacaggtggtcgaggcatttaagatattgacttctgatgacaaagtaaaggcaattttggtgaatatatttggaggaataatgaaatgtgatgtgatagcaagcggaattgtcaatgctgccaaacaggcattaactttctcggtcctttctgaaaaggttgctctaaaagttccagtggttgtacgccttgagggcactaatgttgaccaaggaaagagaattctgaaggagagtggaatggcactaatcacagcagaagatttggatgatgctgcaaagaaagcagtaaaagcatcagctagctga

SEQ ID NO: 1593 - protein, 426 aa, Populus balsamifera subsp. trichocarpa
  misc_feature (1)..(426): Ceres ANNOT ID no. 1472663
  misc_feature (275)..(421): Pfam Name: Ligase_CoA Pfam Description: CoA-ligase
  misc_feature (53)..(227): Pfam Name: ATP-grasp Pfam Description: ATP-grasp domain
  misc_feature: SWISSPROT Homolog: SUCB_ARATH Succinyl-CoA ligase [GDP-forming] beta-chain, (EC 6.2.1.4) (Succinyl-CoA synthetase, beta chain) (SCS-beta) with e-value of 2.1e-217 and BLAST sequence identity of 99.8
  misc_feature: SWISSPROT Homolog: SUCB1_PIG Succinyl-CoA ligase [ADP-forming] beta-chain, mitochondrial precursor with e-value of 7.5e-110 and BLAST sequence identity of 52.6
  misc_feature: SWISSPROT Homolog: SUCB1_PIG EC 6.2.1.5 (Succinyl-CoA synthetase, betaA chain) (SCS-betaA) (ATP- specific succinyl-CoA synthetase beta subunit) (Fragment)
  misc_feature: SWISSPROT Homolog: SUCB1_HUMAN Succinyl-CoA ligase [ADP-forming] beta-chain, mitochondrial precursor with e-value of 1.2e-109 and BLAST sequence identity of 53.1
  misc_feature: SWISSPROT Homolog: SUCB1_HUMAN EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB1_MOUSE Succinyl-CoA ligase [ADP-forming] beta-chain, mitochondrial precursor with e-value of 2.3e-108 and BLAST sequence identity of 51.9
  misc_feature: SWISSPROT Homolog: SUCB1_MOUSE EC 6.2.1.5 (Succinyl-CoA synthetase, betaA chain) (SCS-betaA) (ATP- specific succinyl-CoA synthetase beta subunit)
  misc_feature: SWISSPROT Homolog: SUCB_NEUCR Probable succinyl-CoA ligase [GDP-forming] beta-chain, (EC 6.2.1.4) (Succinyl-CoA synthetase, beta chain) (SCS-beta) with e-value of 1.2e-104 and BLAST sequence identity of 49.6
  misc_feature 175667:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: CAULINE LEAVES - Undulate Shaped Useful for making plants with increased biomass and foliage
  misc_feature: Phenotype: ROSETTE LEAVES - Undulate Shaped Useful for making plants with increased biomass and foliage
  misc_feature (1)..(426): Functional Homolog of  Ceres CLONE ID no. 36904 at SEQ ID NO. 1629 with e-value of 2.29E-176 and BLAST sequence identity of 88.6
MATPTAPPPQHPRISGHLSLSSSPLCITGAELMGKYGVNVPKGVAVSSLDEVKKAIQDVFPGESELVVKSQVLAGGRGLGKFKNGFQGGVHIVKADKIEETAGKMLGQILVTKQTGSQGKIVSKVYLCEKLSLVNEMYFAIMLDRTSAGPLIIACKKGGTSIEDLAEKFPDLIIKVPIDVFKGITDEDAAKVVDGLAPKVADRNNSIEQVKKLYKLFCECDCTLLEINPIAETSDKQLVAADAKLNFDDNAAFRQKEIFALRDPTQEDPREVAAAMADLNYIGLDGEIGCMVNGAGLAMATMDIVKLHGGTPANFLDVGGNASEGQVVEAFKILTSDDKVKAILVNIFGGIMKCDVIASGIVNAAKQALTFSVLSEKVALKVPVVVRLEGTNVDQGKRILKESGMALITAEDLDDAAKKAVKASAS

SEQ ID NO: 1594 - protein, 274 aa, Arabidopsis thaliana
  misc_feature (1)..(274): Ceres CLONE ID no. 36927
  misc_feature (1)..(274): Also Known As Ceres CDNA ID no. 23386077
  misc_feature (1)..(274): Also Known As Ceres GEMINI ID 532E8
  misc_feature (196)..(231): Pfam Name: GATA Pfam Description: GATA zinc finger
  misc_feature 175843:<222: Transcription Factor
  misc_feature: Phenotype: Activates expression of the gene endogenous to the AtATTPS3 (SEQ ID NO 4165) regalutory region Useful for modulating Terpenoid Biosynthesis
MEMESFMDDLLNFSVPEEEEDDDEHTQPPRNITRRKTGLRPTDSFGLFNTDDLGVVEEEDLQWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 1595 - DNA, 777 bp, Populus balsamifera subsp. trichocarpa
  misc_feature (1)..(777): Ceres ANNOT ID no. 1447997
  misc_feature 175922:<222: Transcription Factor
  misc_feature: Phenotype: Activates expression of the gene endogenous to the AtATTPS3 (SEQ ID NO 4165) regalutory region Useful for modulating Terpenoid Biosynthesis
atggagtctctagacacggctgctggtttcatggttgatgaccttttggacttctgttctgatataggcgagggagatgatgacgaagaacaccagaacaacaacaaaaaacccagaaagggacttccttcccttaaccctaatgcccttgcctcggcttctttcaacgttttggaacatactttgttacctgaatttgcagaggaagaactggaatggttatcaaataaagatgctttcccagcagtggaaacctgcttcggcattctctccgaggagccaggcagcattcccaagcaccacagcccagtctccgttcttgaaaacagtaccactagcagcactagcatcagtgggaatagcagtaatagtagcattattatgagttactgtagccttcgcgtgcctgtcaaggctcgcagcaagcgtcgccacaggcgccctcgagaaatccgagagcaagagcgctggtggagtcgggaaaattctacaaggagaaaaccagctgtgtcagtagcaaaaatggggagaaaatgtcagcattgtggtgttgaaaagaccccgcaatggcgggcaggtccagatgggcctaaaacgttgtgtaatgcttgcggggtgcgatacaagtctggtaggttggtgcctgagtatcggcctgcgaatagtccgacattctccagcaaattgcactcgaattcacatcggaaggttgtggagatgaggaagcagaagcagatgatggggtcacttgttgtgaagccaatggataaagggtag

SEQ ID NO: 1596 - protein, 258 aa, Populus balsamifera subsp. trichocarpa
  misc_feature (1)..(258): Ceres ANNOT ID no. 1447997
  misc_feature (179)..(214): Pfam Name: GATA Pfam Description: GATA zinc finger
  misc_feature: SWISSPROT Homolog: GATA1_ARATH GATA transcription factor 1 (AtGATA-1) with e-value of 5.3e-148 and BLAST sequence identity of 99.6
  misc_feature: SWISSPROT Homolog: GAT10_ARATH GATA transcription factor 10 (AtGATA-10) with e-value of 3.6e-33 and BLAST sequence identity of 74.0
  misc_feature: SWISSPROT Homolog: GATA9_ARATH GATA transcription factor 9 (AtGATA-9) with e-value of 8.2e-33 and BLAST sequence identity of 35.6
  misc_feature: SWISSPROT Homolog: GATA4_ARATH GATA transcription factor 4 (AtGATA-4) with e-value of 6.6e-32 and BLAST sequence identity of 53.4
  misc_feature: SWISSPROT Homolog: GATA3_ARATH GATA transcription factor 3 (AtGATA-3) with e-value of 9.4e-32 and BLAST sequence identity of 52.3
  misc_feature 176019:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(258): Functional Homolog of  Ceres CLONE ID no. 36927 at SEQ ID NO. 1638 with e-value of 2.50E-53 and BLAST sequence identity of 58.3
MESLDTAAGFMVDDLLDFCSDIGEGDDDEEHQNNNKKPRKGLPSLNPNALASASFNVLEHTLLPEFAEEELEWLSNKDAFPAVETCFGILSEEPGSIPKHHSPVSVLENSTTSSTSISGNSSNSSIIMSYCSLRVPVKARSKRRHRRPREIREQERWWSRENSTRRKPAVSVAKMGRKCQHCGVEKTPQWRAGPDGPKTLCNACGVRYKSGRLVPEYRPANSPTFSSKLHSNSHRKVVEMRKQKQMMGSLVVKPMDKG

SEQ ID NO: 1597 - DNA, 777 bp, Populus balsamifera subsp. trichocarpa
  misc_feature (1)..(777): Ceres ANNOT ID no. 1438091
  misc_feature 176103:<222: Transcription Factor
  misc_feature: Phenotype: Activates expression of the gene endogenous to the AtATTPS3 (SEQ ID NO 4165) regalutory region Useful for modulating Terpenoid Biosynthesis
atggagtctctagacacggctgcttgtttcatggtggatgaccttttggacttctgttctgatataggagaggaagaggatggtgaagaacaccagaggaacagcaaaaaatccagaagggcacttccttcccttaaccctaatgcccttcacccggcttctttcaacgttttggaacatagtttgttacctgaatttgcagaggaagagctggaatggttatcgaacaaagatgcgttcccaacagtcgaaacttgcttcggtagcctctccggtgagccaggcagcattcccaagcaccacagcccagtttccgtgctcgaaaacagcactactagcagcaccagcaacagtggcaatagcagtaatagtaacattattatgagttactgtcgacttcgcgtgcctgttaaggctcgtagcaagcgccaccatagacaccctcgagaaatccaagagcaagagtgttggtggagtcaggaaaatttcataacgaggaaaccggctgtgtcagtagcaaaattggggagaaaatgtcagcattgtggtgttgaaaagactccacaatggcgggcaggtccagatggacctaaaacattgtgtaatgcttgtggggtgagatacaagtctggtagattggtgcctgagtaccgacctgcaaatagtccaacgttctccagcaaattgcactcgaattcgcataggaaggttgtggagatgaggaggcagaagcagatgacggggttacttgttgcgaagccgatggataaagggtag

SEQ ID NO: 1598 - protein, 258 aa, Populus balsamifera subsp. trichocarpa
  misc_feature (1)..(258): Ceres ANNOT ID no. 1438091
  misc_feature (179)..(214): Pfam Name: GATA Pfam Description: GATA zinc finger
  misc_feature: SWISSPROT Homolog: GATA1_ARATH GATA transcription factor 1 (AtGATA-1) with e-value of 5.3e-148 and BLAST sequence identity of 99.6
  misc_feature: SWISSPROT Homolog: GAT10_ARATH GATA transcription factor 10 (AtGATA-10) with e-value of 3.6e-33 and BLAST sequence identity of 74.0
  misc_feature: SWISSPROT Homolog: GATA9_ARATH GATA transcription factor 9 (AtGATA-9) with e-value of 8.2e-33 and BLAST sequence identity of 35.6
  misc_feature: SWISSPROT Homolog: GATA4_ARATH GATA transcription factor 4 (AtGATA-4) with e-value of 6.6e-32 and BLAST sequence identity of 53.4
  misc_feature: SWISSPROT Homolog: GATA3_ARATH GATA transcription factor 3 (AtGATA-3) with e-value of 9.4e-32 and BLAST sequence identity of 52.3
  misc_feature 176200:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(258): Functional Homolog of  Ceres CLONE ID no. 36927 at SEQ ID NO. 1638 with e-value of 2.89E-52 and BLAST sequence identity of 57.8
MESLDTAACFMVDDLLDFCSDIGEEEDGEEHQRNSKKSRRALPSLNPNALHPASFNVLEHSLLPEFAEEELEWLSNKDAFPTVETCFGSLSGEPGSIPKHHSPVSVLENSTTSSTSNSGNSSNSNIIMSYCRLRVPVKARSKRHHRHPREIQEQECWWSQENFITRKPAVSVAKLGRKCQHCGVEKTPQWRAGPDGPKTLCNACGVRYKSGRLVPEYRPANSPTFSSKLHSNSHRKVVEMRRQKQMTGLLVAKPMDKG

SEQ ID NO: 1599 - protein, 350 aa, Arabidopsis thaliana
  misc_feature (1)..(350): Ceres CLONE ID no. 37019
  misc_feature (69)..(339): Pfam Name: CDC50 Pfam Description: LEM3 ligand-effect modulator 3) family / CDC50 family
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
MSSSNTPSSSAAAAGSIDSSAARRNSKRPKYSKFTQQELPACKPILTPGWVISTFLIISVIFIPLGVISLFASQDVVEIVDRYDSACIPLSDRANKVAYIQGTGNKSCTRTLIVPKRMKQPIYVYYQLENFYQNHRRYVKSRSDSQLRSVKDENQIDACKPEDDFGGQPIVPCGLIAWSLFNDTYVLSRNNQGLTVNKKGIAWKSDKEHKFGKNVFPKNFQKGNLTGGASLDPNKPLSDQEDLIVWMRTAALPTFRKLYGKIESDLEKGENIQVTLQNNYNTYSFSGKKKLVLSTTSWLGGKNDFLGIAYLTVGGICFVLALAFTVMYLVKPRRLGDPTYLSWNRIPGGR

SEQ ID NO: 1600 - DNA, 1053 bp, Populus balsamifera subsp. trichocarpa
  misc_feature (1)..(1053): Ceres ANNOT ID no. 1517849
  misc_feature 176407:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
atgagtagccacacggcatcctccagtaatggaggcaacggatcgggtgattctggtgctccaagaaggaattcaaagcgacccaaatattcaaagtttactcaacaagaacttcctgcttgcaagccaattctcacaccacgatgggtagtgtctgcattcatgcttgttgccattgtcttcatccctatcggcattgcttgcttgcttggttcccgagatgttgttgaagttgttaaacggtatgaaacagaatgcattccggttggaaatagaggcaatgaagtccaatttatacaaagcgctgctgataaaacatgcacaatatcaatgacgatccctaagcgtatgaagcaacctatttatgtttactatcagcttgacaacttctaccagaatcatcgtaggtatgtgaagagccgaagtgatgaacagttgaaaagtgcgagtaaagagaatgatacaagttcttgtgagccagaagatactgcaacggggaggggggcaattgtaccctgtggtctgatagcttggagtttgtttaatgatacctatagcttctcccgcctgaaccagtcgttgacagtgaataagaagggaattgcttggaagagtgataaggagaaaaggtttggtaaagatgtctttcctaaaaactttcagggtggaggtcttgtaggtggtgcaaggctcgatccattaacacgtctgagcgatcaggaggacctcatggtttggatgcgaactgcagctctgccaacttttagaaagttgtatgggaagatagaggtggatcttgatgcaaaagaagtcataaatgttacactgggtaacaactataacacatacagttttaatggcaagaagaaacttgtgctttcaactacaagctggattggtggaagaaatgactttcttggcattgcttatctcactgttgggatgatatgcttcgccttgtcaatgggtttcacaattgtgtattttgtcaagcctaggcggcttggtgatcctaccttcttatcatggaacagaggtcctggatcgcactaa

SEQ ID NO: 1601 - protein, 350 aa, Populus balsamifera subsp. trichocarpa
  misc_feature (1)..(350): Ceres ANNOT ID no. 1517849
  misc_feature (68)..(339): Pfam Name: CDC50 Pfam Description: LEM3 ligand-effect modulator 3) family / CDC50 family
  misc_feature: SWISSPROT Homolog: CDC50_YEAST Cell division control protein 50 with e-value of 9.2e-46 and BLAST sequence identity of 37.9
  misc_feature: SWISSPROT Homolog: YN8S_YEAST Hypothetical protein YNR048W with e-value of 1.0e-44 and BLAST sequence identity of 40.0
  misc_feature: SWISSPROT Homolog: LEM3_YEAST Alkylphosphocholine resistance protein LEM3 (Ro-sensitive 3) with e-value of 6.7e-34 and BLAST sequence identity of 36.0
  misc_feature 176525:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(350): Functional Homolog of  Ceres CLONE ID no. 37019 at SEQ ID NO. 1643 with e-value of 4.80E-137 and BLAST sequence identity of 71.6
MSSHTASSSNGGNGSGDSGAPRRNSKRPKYSKFTQQELPACKPILTPRWVVSAFMLVAIVFIPIGIACLLGSRDVVEVVKRYETECIPVGNRGNEVQFIQSAADKTCTISMTIPKRMKQPIYVYYQLDNFYQNHRRYVKSRSDEQLKSASKENDTSSCEPEDTATGRGAIVPCGLIAWSLFNDTYSFSRLNQSLTVNKKGIAWKSDKEKRFGKDVFPKNFQGGGLVGGARLDPLTRLSDQEDLMVWMRTAALPTFRKLYGKIEVDLDAKEVINVTLGNNYNTYSFNGKKKLVLSTTSWIGGRNDFLGIAYLTVGMICFALSMGFTIVYFVKPRRLGDPTFLSWNRGPGSH

SEQ ID NO: 1602 - DNA, 1053 bp, Populus balsamifera subsp. trichocarpa
  misc_feature (1)..(1053): Ceres ANNOT ID no. 1511684
  misc_feature 176652:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
atgagcagtcacgcggcttcgtccagcaatggaggcaatggatcgggcgattctgatgctccaagaaggaattcaaagcgacccaaatattcaaagtttacacaacaagaacttcctgcttgcaagccaattctcacaccacgatgggtggtgtctgcattcatgattattgccattgtcttcattcctattggcattgcttgcttgcttggttcccgagatgttgttgaagtttctaaacggtatgaaatagactgtattcctcctgaaaatagaagcaataaggtccaatttattcaaagctctgccaataaaacatgcacaatatcaatgacgatccctaagcgtatgaagaaacctatttatgtttactatcagcttgacaacttctaccagaatcatcgtaggtatgtgaagagccgaagtgacaagcagttgaaaagtttgagcaaagagaccgatacaagtagttgcaagccagaagataccacagctgggggggcggcgattgtaccctgtggtctaatagcttggagtatgtttaatgatacttataacttctccaggctgaaccaagaattgactgtgaataagaagggaattgcttggaagagtgataagcagaaaaggtttggtaaagatgtgtttcctaaaaattttcagggtggaggtcttcaaggtggtaaaattctcaatgaaaaaataccattgaatgagcaggaggacctcatggtttggatgcgaactgcagctctgccaacttttagaaagttgtacgggaagatagaggtggatcttgaggcaaacgaagtcataaatgtgacactggacaacaactataacacatacagttttaatggcaagaagaaactcgtgctttcaaccacaagctggattggtggaagaaatgactttcttggcatcgcttatctcactgttgggatgatatgcttagctttggcaatgggtttcacagctgtatatttcatcaagcctaggcggcttggtgatcctacctttttatcatggaacagaggtcctggatcgcagtaa

SEQ ID NO: 1603 - protein, 350 aa, Populus balsamifera subsp. trichocarpa
  misc_feature (1)..(350): Ceres ANNOT ID no. 1511684
  misc_feature (68)..(339): Pfam Name: CDC50 Pfam Description: LEM3 ligand-effect modulator 3) family / CDC50 family
  misc_feature: SWISSPROT Homolog: CDC50_YEAST Cell division control protein 50 with e-value of 9.2e-46 and BLAST sequence identity of 37.9
  misc_feature: SWISSPROT Homolog: YN8S_YEAST Hypothetical protein YNR048W with e-value of 1.0e-44 and BLAST sequence identity of 40.0
  misc_feature: SWISSPROT Homolog: LEM3_YEAST Alkylphosphocholine resistance protein LEM3 (Ro-sensitive 3) with e-value of 6.7e-34 and BLAST sequence identity of 36.0
  misc_feature 176770:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(350): Functional Homolog of  Ceres CLONE ID no. 37019 at SEQ ID NO. 1643 with e-value of 4.49E-134 and BLAST sequence identity of 70.1
MSSHAASSSNGGNGSGDSDAPRRNSKRPKYSKFTQQELPACKPILTPRWVVSAFMIIAIVFIPIGIACLLGSRDVVEVSKRYEIDCIPPENRSNKVQFIQSSANKTCTISMTIPKRMKKPIYVYYQLDNFYQNHRRYVKSRSDKQLKSLSKETDTSSCKPEDTTAGGAAIVPCGLIAWSMFNDTYNFSRLNQELTVNKKGIAWKSDKQKRFGKDVFPKNFQGGGLQGGKILNEKIPLNEQEDLMVWMRTAALPTFRKLYGKIEVDLEANEVINVTLDNNYNTYSFNGKKKLVLSTTSWIGGRNDFLGIAYLTVGMICLALAMGFTAVYFIKPRRLGDPTFLSWNRGPGSQ

SEQ ID NO: 1604 - DNA, 1002 bp, Populus balsamifera subsp. trichocarpa
  misc_feature (1)..(1002): Ceres ANNOT ID no. 1464532
  misc_feature 176897:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
atgagtagccacacggcatcctccagtaatggaggcaacggatcgggtgattctggtgctccaagaaggaattcaaagcgacccaaatattcaaagtttactcaacaagaacttcctgcttgcaagccaattctcacaccacgatgggtagtgtctgcattcatgcttgttgccattgtcttcatccctatcggcattgcttgcttgcttggttcccgagatgttgttgaagttgttaaacggtatgaaacagaatgcattccggttggaaatagaggcaatgaagtccaatttatacaaagcgctgctgataaaacatgcacaatatcaatgacgatccctaagcgtatgaagcaacctatttatgtttactatcagcttgacaacttctaccagaatcatcgtaggtatgtgaagagccgaagtgatgaacagttgaaaagtgcgagtaaagagaatgatacaagttcttgtgagccagaagatactgcaacggggaggggggcaattgtaccctgtggtctgatagcttggagtttgtttaatgatacctatagcttctcccgcctgaaccagtcgttgacagtgaataagaagggaattgcttggaagagtgataaggagaaaaggtttggtaaagatgtctttcctaaaaactttcagggtggaggtcttgtaggtggtgcaaggctcgatccattaacacgtctgagcgatcaggaggacctcatggtttggatgcgaactgcagctctgccaacttttagaaagttgtatgggaagatagaggtggatcttgatgcaaaagaagtcataaatgttacactgggtaacaactataacacatacagttttaatggcaagaagaaacttgtgctttcaactacaagctggattggtggaagaaatgactttcttggcattgcttatctcactgttgggatgatatgcttcgccttgtcaatgggtttcacaattgtgtattttgtcaagcctaggtaa

SEQ ID NO: 1605 - protein, 333 aa, Populus balsamifera subsp. trichocarpa
  misc_feature (1)..(333): Ceres ANNOT ID no. 1464532
  misc_feature (68)..(333): Pfam Name: CDC50 Pfam Description: LEM3 ligand-effect modulator 3) family / CDC50 family
  misc_feature: SWISSPROT Homolog: CDC50_YEAST Cell division control protein 50 with e-value of 9.2e-46 and BLAST sequence identity of 37.9
  misc_feature: SWISSPROT Homolog: YN8S_YEAST Hypothetical protein YNR048W with e-value of 1.0e-44 and BLAST sequence identity of 40.0
  misc_feature: SWISSPROT Homolog: LEM3_YEAST Alkylphosphocholine resistance protein LEM3 (Ro-sensitive 3) with e-value of 6.7e-34 and BLAST sequence identity of 36.0
  misc_feature 177013:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(333): Functional Homolog of  Ceres CLONE ID no. 37019 at SEQ ID NO. 1643 with e-value of 4.30E-129 and BLAST sequence identity of 70.9
MSSHTASSSNGGNGSGDSGAPRRNSKRPKYSKFTQQELPACKPILTPRWVVSAFMLVAIVFIPIGIACLLGSRDVVEVVKRYETECIPVGNRGNEVQFIQSAADKTCTISMTIPKRMKQPIYVYYQLDNFYQNHRRYVKSRSDEQLKSASKENDTSSCEPEDTATGRGAIVPCGLIAWSLFNDTYSFSRLNQSLTVNKKGIAWKSDKEKRFGKDVFPKNFQGGGLVGGARLDPLTRLSDQEDLMVWMRTAALPTFRKLYGKIEVDLDAKEVINVTLGNNYNTYSFNGKKKLVLSTTSWIGGRNDFLGIAYLTVGMICFALSMGFTIVYFVKPR

SEQ ID NO: 1606 - DNA, 1002 bp, Populus balsamifera subsp. trichocarpa
  misc_feature (1)..(1002): Ceres ANNOT ID no. 1458439
  misc_feature 177137:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
atgagcagtcacgcggcttcgtccagcaatggaggcaatggatcgggcgattctgatgctccaagaaggaattcaaagcgacccaaatattcaaagtttacacaacaagaacttcctgcttgcaagccaattctcacaccacgatgggtggtgtctgcattcatgattattgccattgtcttcattcctattggcattgcttgcttgcttggttcccgagatgttgttgaagtttctaaacggtatgaaatagactgtattcctcctgaaaatagaagcaataaggtccaatttattcaaagctctgccaataaaacatgcacaatatcaatgacgatccctaagcgtatgaagaaacctatttatgtttactatcagcttgacaacttctaccagaatcatcgtaggtatgtgaagagccgaagtgacaagcagttgaaaagtttgagcaaagagaccgatacaagtagttgcaagccagaagataccacagctgggggggcggcgattgtaccctgtggtctaatagcttggagtatgtttaatgatacttataacttctccaggctgaaccaagaattgactgtgaataagaagggaattgcttggaagagtgataagcagaaaaggtttggtaaagatgtgtttcctaaaaattttcagggtggaggtcttcaaggtggtaaaattctcaatgaaaaaataccattgaatgagcaggaggacctcatggtttggatgcgaactgcagctctgccaacttttagaaagttgtacgggaagatagaggtggatcttgaggcaaacgaagtcataaatgtgacactggacaacaactataacacatacagttttaatggcaagaagaaactcgtgctttcaaccacaagctggattggtggaagaaatgactttcttggcatcgcttatctcactgttgggatgatatgcttagctttggcaatgggtttcacagctgtatatttcatcaagcctaggtaa

SEQ ID NO: 1607 - protein, 333 aa, Populus balsamifera subsp. trichocarpa
  misc_feature (1)..(333): Ceres ANNOT ID no. 1458439
  misc_feature (68)..(334): Pfam Name: CDC50 Pfam Description: LEM3 ligand-effect modulator 3) family / CDC50 family
  misc_feature: SWISSPROT Homolog: CDC50_YEAST Cell division control protein 50 with e-value of 9.2e-46 and BLAST sequence identity of 37.9
  misc_feature: SWISSPROT Homolog: YN8S_YEAST Hypothetical protein YNR048W with e-value of 1.0e-44 and BLAST sequence identity of 40.0
  misc_feature: SWISSPROT Homolog: LEM3_YEAST Alkylphosphocholine resistance protein LEM3 (Ro-sensitive 3) with e-value of 6.7e-34 and BLAST sequence identity of 36.0
  misc_feature 177253:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(333): Functional Homolog of  Ceres CLONE ID no. 37019 at SEQ ID NO. 1643 with e-value of 4.99E-126 and BLAST sequence identity of 69.7
MSSHAASSSNGGNGSGDSDAPRRNSKRPKYSKFTQQELPACKPILTPRWVVSAFMIIAIVFIPIGIACLLGSRDVVEVSKRYEIDCIPPENRSNKVQFIQSSANKTCTISMTIPKRMKKPIYVYYQLDNFYQNHRRYVKSRSDKQLKSLSKETDTSSCKPEDTTAGGAAIVPCGLIAWSMFNDTYNFSRLNQELTVNKKGIAWKSDKQKRFGKDVFPKNFQGGGLQGGKILNEKIPLNEQEDLMVWMRTAALPTFRKLYGKIEVDLEANEVINVTLDNNYNTYSFNGKKKLVLSTTSWIGGRNDFLGIAYLTVGMICLALAMGFTAVYFIKPR

SEQ ID NO: 1608 - DNA, 1062 bp, Populus balsamifera subsp. trichocarpa
  misc_feature (1)..(1062): Ceres ANNOT ID no. 1540674
  misc_feature 177377:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
atgataggggaagccacaagctctagcggtggaggcaaggatgattctcctgctgctgtttctgccaaaaagaacaagaaacccaactattctagattcacacagcaagagcttcctgcttgtaaacctattttaacgccgggatgggtcattacatcattcattgttgttggagttgtgtttatccctataggccttgcttccttgtatgcatcagaacatgtggtggaaattgtggagcgatatgacaaagattgtattccccctgattatagaaataacagcctacattatatccaaaccagcgaaattaacaagacttgtacaatgaccattaatgttccaaagcacatgaaaagtcctgttttcatctattacgagcttgataacttttaccagaaccaccgtcgatatgtaaaaagtcgaagtgataaacagttacgaagcaaggccagtgaaggtgtcacagaaacctgcaaaccggaagctgtcacatcaaatgggcaaccaattgttccttgtggccttgttgcatggagtttgttcaatgatacatacaggttttcggtaaaaaaagaggttttagatgtcagcaaaaagaatattgcttggaaaagtgaccaggagcataaatttggttccgatgtctatcctaaaaatttccagagtggaagcttgattggaggtggaaaacttgattcaagcatacctttgagtgaacaagtagatcttattgtatggatgcgtactgcagcgctgccaaacttcagaaaactttatggaaagatagagaaggaccttcaagctaacactacaattacggttaccattgagaataattataacacttacagttttggaggcaaaaagaagctggttctttcaaccacgagttggataggtggaaaaaatagtttcctgggcagagcttatatcgctattggaggcttgtgcttgttcttggcagtatgctttgtatttgtatatgtgttcaagccaaggccccttggtgatccatcctacttatcttggaacaggaatccatcaggacaaatgaattaa

SEQ ID NO: 1609 - protein, 353 aa, Populus balsamifera subsp. trichocarpa
  misc_feature (1)..(353): Ceres ANNOT ID no. 1540674
  misc_feature (68)..(340): Pfam Name: CDC50 Pfam Description: LEM3 ligand-effect modulator 3) family / CDC50 family
  misc_feature: SWISSPROT Homolog: CDC50_YEAST Cell division control protein 50 with e-value of 9.2e-46 and BLAST sequence identity of 37.9
  misc_feature: SWISSPROT Homolog: YN8S_YEAST Hypothetical protein YNR048W with e-value of 1.0e-44 and BLAST sequence identity of 40.0
  misc_feature: SWISSPROT Homolog: LEM3_YEAST Alkylphosphocholine resistance protein LEM3 (Ro-sensitive 3) with e-value of 6.7e-34 and BLAST sequence identity of 36.0
  misc_feature 177495:<222: Transcription Factor
  misc_feature: Phenotype: ROSETTE LEAVES - Curled 4 Useful for making ornamental plants with altered leaf shape
  misc_feature: Phenotype: CAULINE LEAVES - Curled 5 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(353): Functional Homolog of  Ceres CLONE ID no. 37019 at SEQ ID NO. 1643 with e-value of 5.40E-122 and BLAST sequence identity of 64.1
MIGEATSSSGGGKDDSPAAVSAKKNKKPNYSRFTQQELPACKPILTPGWVITSFIVVGVVFIPIGLASLYASEHVVEIVERYDKDCIPPDYRNNSLHYIQTSEINKTCTMTINVPKHMKSPVFIYYELDNFYQNHRRYVKSRSDKQLRSKASEGVTETCKPEAVTSNGQPIVPCGLVAWSLFNDTYRFSVKKEVLDVSKKNIAWKSDQEHKFGSDVYPKNFQSGSLIGGGKLDSSIPLSEQVDLIVWMRTAALPNFRKLYGKIEKDLQANTTITVTIENNYNTYSFGGKKKLVLSTTSWIGGKNSFLGRAYIAIGGLCLFLAVCFVFVYVFKPRPLGDPSYLSWNRNPSGQMN

SEQ ID NO: 1610 - protein, 186 aa, Arabidopsis thaliana
  misc_feature (1)..(186): Ceres CLONE ID no. 37217
  misc_feature (1)..(106): Pfam Name: BAH Pfam Description: BAH domain
  misc_feature (110)..(159): Pfam Name: PHD Pfam Description: PHD-finger
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
MRPSDAGKPPYVARVEKIEADARNNVKVHCRWYYRPEESLGGRRQFHGAKELFLSDHFDVQSAHTIEGKCIVHTFKNYTRLENVGAEDYYCRFEYKAATGAFTPDRVAVYCKCEMPYNPDDLMVQCEGCKDWYHPACVGMTIEEAKKLDHFVCAECSSDDDVKKSQNGFTSSPADDVKVETKRRKR

SEQ ID NO: 1611 - DNA, 732 bp, Populus balsamifera subsp. trichocarpa
  misc_feature (1)..(732): Ceres ANNOT ID no. 1465580
  misc_feature 177702:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
atggctaaaaccagaccaggaggcatcatctccaagcctaaaacaggcaagagggaccttgaatcctacacaattcgtggcactaccaaagttgttagagcgggggattgtgtattgatgagaccatctgatactggtaggccttcatacgtggcaaaaattgaggcgattgaggctgatagcagaaacaatgtgaaggttagagtgagatggtactataggccagaagagtctttgggagggcgcaggcagtttcatggagcaaaagagttgttcttatcagatcattatgatgtacaaagtgctcacaccattgaagggaagtgtatagttcactcttttaagaactatacaaagctcgagaatgttggagctgaggattattattgtaggtttgagtataaggctgctactggaggtttcacaccagaccgtgttgctgtgtattgcaaatgtgagatgccatataacccagatgatctcatggtgcaatgtgagggttgcaaggactggtatcatcctgcttgtgttgacatgacaattgaagaggcaaagaaattggatcacttcatgtgttctgagtgtgcatctgatgatgatgtgaaaagatcacagaatggattttcagcatcatcattagctgaagtcaaggcgagacttttctctatcctgtttccttttttctggagattcatttttgtggccttaatataccccatttactgtgcatga

SEQ ID NO: 1612 - protein, 243 aa, Populus balsamifera subsp. trichocarpa
  misc_feature (1)..(243): Ceres ANNOT ID no. 1465580
  misc_feature (149)..(198): Pfam Name: PHD Pfam Description: PHD-finger
  misc_feature (30)..(145): Pfam Name: BAH Pfam Description: BAH domain
  misc_feature: SWISSPROT Homolog: PHF2_HUMAN PHD finger protein 2 (GRC5) with e-value of 1.3e-10 and BLAST sequence identity of 39.0
  misc_feature: SWISSPROT Homolog: PHF2_MOUSE PHD finger protein 2 (GRC5) with e-value of 3.4e-10 and BLAST sequence identity of 37.7
  misc_feature: SWISSPROT Homolog: PB1_HUMAN Protein polybromo-1 (hPB1) (Polybromo-1D) BRG1-associated factor 180 (BAF180) with e-value of 1.4e-09 and BLAST sequence identity of 32.1
  misc_feature: SWISSPROT Homolog: PHF8_MOUSE PHD finger protein 8 with e-value of 5.9e-09 and BLAST sequence identity of 36.1
  misc_feature: SWISSPROT Homolog: PHF8_HUMAN PHD finger protein 8 with e-value of 6.2e-09 and BLAST sequence identity of 36.1
  misc_feature 177810:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature (1)..(243): Functional Homolog of  Ceres CLONE ID no. 37217 at SEQ ID NO. 1654 with e-value of 1.60E-88 and BLAST sequence identity of 86.5
MAKTRPGGIISKPKTGKRDLESYTIRGTTKVVRAGDCVLMRPSDTGRPSYVAKIEAIEADSRNNVKVRVRWYYRPEESLGGRRQFHGAKELFLSDHYDVQSAHTIEGKCIVHSFKNYTKLENVGAEDYYCRFEYKAATGGFTPDRVAVYCKCEMPYNPDDLMVQCEGCKDWYHPACVDMTIEEAKKLDHFMCSECASDDDVKRSQNGFSASSLAEVKARLFSILFPFFWRFIFVALIYPIYCA

SEQ ID NO: 1613 - DNA, 828 bp, Populus balsamifera subsp. trichocarpa
  misc_feature (1)..(828): Ceres ANNOT ID no. 1472014
  misc_feature 177898:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
atggccaaaaccaaacctggcaaaaaagaccttgattcttacactatcaaaggcaccaacaaagttgttagacctggtgattgtgtgttgatgcgcccatcggatacagataagcttccatacgtggcacgtatagagaaaatcgaggcagatcatcgaaacaacgttaaagttcgtgtacggtggtactaccggccggaggaatccattgggggacgccgtcaattccacggagcaaaagagttattcctgtcagaccactatgatgtgcaaagtgcacatacaatcgaaggcaagtgcacagtgcactccttcaagaactacactaagcttgaaaatgttggagctgaggattacttttgtaggttcgaatacaaggcttccactggtggtttcactcccgatcgtgtagctgtgtactgtaagtgtgaaatgccatacaatccggatgatctcatggtgcaatgcgagggatgcaaagattggtttcatccttcttgtatgggtatgacaattgaagaagccaaaaaatcagatcactttctgtgctccgactgctcatctgatgatgatgcaaaaagatctttgaatgtattcccagtatcaccatcacttgaggttaaggatcacccttaccttattggcttgtcgacatggtgtggagacaaaacgcaggaagagatgactgaagttgcggtgcataacaaagggttagtaaatgttcttgcactagctccaccatcgctgtcatccctgctgggttatgttatggaattgtacagtgcagagaagatatcgtgcttgcacaaacaagaggcattttattaa

SEQ ID NO: 1614 - protein, 275 aa, Populus balsamifera subsp. trichocarpa
  misc_feature (1)..(275): Ceres ANNOT ID no. 1472014
  misc_feature (140)..(189): Pfam Name: PHD Pfam Description: PHD-finger
  misc_feature (21)..(136): Pfam Name: BAH Pfam Description: BAH domain
  misc_feature: SWISSPROT Homolog: PHF2_HUMAN PHD finger protein 2 (GRC5) with e-value of 1.3e-10 and BLAST sequence identity of 39.0
  misc_feature: SWISSPROT Homolog: PHF2_MOUSE PHD finger protein 2 (GRC5) with e-value of 3.4e-10 and BLAST sequence identity of 37.7
  misc_feature: SWISSPROT Homolog: PB1_HUMAN Protein polybromo-1 (hPB1) (Polybromo-1D) BRG1-associated factor 180 (BAF180) with e-value of 1.4e-09 and BLAST sequence identity of 32.1
  misc_feature: SWISSPROT Homolog: PHF8_MOUSE PHD finger protein 8 with e-value of 5.9e-09 and BLAST sequence identity of 36.1
  misc_feature: SWISSPROT Homolog: PHF8_HUMAN PHD finger protein 8 with e-value of 6.2e-09 and BLAST sequence identity of 36.1
  misc_feature 178008:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature (1)..(275): Functional Homolog of  Ceres CLONE ID no. 37217 at SEQ ID NO. 1654 with e-value of 2.79E-84 and BLAST sequence identity of 82.5
MAKTKPGKKDLDSYTIKGTNKVVRPGDCVLMRPSDTDKLPYVARIEKIEADHRNNVKVRVRWYYRPEESIGGRRQFHGAKELFLSDHYDVQSAHTIEGKCTVHSFKNYTKLENVGAEDYFCRFEYKASTGGFTPDRVAVYCKCEMPYNPDDLMVQCEGCKDWFHPSCMGMTIEEAKKSDHFLCSDCSSDDDAKRSLNVFPVSPSLEVKDHPYLIGLSTWCGDKTQEEMTEVAVHNKGLVNVLALAPPSLSSLLGYVMELYSAEKISCLHKQEAFY

SEQ ID NO: 1615 - DNA, 1074 bp, Populus balsamifera subsp. trichocarpa
  misc_feature (1)..(1074): Ceres ANNOT ID no. 1445195
  misc_feature 178102:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
atggccaaaaccaaacctggcaaaaaagaccttgattcctacactatcaaaggcaccaacaaagttgttagacctggtgattgtgtgttgatgcgcccatcggacaccgataagcttccatacgtggcacttgtagagaaaatcgaggcagatcatagaaacaacgttaaagttcgtgtacggtggtactaccggccggaggaatccattgggggacgccgtcaattccacggagccaaagagttattcttgtcagaccaccatgatatgcaaagtgcacacacaatcgaaggcaagtgcacagtgcactccttcaagaactatagtaagcttgagaatgttggagctgaggattacttttgtaggttcgagtacaaggcttccaccggtgggttcactcctgatcgtgtagctgtgtactgtaagtgcgagatgccatacaatccagacgatctcatggtgcaatgcgagggatgcaaagattggtttcatccatcttgtatgggtatgacaattgaagaagccaaaaaattggatcactttctatgctctgactgctcatctgaagatgatgcgaagagatctatgaatgtattcccagtatctccgtcccttgaagctaaggaactatctattgagaggcattcagacaaaacccattgtttctatcatgatgaaagtgatccgactcctaccgaggattcaaagttggctcagtggaagatcaaaaatgctagaatcatgacctggattttagcctatgttgactctctgattgctctaaatctgaggccgtataagactgccaagaatatgtgctttgaggagttactttgtgaagagcaacatcttgctacacaggctaccttacagcaagacaaattacccactaatattgttgcctatgctgctcaagtgaaagggaaaggacttaaaggtaacagtttcctacaattaaaatcatggcgtgttgattctggtgcttctaatcatgacacttttcacaatattcggccatatacaacatctttacaaattacgattgctaatggtagtcagtttacctattcatga

SEQ ID NO: 1616 - protein, 327 aa, Populus balsamifera subsp. trichocarpa
  misc_feature (1)..(327): Ceres ANNOT ID no. 1445195
  misc_feature (1)..(106): Pfam Name: BAH Pfam Description: BAH domain
  misc_feature (110)..(159): Pfam Name: PHD Pfam Description: PHD-finger
  misc_feature: SWISSPROT Homolog: PHF2_HUMAN PHD finger protein 2 (GRC5) with e-value of 1.3e-10 and BLAST sequence identity of 39.0
  misc_feature: SWISSPROT Homolog: PHF2_MOUSE PHD finger protein 2 (GRC5) with e-value of 3.4e-10 and BLAST sequence identity of 37.7
  misc_feature: SWISSPROT Homolog: PB1_HUMAN Protein polybromo-1 (hPB1) (Polybromo-1D) BRG1-associated factor 180 (BAF180) with e-value of 1.4e-09 and BLAST sequence identity of 32.1
  misc_feature: SWISSPROT Homolog: PHF8_MOUSE PHD finger protein 8 with e-value of 5.9e-09 and BLAST sequence identity of 36.1
  misc_feature: SWISSPROT Homolog: PHF8_HUMAN PHD finger protein 8 with e-value of 6.2e-09 and BLAST sequence identity of 36.1
  misc_feature 178220:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature (1)..(327): Functional Homolog of  Ceres CLONE ID no. 37217 at SEQ ID NO. 1654 with e-value of 1.79E-82 and BLAST sequence identity of 80.8
MRPSDTDKLPYVALVEKIEADHRNNVKVRVRWYYRPEESIGGRRQFHGAKELFLSDHHDMQSAHTIEGKCTVHSFKNYSKLENVGAEDYFCRFEYKASTGGFTPDRVAVYCKCEMPYNPDDLMVQCEGCKDWFHPSCMGMTIEEAKKLDHFLCSDCSSEDDAKRSMNVFPVSPSLEAKELSIERHSDKTHCFYHDESDPTPTEDSKLAQWKIKNARIMTWILAYVDSLIALNLRPYKTAKNMCFEELLCEEQHLATQATLQQDKLPTNIVAYAAQVKGKGLKGNSFLQLKSWRVDSGASNHDTFHNIRPYTTSLQITIANGSQFTYS

SEQ ID NO: 1617 - protein, 340 aa, Arabidopsis thaliana
  misc_feature (1)..(340): Ceres CLONE ID no. 37229
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MAAMAAKLQLSAKSDQSSVRLPRVINLSRDPTTRVSFPRNGSVCSLHTNFSSPHLAKPCAGGGGGGSTGNNGGGSGSGGGGGGFGGSGGEASEESSPWGPIGLFIQGWRSRVAADPQFPFKVLMEEIVGLSACVLGDMASRPNFGLNELDFVFSTLVVGSILNFVLMYMLAPTAATLGSSQTLPGIFRNCPSSHMFEQGSFTVMNRFGTLVYKGMVFASVGLAAGLVGTAISNGLIMLRKKMDPSFETPNKPPPTVLNSLTWATHMGVSANARYQTLNGIEFLLAKVLPPLVFKTSVIVLRCANNVAGGMSFVLLARMTGSQSVEEKTEMSEISEKEKDD

SEQ ID NO: 1618 - DNA, 1074 bp, Populus balsamifera subsp. trichocarpa
  misc_feature (1)..(1074): Ceres ANNOT ID no. 1485157
  misc_feature 178418:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atggcaacggcagcagcccagctccgattctcgacatttgcaaggcaatacgctgctaatttcaccaaacaaaacaaccctagattcccaaatcccaattctccttctctctctttccctttctccacccctcttaatccctccctccgcctcctccattccaaaccaccccacctttccaatgccggtggaggcttcggtggcagtggcggagatggtggaaactggagtggcggcggcggcggagctggtgattcgagttctgacaattcatcatcgtccgcggcggggtttggggttctgggtctttttctaaatgggtggagatcgcgggtcgcggcggatccgcagttcccttttaaggtattgatggaggaagtagttggggtgtctgcttgtgttcttggtgatatggcatcgcggccgaattttggtcttgacgagttggattttgttttttcgaccctggttgttggttgtatactgaattttaccttgatgtatttgcttgcgcctactgcggctgctactagtcagacattgcctgcaattttcgccaattgtccgacaagtcatatgtttgaaccgggtgcatatggtttgatgaacaggcttggtacttttgtttataaaggaactatttttgctgctgttggttttgccgcgggtttggtagggactgcgctatcaaatgggttgattaagatgaggaagaagatggatcccacttttgagacgccgaataaggcacctcccactgttttgaatgcattgacctgggcaattcatatggggtttagtagtaatttgaggtaccagacgctgaatggggctgagtttttgttggagaaaggactttctcccttggcgtttaagacatcggtcgtggttcttaggtgcttgaataatgttcttggtgggatgtcgtttgtgatattggcgaggatgacgggttctcagagcgttgaagaaccaaaactggttgatgttgatgtcgggctggctgctccagagaaggagaaactgcttgatggaggagacgaattgcagagcaatcagtcgactttcaagtga

SEQ ID NO: 1619 - protein, 357 aa, Populus balsamifera subsp. trichocarpa
  misc_feature (1)..(357): Ceres ANNOT ID no. 1485157
  misc_feature: SWISSPROT Homolog: HXB3_MOUSE Homeobox protein Hox-B3 (Hox-2.7) (MH-23) with e-value of 3.0e-06 and BLAST sequence identity of 60.9
  misc_feature: SWISSPROT Homolog: GRP1_SORBI Glycine-rich RNA-binding protein 1 (Fragment) with e-value of 5.4e-06 and BLAST sequence identity of 65.6
  misc_feature: SWISSPROT Homolog: ANDR_HUMAN Androgen receptor (Dihydrotestosterone receptor) with e-value of 7.4e-06 and BLAST sequence identity of 39.8
  misc_feature: SWISSPROT Homolog: MKRN2_SERQU Makorin-2 (Zinc finger protein YGHLC3HC4) with e-value of 8.3e-06 and BLAST sequence identity of 42.6
  misc_feature 178518:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(357): Functional Homolog of  Ceres CLONE ID no. 37229 at SEQ ID NO. 1661 with e-value of 2.90E-107 and BLAST sequence identity of 69.0
MATAAAQLRFSTFARQYAANFTKQNNPRFPNPNSPSLSFPFSTPLNPSLRLLHSKPPHLSNAGGGFGGSGGDGGNWSGGGGGAGDSSSDNSSSSAAGFGVLGLFLNGWRSRVAADPQFPFKVLMEEVVGVSACVLGDMASRPNFGLDELDFVFSTLVVGCILNFTLMYLLAPTAAATSQTLPAIFANCPTSHMFEPGAYGLMNRLGTFVYKGTIFAAVGFAAGLVGTALSNGLIKMRKKMDPTFETPNKAPPTVLNALTWAIHMGFSSNLRYQTLNGAEFLLEKGLSPLAFKTSVVVLRCLNNVLGGMSFVILARMTGSQSVEEPKLVDVDVGLAAPEKEKLLDGGDELQSNQSTFK

SEQ ID NO: 1620 - DNA, 1059 bp, Populus balsamifera subsp. trichocarpa
  misc_feature (1)..(1059): Ceres ANNOT ID no. 1476218
  misc_feature 178627:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atggaaacggcagcagcccagctccgaatctctgcattttcaaggcaatacattactaattacaccacccccagattcccaaaccctaattctccttctctctctttcccctttgccacccctcttaacccctctctccgcctcctcccttccaaaccacccaccccctccaatgccggaggcggtggaaccttcggtggaaacggtggagatggtggaaactggagtggtggtggtgattcgagctctgacaattcatcgtcgtcgtcggcggggtttggggttctgggtctttttttaaatgggtggagatcacgggtggcggcggatccgcagttcccttttaaggtgttgatggaggaggttgttggagtgtcttcttgtattcttggggatatggcttcgcggccgaattttggtcttaatgagttggattttgttttttcgactttggttgttggtgctatactcaattttactttgatgtatttgcttgcgccgaccgcggcggctactagtcagacattgcctgcgatcttcgcaaattgtccaaccagtcatatgtttgagccaggtgcttatagtttgatgagtagacttggtacacttgtttataaaggaattatttttgctgctgttggttttgctgctggtttggtagggactgagctttcaaatgggttgattaagatgaggaaaaagatggatccgagctttgagacgccgaataaaccacctccgactgttttgaatgccttgacgtgggcgattcatatgggggttagtagcaatctcaggtaccagtcactgaatggggtggagtttttgttggccaacggacttcctccgtttgcgtttaagtcatcggttgtggttcttaggtgcttgaataatgttcttggtgggatgacctttgtcatattggcaaggatgacggggtctcagagtgttgaagaatcgaaacctgttgctgatggtgttagatcggctgctccggagaaggagaaactgcttgatggaggtgaggagttgcagagcaaacagtcgactttcaagtga

SEQ ID NO: 1621 - protein, 352 aa, Populus balsamifera subsp. trichocarpa
  misc_feature (1)..(352): Ceres ANNOT ID no. 1476218
  misc_feature: SWISSPROT Homolog: HXB3_MOUSE Homeobox protein Hox-B3 (Hox-2.7) (MH-23) with e-value of 3.0e-06 and BLAST sequence identity of 60.9
  misc_feature: SWISSPROT Homolog: GRP1_SORBI Glycine-rich RNA-binding protein 1 (Fragment) with e-value of 5.4e-06 and BLAST sequence identity of 65.6
  misc_feature: SWISSPROT Homolog: ANDR_HUMAN Androgen receptor (Dihydrotestosterone receptor) with e-value of 7.4e-06 and BLAST sequence identity of 39.8
  misc_feature: SWISSPROT Homolog: MKRN2_SERQU Makorin-2 (Zinc finger protein YGHLC3HC4) with e-value of 8.3e-06 and BLAST sequence identity of 42.6
  misc_feature 178727:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(352): Functional Homolog of  Ceres CLONE ID no. 37229 at SEQ ID NO. 1661 with e-value of 7.59E-107 and BLAST sequence identity of 66.0
METAAAQLRISAFSRQYITNYTTPRFPNPNSPSLSFPFATPLNPSLRLLPSKPPTPSNAGGGGTFGGNGGDGGNWSGGGDSSSDNSSSSSAGFGVLGLFLNGWRSRVAADPQFPFKVLMEEVVGVSSCILGDMASRPNFGLNELDFVFSTLVVGAILNFTLMYLLAPTAAATSQTLPAIFANCPTSHMFEPGAYSLMSRLGTLVYKGIIFAAVGFAAGLVGTELSNGLIKMRKKMDPSFETPNKPPPTVLNALTWAIHMGVSSNLRYQSLNGVEFLLANGLPPFAFKSSVVVLRCLNNVLGGMTFVILARMTGSQSVEESKPVADGVRSAAPEKEKLLDGGEELQSKQSTFK

SEQ ID NO: 1622 - protein, 256 aa, Arabidopsis thaliana
  misc_feature (1)..(256): Ceres CLONE ID no. 37288
  misc_feature (81)..(180): Pfam Name: K-box Pfam Description: K-box region
  misc_feature (9)..(59): Pfam Name: SRF-TF Pfam Description: SRF-type transcription factor DNA-binding and dimerisation domain)
  misc_feature: Utility: Plant Size Useful for making plants with increased size and biomass
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Plant Size Useful for making plants with increased size and biomass
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKVELERLQLAIERLKGKELEGMSFPDLISFENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 1623 - DNA, 753 bp, Populus balsamifera subsp. trichocarpa
  misc_feature (1)..(753): Ceres ANNOT ID no. 1453650
  misc_feature: Utility: Plant Size Useful for making plants with increased size and biomass
  misc_feature 179011:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Plant Size Useful for making plants with increased size and biomass
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggggagagggaagattgagataaagaggatagaaaacttgaatagcaggcaggtcaccttctccaaacgcaggaatgggttgctgaagaaagctagagaattatcagttttgtgtgatgctgaggttgctgtcatagtcttctctagcacaggaaagctttatgaattttcaagcacaagcatggaacacacactttcaagatatggcagtggcctggatttggattataatgaccatccttctgatgaccatggggcagagcattcaaatagtgcagaggttaatgcagtgaaagatgaactctcaaagttacggttgacatgcttgcagatgatgggtcaacaacttgatggcttgagtttcaaggagctgcaacacctagaacatcaattaagtgcaggcattctgtctgttaaggacaagaaggaacaaatgctgatggatcagcttaagaaatccaaaatgcaggagcaaaaggccactctagagaacgaatctctgcgtaaacagattgaggaactcaaacgaggatcccggccaaagtctgctttcctggaattaagtcctttggacaggagatttgccgtagcaagttcgaaacctgatagtaatcgcaaaccacaggaagaagaagatctttccgacacttcattgcacttggggttgtcatctgatgtttgtcacaagaggaaagctgacaagattgaatctgtctccaatgattcaggaagtcaggtggcttcagggtga

SEQ ID NO: 1624 - protein, 250 aa, Populus balsamifera subsp. trichocarpa
  misc_feature (1)..(250): Ceres ANNOT ID no. 1453650
  misc_feature (77)..(174): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AGL15_ARATH Agamous-like MADS-box protein AGL15 with e-value of 8.0e-42 and BLAST sequence identity of 42.1
  misc_feature: SWISSPROT Homolog: AGL15_BRANA Agamous-like MADS-box protein AGL15 with e-value of 6.7e-38 and BLAST sequence identity of 42.1
  misc_feature: SWISSPROT Homolog: MAD17_ORYSA MADS-box transcription factor 17 (OsMADS17) (NMADS3) (RMADS213) with e-value of 1.8e-33 and BLAST sequence identity of 43.0
  misc_feature: SWISSPROT Homolog: CAL_ARATH Transcription factor CAULIFLOWER (Agamous-like MADS-box protein AGL10) with e-value of 5.0e-33 and BLAST sequence identity of 43.3
  misc_feature: SWISSPROT Homolog: MAD57_ORYSA MADS-box transcription factor 57 (OsMADS57) with e-value of 2.2e-32 and BLAST sequence identity of 37.2
  misc_feature: Utility: Plant Size Useful for making plants with increased size and biomass
  misc_feature 179196:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Plant Size Useful for making plants with increased size and biomass
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(250): Functional Homolog of  Ceres CLONE ID no. 37288 at SEQ ID NO. 1666 with e-value of 1.30E-56 and BLAST sequence identity of 55.3
MGRGKIEIKRIENLNSRQVTFSKRRNGLLKKARELSVLCDAEVAVIVFSSTGKLYEFSSTSMEHTLSRYGSGLDLDYNDHPSDDHGAEHSNSAEVNAVKDELSKLRLTCLQMMGQQLDGLSFKELQHLEHQLSAGILSVKDKKEQMLMDQLKKSKMQEQKATLENESLRKQIEELKRGSRPKSAFLELSPLDRRFAVASSKPDSNRKPQEEEDLSDTSLHLGLSSDVCHKRKADKIESVSNDSGSQVASG

SEQ ID NO: 1625 - protein, 277 aa, Arabidopsis thaliana
  misc_feature (1)..(277): Ceres CLONE ID no. 37298
  misc_feature (32)..(223): Pfam Name: Band_7 Pfam Description: SPFH domain / Band 7 family
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MGSQQAAVSFLSNLAKAAFGLGTAATVLNTSLFTVDGGERAVIFDRFRGVMDQTVGEGTHFLIPILQRPHIFDIRTKPHTFSSISGTKDLQMVNLTLRVLSRPEVSRLPYIFQTLGLEYDEKVLPSIGNEVLKAVVAQFNADQLLTERPHVSALVRESLITRAKDFNIVLDDVAITHLSYGVEFSRAVEQKQVAQQEAERSKFVVMKADQERRAAVIRAEGESEAAQLISDATAKAGMGLIELRRIEASREIASTLARSPNVAYLPGGQSMLFALNR

SEQ ID NO: 1626 - DNA, 840 bp, Populus balsamifera subsp. trichocarpa
  misc_feature (1)..(840): Ceres ANNOT ID no. 1476538
  misc_feature 179499:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgggtagcagccaagcagcggtttcctttcttaacaacctcgctcgcgcagctttcggtatcggcgccgccgctaccgttctcaactcctctctttacacagtcgatggaggccaacgcgctgttctctttgacagattccgtggagtcattgacactaccataggcgaagggactcattttcttatcccttggcttcaaaagccatttatctttgatatccgaacacgccctcacactttctcttctgtctctggtactaaagatctccagatggtcaatctcacactccgtgttctctctcgtcccgaggtgtcacgtttgccccatatctttcaacgtcttgggcttgagtatgatgagaaggtgcttccttcgattggcaatgaggtcttgaaggctgttgttgcacagttcaatgctgaccagctcctcactgaacgtccccatgtgtcagctatggtccgtgactcgctcatcaagcgtgcaagagactttgacattgtgatggatgatgtggctattacccacttgtcttatggagtggagttctcaagggctgtggagcagaagcaggttgctcagcaggaggcagagaggtccaagtttgttgtcatgaaagctgaccaggagagaagggctgcaattatcagggcagaaggtgagagtgatgctgctaagctgatctctgaggcaacaacaaaggctggtatggggttgattgaattgagaaggattgaagcatcgagggaaattgcttcaactctggccaagtcatctaatgtggcataccttcctggtggtaacaacatgcttctggccctgaatgcaaaccgttga

SEQ ID NO: 1627 - protein, 279 aa, Populus balsamifera subsp. trichocarpa
  misc_feature (1)..(279): Ceres ANNOT ID no. 1476538
  misc_feature (32)..(223): Pfam Name: Band_7 Pfam Description: SPFH domain / Band 7 family
  misc_feature: SWISSPROT Homolog: PHB1_YEAST Prohibitin-1 with e-value of 2.8e-78 and BLAST sequence identity of 59.5
  misc_feature: SWISSPROT Homolog: PHB_CHICK Prohibitin with e-value of 6.7e-77 and BLAST sequence identity of 56.1
  misc_feature: SWISSPROT Homolog: PHB_BOVIN Prohibitin with e-value of 7.7e-76 and BLAST sequence identity of 55.8
  misc_feature: SWISSPROT Homolog: PHB_HUMAN Prohibitin with e-value of 7.7e-76 and BLAST sequence identity of 55.8
  misc_feature: SWISSPROT Homolog: PHB_MOUSE Prohibitin (B-cell receptor-associated protein 32) (BAP 32) with e-value of 1.6e-75 and BLAST sequence identity of 55.4
  misc_feature 179659:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(279): Functional Homolog of  Ceres CLONE ID no. 37298 at SEQ ID NO. 1669 with e-value of 8.50E-124 and BLAST sequence identity of 87.3
MGSSQAAVSFLNNLARAAFGIGAAATVLNSSLYTVDGGQRAVLFDRFRGVIDTTIGEGTHFLIPWLQKPFIFDIRTRPHTFSSVSGTKDLQMVNLTLRVLSRPEVSRLPHIFQRLGLEYDEKVLPSIGNEVLKAVVAQFNADQLLTERPHVSAMVRDSLIKRARDFDIVMDDVAITHLSYGVEFSRAVEQKQVAQQEAERSKFVVMKADQERRAAIIRAEGESDAAKLISEATTKAGMGLIELRRIEASREIASTLAKSSNVAYLPGGNNMLLALNANR

SEQ ID NO: 1628 - DNA, 840 bp, Populus balsamifera subsp. trichocarpa
  misc_feature (1)..(840): Ceres ANNOT ID no. 1493576
  misc_feature 179809:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgggtagcagccaagcagcagtttccttccttaacaacgtcgctcgcgcagcttttggtcttggtgccgccgctaccattctcaactcctctctttacaccgtcgatggaggccaacgcgctgttctctttgacagattccgtggagtcattgatactagcattggtgaagggactcatttcctcatcccttggcttcaaaagccatttatctttgacatccgtacacgacctcacactttctcttctgtctctggtaccaaggatcttcagatggtcaatcttaccctccgtgttctctctcgtcctgaggtgtcacgtttgcctcatatctttcaacgccttgggctcgagtatgatgagaaggtgctcccctcgattggcaatgaggtgttgaaggctgtggttgctcagttcaatgctgatcagctcctcactgagcgtccccaggtgtcagctctagtccgtgatgcactcatcaagcgtgcaagggacttcgacatagtgatggatgatgtggctattacccacttgtcttatggagtggagttctcaagggctgtagagcagaaacaggttgcgcagcaagaggcagagaggtccaagtttgttgtcatgaaggctgaccaggagagaagggctgcaattatcagggcagaaggtgagagtgatgccgctaagctgatctctgaggcaacaacaaaagctggtatggggctgattgaattgagaaggattgaagcatcaagggaaattgcttcaactctggctaagtcacccaacgtggcataccttcctggtggtaacaacatgcttctggcactgaatgcaaaccggtga

SEQ ID NO: 1629 - protein, 279 aa, Populus balsamifera subsp. trichocarpa
  misc_feature (1)..(279): Ceres ANNOT ID no. 1493576
  misc_feature (32)..(223): Pfam Name: Band_7 Pfam Description: SPFH domain / Band 7 family
  misc_feature: SWISSPROT Homolog: PHB1_YEAST Prohibitin-1 with e-value of 2.8e-78 and BLAST sequence identity of 59.5
  misc_feature: SWISSPROT Homolog: PHB_CHICK Prohibitin with e-value of 6.7e-77 and BLAST sequence identity of 56.1
  misc_feature: SWISSPROT Homolog: PHB_BOVIN Prohibitin with e-value of 7.7e-76 and BLAST sequence identity of 55.8
  misc_feature: SWISSPROT Homolog: PHB_HUMAN Prohibitin with e-value of 7.7e-76 and BLAST sequence identity of 55.8
  misc_feature: SWISSPROT Homolog: PHB_MOUSE Prohibitin (B-cell receptor-associated protein 32) (BAP 32) with e-value of 1.6e-75 and BLAST sequence identity of 55.4
  misc_feature 179969:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(279): Functional Homolog of  Ceres CLONE ID no. 37298 at SEQ ID NO. 1669 with e-value of 4.69E-123 and BLAST sequence identity of 86.5
MGSSQAAVSFLNNVARAAFGLGAAATILNSSLYTVDGGQRAVLFDRFRGVIDTSIGEGTHFLIPWLQKPFIFDIRTRPHTFSSVSGTKDLQMVNLTLRVLSRPEVSRLPHIFQRLGLEYDEKVLPSIGNEVLKAVVAQFNADQLLTERPQVSALVRDALIKRARDFDIVMDDVAITHLSYGVEFSRAVEQKQVAQQEAERSKFVVMKADQERRAAIIRAEGESDAAKLISEATTKAGMGLIELRRIEASREIASTLAKSPNVAYLPGGNNMLLALNANR

SEQ ID NO: 1630 - protein, 416 aa, Arabidopsis thaliana
  misc_feature (1)..(416): Ceres CLONE ID no. 37398
  misc_feature (12)..(261): Pfam Name: Pkinase_Tyr Pfam Description: Protein tyrosine kinase
  misc_feature (292)..(352): Pfam Name: NAF Pfam Description: NAF domain
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
MGLFRTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDYCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKVKIQPKEIRSRSSYDLLSAEVIEVTPTNCVIEISKSAGELRLYMEFCQSLSSLLTAEVS

SEQ ID NO: 1631 - DNA, 1401 bp, Populus balsamifera subsp. trichocarpa
  misc_feature (1)..(1401): Ceres ANNOT ID no. 1531721
  misc_feature 180262:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
atgggacatggaaataacataggtaagtaccagttaggtcgaacaatcggagagggaacatttgccaaggttaagctggctgtagacagcactgatggtcgtcctcttgcaatcaagatcatggataagaaaaaggtcatgcaaagccatctcaaggatcagagggagataagagctatgaagctcttgcaccaccccggtatcgtaaggatacatgaggtgattggcacaaagacaaagatttatatggtaatggaatatgtatcaggaggacaactagcagataagctgtcctatgccaagaaacttcgtgaatcggaggcgagaagaatattccatcaattgatagatgccgtggactattgccataacagaggagtttatcacagagatctaaagccagagaacttacttctggacggcaaaggaaatctgaaagtctctgacttcggactaagtgcattacaaaagaccgcaagcttgctaactacaacatgcgggtcacctttctatatagcacctgagcttattgcaaataagggttatgagggggcagcagcagatctttggtcctgtggggtaatcctttttgagctactgtcgggatatctaccatttgacgaacgcaacctcataatgttgtataagaagatatctgcagctgattacacatgtccacagtggtttacagaaagtcaaaagaagctaatatcaagaatattagatccaaatcccagaaagagaataacattaccagagatccttgaagacgaatggtttcagatagattacgtgccttctagtggatatgaatgtgatgaaaaaatcttcttggatgatgttaatgctgcttttgatgctgacgaggtcaacgcctcagaaacagagacccctaaatcctcaagtttcataaacgctttccaactgatagcaatgtcccatgatcttgatttatcaggtctcttcgaagaacaggaagacaggaagcagaaaaccaggctaggatccaaacatacagttaacgaaaccataaggaaaatagaagctgctgcaatggatatgagtttgtcagttgaaagaatgaacaatttcaagatgaaaatgcatcagaaaccaaacatgaaaagatataccagatcatattatgacctatcagcagaggtaatcgaggttgctcctatgaattgcgttgtagaaatatcaaaatcagtcggggagacaagattgtacaaagagttctgcaaaagtttatcgagtttgctgacaaagatatcagatgtatcattgcaaaaggaaggatcagaaaaatcaagcaacaatagaagcactcaagagataagaagctgtgaggagcaaaatgaaaaagtgactaatggccttcaaggctattcctcttcttga

SEQ ID NO: 1632 - protein, 466 aa, Populus balsamifera subsp. trichocarpa
  misc_feature (1)..(466): Ceres ANNOT ID no. 1531721
  misc_feature (23)..(168): Pfam Name: RIO1 Pfam Description: RIO1 family
  misc_feature (300)..(360): Pfam Name: NAF Pfam Description: NAF domain
  misc_feature: SWISSPROT Homolog: CIPK1_ARATH CBL-interacting serine/threonine-protein kinase 1 chloroplast precursor with e-value of 5.1e-95 and BLAST sequence identity of 45.9
  misc_feature: SWISSPROT Homolog: CIPK1_ARATH EC 2.7.11.1 SOS2-like protein kinase PKS13 SNF1-related kinase 3.16
  misc_feature: SWISSPROT Homolog: CIPK1_ORYSA CIPK-like protein 1 chloroplast precursor (EC 2.7.11.1) (OsCK1) with e-value of 1.8e-92 and BLAST sequence identity of 45.2
  misc_feature: SWISSPROT Homolog: CPK24_ARATH CBL-interacting serine/threonine-protein kinase 24 chloroplast precursor with e-value of 3.3e-91 and BLAST sequence identity of 44.1
  misc_feature: SWISSPROT Homolog: CPK24_ARATH EC 2.7.11.1 SNF1-related kinase 3.11 SALT OVERLY SENSITIVE 2 protein
  misc_feature: SWISSPROT Homolog: CPK15_ARATH CBL-interacting serine/threonine-protein kinase 15 with e-value of 5.4e-84 and BLAST sequence identity of 45.2
  misc_feature: SWISSPROT Homolog: CPK15_ARATH EC 2.7.11.1 (Serine/threonine-protein kinase ATPK10) SOS2-like protein kinase PKS3 SOS-interacting protein 2 (SNF1-related kinase 3.1)
  misc_feature: SWISSPROT Homolog: SSRA_RAT TRAP-alpha Signal sequence receptor alpha subunit (SSR-alpha) Liver regeneration-related protein LRRG137
  misc_feature: SWISSPROT Homolog: CPK11_ARATH CBL-interacting serine/threonine-protein kinase 11 transduction-associated protein 3 with e-value of 1.8e-76 and BLAST sequence identity of 45.6
  misc_feature: SWISSPROT Homolog: CPK11_ARATH EC 2.7.11.1 (SOS2-like protein kinase PKS5) SOS-interacting protein 4 SNF1-related kinase 3.22
  misc_feature 180458:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature (1)..(466): Functional Homolog of  Ceres CLONE ID no. 37398 at SEQ ID NO. 1674 with e-value of 6.29E-135 and BLAST sequence identity of 68.75
MGHGNNIGKYQLGRTIGEGTFAKVKLAVDSTDGRPLAIKIMDKKKVMQSHLKDQREIRAMKLLHHPGIVRIHEVIGTKTKIYMVMEYVSGGQLADKLSYAKKLRESEARRIFHQLIDAVDYCHNRGVYHRDLKPENLLLDGKGNLKVSDFGLSALQKTASLLTTTCGSPFYIAPELIANKGYEGAAADLWSCGVILFELLSGYLPFDERNLIMLYKKISAADYTCPQWFTESQKKLISRILDPNPRKRITLPEILEDEWFQIDYVPSSGYECDEKIFLDDVNAAFDADEVNASETETPKSSSFINAFQLIAMSHDLDLSGLFEEQEDRKQKTRLGSKHTVNETIRKIEAAAMDMSLSVERMNNFKMKMHQKPNMKRYTRSYYDLSAEVIEVAPMNCVVEISKSVGETRLYKEFCKSLSSLLTKISDVSLQKEGSEKSSNNRSTQEIRSCEEQNEKVTNGLQGYSSS

SEQ ID NO: 1633 - DNA, 1455 bp, Populus balsamifera subsp. trichocarpa
  misc_feature (1)..(1455): Ceres ANNOT ID no. 1478221
  misc_feature 180609:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
atgggacatggaaataacataggtaagtaccagttaggtcgaacaatcggagagggaacatttgccaaggttaagctggctgtagacagcactgatggtcgtcctcttgcaatcaagatcatggataagaaaaaggtcatgcaaagccatctcaaggatcaggtacagagggagataagagctatgaagctcttgcaccaccccggtatcgtaaggatacatgaggtgattggcacaaagacaaagatttatatggtaatggaatatgtatcaggaggacaactagcagataagctgtcctatgccaagaaacttcgtgaatcggaggcgagaagaatattccatcaattgatagatgccgtggactattgccataacagaggagtttatcacagagatctaaagccagagaacttacttctggacggcaaaggaaatctgaaagtctctgacttcggactaagtgcattacaaaagaccgcaagcttgctaactacaacatgcgggtcacctttctatatagcacctgagcttattgcaaataagggttatgagggggcagcagcagatctttggtcctgtggggtaatcctttttgagctactgtcgggatatctaccatttgacgaacgcaacctcataatgttgtataagaagatatctgcagctgattacacatgtccacagtggtttacagaaagtcaaaagaagctaatatcaagaatattagatccaaatcccagaaagagaataacattaccagagatccttgaagacgaatggtttcagatagattacgtgccttctagtggatatgaatgtgatgaaaaaatcttcttggatgatgttaatgctgcttttgatgctgacgaggtcaacgcctcagaaacagagacccctaaatcctcaagtttcataaacgctttccaactgatagcaatgtcccatgatcttgatttatcaggtctcttcgaagaacaggcaagtctgcaaatcagaatttggctttactttctgcaaacttcctttgaagacaggaagcagaaaaccaggctaggatccaaacatacagttaacgaaaccataaggaaaatagaagctgctgcaatggatatgagtttgtcagttgaaagaatgaacaatttcaagatgaaaatgcatcagaaaccaaacatgaaaagatataccagatcatattatgacctatcagcagaggtaatcgaggttgctcctatgaattgcgttgtagaaatatcaaaatcagtcggggagacaagattgtacaaagagttctgcaaaagtttatcgagtttgctgacaaagatatcagatgtatcattgcaaaaggaaggatcagaaaaatcaagcaacaatagaagcactcaagagataagaagctgtgaggagcaaaatgaaaaagtgactaatggccttcaaggctattcctcttcttga

SEQ ID NO: 1634 - protein, 484 aa, Populus balsamifera subsp. trichocarpa
  misc_feature (1)..(484): Ceres ANNOT ID no. 1478221
  misc_feature (23)..(170): Pfam Name: RIO1 Pfam Description: RIO1 family
  misc_feature (343)..(378): Pfam Name: NAF Pfam Description: NAF domain
  misc_feature: SWISSPROT Homolog: CIPK1_ARATH CBL-interacting serine/threonine-protein kinase 1 chloroplast precursor with e-value of 5.1e-95 and BLAST sequence identity of 45.9
  misc_feature: SWISSPROT Homolog: CIPK1_ARATH EC 2.7.11.1 SOS2-like protein kinase PKS13 SNF1-related kinase 3.16
  misc_feature: SWISSPROT Homolog: CIPK1_ORYSA CIPK-like protein 1 chloroplast precursor (EC 2.7.11.1) (OsCK1) with e-value of 1.8e-92 and BLAST sequence identity of 45.2
  misc_feature: SWISSPROT Homolog: CPK24_ARATH CBL-interacting serine/threonine-protein kinase 24 chloroplast precursor with e-value of 3.3e-91 and BLAST sequence identity of 44.1
  misc_feature: SWISSPROT Homolog: CPK24_ARATH EC 2.7.11.1 SNF1-related kinase 3.11 SALT OVERLY SENSITIVE 2 protein
  misc_feature: SWISSPROT Homolog: CPK15_ARATH CBL-interacting serine/threonine-protein kinase 15 with e-value of 5.4e-84 and BLAST sequence identity of 45.2
  misc_feature: SWISSPROT Homolog: CPK15_ARATH EC 2.7.11.1 (Serine/threonine-protein kinase ATPK10) SOS2-like protein kinase PKS3 SOS-interacting protein 2 (SNF1-related kinase 3.1)
  misc_feature: SWISSPROT Homolog: SSRA_RAT TRAP-alpha Signal sequence receptor alpha subunit (SSR-alpha) Liver regeneration-related protein LRRG137
  misc_feature: SWISSPROT Homolog: CPK11_ARATH CBL-interacting serine/threonine-protein kinase 11 transduction-associated protein 3 with e-value of 1.8e-76 and BLAST sequence identity of 45.6
  misc_feature: SWISSPROT Homolog: CPK11_ARATH EC 2.7.11.1 (SOS2-like protein kinase PKS5) SOS-interacting protein 4 SNF1-related kinase 3.22
  misc_feature 180807:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature (1)..(484): Functional Homolog of  Ceres CLONE ID no. 37398 at SEQ ID NO. 1674 with e-value of 1.69E-132 and BLAST sequence identity of 68.6
MGHGNNIGKYQLGRTIGEGTFAKVKLAVDSTDGRPLAIKIMDKKKVMQSHLKDQVQREIRAMKLLHHPGIVRIHEVIGTKTKIYMVMEYVSGGQLADKLSYAKKLRESEARRIFHQLIDAVDYCHNRGVYHRDLKPENLLLDGKGNLKVSDFGLSALQKTASLLTTTCGSPFYIAPELIANKGYEGAAADLWSCGVILFELLSGYLPFDERNLIMLYKKISAADYTCPQWFTESQKKLISRILDPNPRKRITLPEILEDEWFQIDYVPSSGYECDEKIFLDDVNAAFDADEVNASETETPKSSSFINAFQLIAMSHDLDLSGLFEEQASLQIRIWLYFLQTSFEDRKQKTRLGSKHTVNETIRKIEAAAMDMSLSVERMNNFKMKMHQKPNMKRYTRSYYDLSAEVIEVAPMNCVVEISKSVGETRLYKEFCKSLSSLLTKISDVSLQKEGSEKSSNNRSTQEIRSCEEQNEKVTNGLQGYSSS

SEQ ID NO: 1635 - DNA, 1329 bp, Populus balsamifera subsp. trichocarpa
  misc_feature (1)..(1329): Ceres ANNOT ID no. 1482547
  misc_feature 180961:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
atggcatacggaaataaacttggtaagtaccaggtaggtcgaacaatcggagagggaacatttgcaaaggttaagcttgctgtagacaccaccaatggccatcaggttgcgatcaagatcatggataagaacatggtcatgcaaagcggtctcaagaatcaggtacaaagggagataagaactatgaaactcctccatcaccctaacatcgtacggatacatgaggttatcggatcaaagacaaagatttatatggtaatggaatatatctcaggaggacaacttgcagacaagctggtaaggattatccaagtagcagcatctgcaattcctagatcgtatgccaagaaactaaatgaatcagaagcaagaaaaatgtttcatcaattgatagacgcagtggactattgccataccagaggagtttatcacagagatttaaagccagaaaacttacttctggacagcaaaggaaatctgaaagtctccgacttcggactaagtgcatttcacaagcctgctagcatgctaacaacagcctgtgggtctccatgctatgtagcaccagagcttattgcaaataagggttatgaaggagcagctgcagatgtttggtcctgtgggataatccttttcgaactactgtcaggatatctaccatttgacgaacgtaacctcataatgttatataagaagatatctacagctgaatacacctgtccactgtggtttacaaaaagtcagaggaagctaatatcaagaatattagatccaaatcccagaaagagaataacaataccagagatcattgaagatgaatggtttcggatagattacgtgccttcttgtggatatgaaagcgacgagaaaatcttcctggatgatgttaatgctgcttttgatgcagatgaggaagacaagaagcagaaaaccaggctagggtctgaacattcagttcatgagacaataaggaaaattgaagttgctgcaatggatgcgagtctgtcagtcgaaaggacgaaaaattccaagatgaaaatgaatcaaaaactaaagatgaaaagatgtagcagatcatattatgacctatcagcagaggtgattgaggttgctcccatgaattgcgttgtagaaatatcaaaatcagtaggggatctaagattgtacaaagagactgctatccaactcacaggaaagttttcaaactatgcagctgtgaggagcaaattgaaaaggagaccaatgaccttcaaggctattccacttcatgatgattaccttaacctgcatttgaccaggaattcaatggttcatgaagaaccttcataa

SEQ ID NO: 1636 - protein, 442 aa, Populus balsamifera subsp. trichocarpa
  misc_feature (1)..(442): Ceres ANNOT ID no. 1482547
  misc_feature (10)..(275): Pfam Name: Pkinase Pfam Description: Protein kinase domain
  misc_feature (300)..(339): Pfam Name: NAF Pfam Description: NAF domain
  misc_feature: SWISSPROT Homolog: CIPK1_ARATH CBL-interacting serine/threonine-protein kinase 1 chloroplast precursor with e-value of 5.1e-95 and BLAST sequence identity of 45.9
  misc_feature: SWISSPROT Homolog: CIPK1_ARATH EC 2.7.11.1 SOS2-like protein kinase PKS13 SNF1-related kinase 3.16
  misc_feature: SWISSPROT Homolog: CIPK1_ORYSA CIPK-like protein 1 chloroplast precursor (EC 2.7.11.1) (OsCK1) with e-value of 1.8e-92 and BLAST sequence identity of 45.2
  misc_feature: SWISSPROT Homolog: CPK24_ARATH CBL-interacting serine/threonine-protein kinase 24 chloroplast precursor with e-value of 3.3e-91 and BLAST sequence identity of 44.1
  misc_feature: SWISSPROT Homolog: CPK24_ARATH EC 2.7.11.1 SNF1-related kinase 3.11 SALT OVERLY SENSITIVE 2 protein
  misc_feature: SWISSPROT Homolog: CPK15_ARATH CBL-interacting serine/threonine-protein kinase 15 with e-value of 5.4e-84 and BLAST sequence identity of 45.2
  misc_feature: SWISSPROT Homolog: CPK15_ARATH EC 2.7.11.1 (Serine/threonine-protein kinase ATPK10) SOS2-like protein kinase PKS3 SOS-interacting protein 2 (SNF1-related kinase 3.1)
  misc_feature: SWISSPROT Homolog: SSRA_RAT TRAP-alpha Signal sequence receptor alpha subunit (SSR-alpha) Liver regeneration-related protein LRRG137
  misc_feature: SWISSPROT Homolog: CPK11_ARATH CBL-interacting serine/threonine-protein kinase 11 transduction-associated protein 3 with e-value of 1.8e-76 and BLAST sequence identity of 45.6
  misc_feature: SWISSPROT Homolog: CPK11_ARATH EC 2.7.11.1 (SOS2-like protein kinase PKS5) SOS-interacting protein 4 SNF1-related kinase 3.22
  misc_feature 181155:<222: Transcription Factor
  misc_feature: Phenotype: FLOWER - Reduced fertility Useful for sterility, genetic confinement systems
  misc_feature: Phenotype: FLOWER - Sterile Useful for sterility, genetic confinement systems
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature (1)..(442): Functional Homolog of  Ceres CLONE ID no. 37398 at SEQ ID NO. 1674 with e-value of 5.00E-119 and BLAST sequence identity of 68.5
MAYGNKLGKYQVGRTIGEGTFAKVKLAVDTTNGHQVAIKIMDKNMVMQSGLKNQVQREIRTMKLLHHPNIVRIHEVIGSKTKIYMVMEYISGGQLADKLVRIIQVAASAIPRSYAKKLNESEARKMFHQLIDAVDYCHTRGVYHRDLKPENLLLDSKGNLKVSDFGLSAFHKPASMLTTACGSPCYVAPELIANKGYEGAAADVWSCGIILFELLSGYLPFDERNLIMLYKKISTAEYTCPLWFTKSQRKLISRILDPNPRKRITIPEIIEDEWFRIDYVPSCGYESDEKIFLDDVNAAFDADEEDKKQKTRLGSEHSVHETIRKIEVAAMDASLSVERTKNSKMKMNQKLKMKRCSRSYYDLSAEVIEVAPMNCVVEISKSVGDLRLYKETAIQLTGKFSNYAAVRSKLKRRPMTFKAIPLHDDYLNLHLTRNSMVHEEPS

SEQ ID NO: 1637 - protein, 386 aa, Arabidopsis thaliana
  misc_feature (1)..(386): Ceres CLONE ID no. 37493
  misc_feature (48)..(386): Pfam Name: Methyltransf_7 Pfam Description: SAM dependent carboxyl methyltransferase
  misc_feature: Phenotype: ROSETTE LEAVES - Cup-shaped Useful for making ornamental plants with altered leaf shape
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MGSKGDNVAVCNMKLERLLSMKGGKGQDSYANNSQAQAMHARSMLHLLEETLENVHLNSSASPPPFTTVDLGCSSGANTVHIIDFIVKHISKRFDAAGIDPPEFTAFFSDLPSNDFNTLFQLLPPLVSNTCMEECLAADGNRSYFVAGVPGSFYRRLFPARTIDFFHSAFSLHWLSQVPESVTDRRSAAYNRGRVFIHGAGEKTTTAYKRQFQADLAEFLRARAAEVKRGGAMFLVCLGRTSVDPTDQGGAGLLFGTHFQDAWDDLVREGLVAAEKRDGFNIPVYAPSLQDFKEVVDANGSFAIDKLVVYKGGSPLVVNEPDDASEVGRAFASSCRSVAGVLVEAHIGEELSNKLFSRVESRATSHAKDVLVNLQFFHIVASLSFT

SEQ ID NO: 1638 - DNA, 1158 bp, Populus balsamifera subsp. trichocarpa
  misc_feature (1)..(1158): Ceres ANNOT ID no. 1494370
  misc_feature 181473:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggctcctaaaggtgacaatgttgttgtgtctagtatgaagcttgagaagttgctttgcatgaagggaggcaaaggagaggcaagctatgccaataactctcaagctcaggccttacatgctcgatccatgcttcaccttctggaagaaaccctagatagggtgcacctaaactccccagaattccctttccaggtggcggacttagggtgctcatctggcaacaacaccatccacatcattgatgtcatcatcaagcatatgatcaagcgattcgagtcatccggactcgagccgccggagttctctgcttttttcgccgatctccctagcaatgacttcaacacccttttccagctcctccctcccccggccaattatgggggtagtatggaagagtgcctagctgctagtggccatcgaaactattttgcagctggagttcccggctcctttcaccggaggctttttccggcaagatcaattgacgttttccactcggcattttccttgcactggctctctcaggtgccggagtgtgttctagataagagatcagcagcatataacaaggggagggtgtttatccacaatgcaagcgagtccacaacaaatgcatacaagaaacagttccaaacagacctcgccggcttcctaagtgcaagatctcaagaaatgaagagcggtgggtccatgtttcttgtctgcttgggcagaacttctgccgaccccacagaccaaggtggggctggcctcctcttcgggacccactttcaggatgcctgggatgatcttgtccaggagggtctgattactagcgagaagcgtgacaatttcaacattccagtgtatgcaccaagcctccaagacttcaaggaagtagtggaagccaatggctcatttaccatagacaagctcgaggttttcaaaggagggagccctctggtggttaaccatcctgacaacgaagctgaggtcagccgggccatggctaattcctgccggagtgtggccggggtccttgttgatgcccacattggtgatgggctaagcgaggagttgttcttacgggtggagcaccgagccaaaagccatgcgaaagagcttctagagaagctgcaattcttccatatagttgcatctctttcttttgcttga

SEQ ID NO: 1639 - protein, 385 aa, Populus balsamifera subsp. trichocarpa
  misc_feature (1)..(385): Ceres ANNOT ID no. 1494370
  misc_feature (48)..(385): Pfam Name: Methyltransf_7 Pfam Description: SAM dependent carboxyl methyltransferase
  misc_feature: SWISSPROT Homolog: JMT_ARATH Jasmonate O-methyltransferase (EC 2.1.1.141) (S-adenosyl-L-methionine:jasmonic acid carboxyl methyltransferase) with e-value of 8.1e-49 and BLAST sequence identity of 36.4
  misc_feature: SWISSPROT Homolog: BAMT_ANTMA Benzoate carboxyl methyltransferase (EC 2.1.1.-) (S-adenosyl-L-methionine:benzoic acid carboxyl methyltransferase) with e-value of 2.2e-48 and BLAST sequence identity of 33.5
  misc_feature: SWISSPROT Homolog: JMT_BRARP Jasmonate O-methyltransferase with e-value of 5.9e-46 and BLAST sequence identity of 34.8
  misc_feature: SWISSPROT Homolog: JMT_BRARP EC 2.1.1.141 (S-adenosyl-L-methionine: jasmonic acid carboxyl methyltransferase) Floral nectary-specific protein 1
  misc_feature 181646:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(385): Functional Homolog of  Ceres CLONE ID no. 37493 at SEQ ID NO. 1681 with e-value of 1.29E-157 and BLAST sequence identity of 76.5
MAPKGDNVVVSSMKLEKLLCMKGGKGEASYANNSQAQALHARSMLHLLEETLDRVHLNSPEFPFQVADLGCSSGNNTIHIIDVIIKHMIKRFESSGLEPPEFSAFFADLPSNDFNTLFQLLPPPANYGGSMEECLAASGHRNYFAAGVPGSFHRRLFPARSIDVFHSAFSLHWLSQVPECVLDKRSAAYNKGRVFIHNASESTTNAYKKQFQTDLAGFLSARSQEMKSGGSMFLVCLGRTSADPTDQGGAGLLFGTHFQDAWDDLVQEGLITSEKRDNFNIPVYAPSLQDFKEVVEANGSFTIDKLEVFKGGSPLVVNHPDNEAEVSRAMANSCRSVAGVLVDAHIGDGLSEELFLRVEHRAKSHAKELLEKLQFFHIVASLSFA

SEQ ID NO: 1640 - DNA, 1260 bp, Populus balsamifera subsp. trichocarpa
  misc_feature (1)..(1260): Ceres ANNOT ID no. 1441478
  misc_feature 181824:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggctcctaaaggtgacaatgttgttgtgtctagtatgaagcttgagaagttgctttgcatgaagggaggcaaaggagaggcaagctatgccaataactctcaagctcaggccttacatgctcgatccatgcttcaccttctggaagaaaccctagatagggtgcacctaaactccccagaattccctttccaggtggcggacttagggtgctcatctggcaacaacaccatccacatcattgatgtcatcatcaagcatatgatcaagcgattcgagtcatccggactcgagccgccggagttctctgcttttttcgccgatctccctagcaatgacttcaacacccttttccagctcctccctcccccggccaattatgggggtagtatggaagagtgcctagctgctagtggccatcgaaactattttgcagctggagttcccggctcctttcaccggaggctttttccggcaagatcaattgacgttttccactcggcattttccttgcactggctctctcagatggtcaaaagtaacgactccatggttattatcatcctaacaagtgttgaaagaaagtgtatgaaatcttgggtgccggagtgtgttctagataagagatcagcagcatataacaaggggagggtgtttatccacaatgcaagcgagtccacaacaaatgcatacaagaaacagttccaaacagacctcgccggcttcctaagtgcaagatctcaagaaatgaagagcggtgggtccatgtttcttgtctgcttgggcagaacttctgccgaccccacagaccaaggtggggctggcctcctcttcgggacccactttcaggatgcctgggatgatcttgtccaggagcttgtgccgaatacagaggcttgcttactgggtctgattactagcgagaagcgtgacaatttcaacattccagtgtatgcaccaagcctccaagacttcaaggaagtagtggaagccaatggctcatttaccatagacaagctcgaggttttcaaaggagggagccctctggtggttaaccatcctgacaacgaagctgaggtcagccgggccatggctaattcctgccggagtgtggccggggtccttgttgatgcccacattggtgatgggctaagcgaggagttgttcttacgggtggagcaccgagccaaaagccatgcgaaagagcttctagagaagctgcaattcttccatatagttgcatctctttcttttgcttga

SEQ ID NO: 1641 - protein, 419 aa, Populus balsamifera subsp. trichocarpa
  misc_feature (1)..(419): Ceres ANNOT ID no. 1441478
  misc_feature (48)..(419): Pfam Name: Methyltransf_7 Pfam Description: SAM dependent carboxyl methyltransferase
  misc_feature: SWISSPROT Homolog: JMT_ARATH Jasmonate O-methyltransferase (EC 2.1.1.141) (S-adenosyl-L-methionine:jasmonic acid carboxyl methyltransferase) with e-value of 8.1e-49 and BLAST sequence identity of 36.4
  misc_feature: SWISSPROT Homolog: BAMT_ANTMA Benzoate carboxyl methyltransferase (EC 2.1.1.-) (S-adenosyl-L-methionine:benzoic acid carboxyl methyltransferase) with e-value of 2.2e-48 and BLAST sequence identity of 33.5
  misc_feature: SWISSPROT Homolog: JMT_BRARP Jasmonate O-methyltransferase with e-value of 5.9e-46 and BLAST sequence identity of 34.8
  misc_feature: SWISSPROT Homolog: JMT_BRARP EC 2.1.1.141 (S-adenosyl-L-methionine: jasmonic acid carboxyl methyltransferase) Floral nectary-specific protein 1
  misc_feature 182001:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(419): Functional Homolog of  Ceres CLONE ID no. 37493 at SEQ ID NO. 1681 with e-value of 6.50E-149 and BLAST sequence identity of 76.5
MAPKGDNVVVSSMKLEKLLCMKGGKGEASYANNSQAQALHARSMLHLLEETLDRVHLNSPEFPFQVADLGCSSGNNTIHIIDVIIKHMIKRFESSGLEPPEFSAFFADLPSNDFNTLFQLLPPPANYGGSMEECLAASGHRNYFAAGVPGSFHRRLFPARSIDVFHSAFSLHWLSQMVKSNDSMVIIILTSVERKCMKSWVPECVLDKRSAAYNKGRVFIHNASESTTNAYKKQFQTDLAGFLSARSQEMKSGGSMFLVCLGRTSADPTDQGGAGLLFGTHFQDAWDDLVQELVPNTEACLLGLITSEKRDNFNIPVYAPSLQDFKEVVEANGSFTIDKLEVFKGGSPLVVNHPDNEAEVSRAMANSCRSVAGVLVDAHIGDGLSEELFLRVEHRAKSHAKELLEKLQFFHIVASLSFA

SEQ ID NO: 1642 - protein, 151 aa, Arabidopsis thaliana
  misc_feature (1)..(151): Ceres CLONE ID no. 37543
  misc_feature (32)..(77): Pfam Name: F-box Pfam Description: F-box domain
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
MKLSTTDSDLAGDAHNETNKKMKSTEEEEIGFSNLDENLVYEVLKHVDAKTLAMSSCVSKIWHKTAQDERLWELICTRHWTNIGCGQNQLRSVVLALGGFRRLHSLYLWPLSKPNPRARFGKDELKLTLSLLSIRYYEKMSFTKRPLPESK

SEQ ID NO: 1643 - DNA, 552 bp, Populus balsamifera subsp. trichocarpa
  misc_feature (1)..(552): Ceres ANNOT ID no. 1539972
  misc_feature 182264:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atgaagcgcccactagacaccggacccgaaatccacaacaaaaccgacatgaaaatgaagaagaaaaggcaccaagaagaaggagaaatcaaggaagaaatagaatccgaaaccaatacaggaactgggtttatgaatttagacgagaacttacttttcgaggtgttgaagcatgtagacgcgaggactttagggagggcatcctgtgtgagcaagcagtggcacaggacagtacaggacgagaggttatgggagctgatctgtaccaagcactgggctaatattggctgtggtaatcaacaactgagatctgttgttttagctcttggtgggtttcgtcgacttcactctcagtatctctggcccctgtcaaaaccacactcaactcctgcaccctcttcttcctcttctccttccgcctggaacccgttcccgaagatgattgggaacaagccaccggctaggtggggcaaggatgaggtgcatctgtctctgtctttgctttcaattcggtattatgagaagatgaattttagtaacagaggaaggtga

SEQ ID NO: 1644 - protein, 183 aa, Populus balsamifera subsp. trichocarpa
  misc_feature (1)..(183): Ceres ANNOT ID no. 1539972
  misc_feature (44)..(89): Pfam Name: F-box Pfam Description: F-box domain
  misc_feature: SWISSPROT Homolog: GID2_ARATH F-box protein GID2 (Protein SLEEPY1) with e-value of 8.3e-79 and BLAST sequence identity of 99.3
  misc_feature: SWISSPROT Homolog: GID2_ORYSA F-box protein GID2 (Gibberellin-insensitive dwarf protein 2) (Protein GIBBERELLIN INSENSITIVE DWARF2) with e-value of 2.4e-26 and BLAST sequence identity of 44.3
  misc_feature: SWISSPROT Homolog: SNE_ARATH F-box protein SNE (Protein SNEEZY) (Sleepy protein 2) with e-value of 1.1e-14 and BLAST sequence identity of 30.6
  misc_feature 182360:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(183): Functional Homolog of  Ceres CLONE ID no. 37543 at SEQ ID NO. 1686 with e-value of 6.69E-44 and BLAST sequence identity of 74.4
MKRPLDTGPEIHNKTDMKMKKKRHQEEGEIKEEIESETNTGTGFMNLDENLLFEVLKHVDARTLGRASCVSKQWHRTVQDERLWELICTKHWANIGCGNQQLRSVVLALGGFRRLHSQYLWPLSKPHSTPAPSSSSSPSAWNPFPKMIGNKPPARWGKDEVHLSLSLLSIRYYEKMNFSNRGR

SEQ ID NO: 1645 - DNA, 597 bp, Populus balsamifera subsp. trichocarpa
  misc_feature (1)..(597): Ceres ANNOT ID no. 1486562
  misc_feature 182450:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atgaagcgcccactagacaccggacccgaaatccacaacaaaaccgacatgaaaatgaagaagaaaaggcaccaagaagaaggagaaatcaaggaagaaatagaatccgaaaccaatacaggaactgggtttatgaatttagacgagaacttacttttcgaggtgttgaagcatgtagacgcgaggactttagggagggcatcctgtgtgagcaagcagtggcacaggacagtacaggacgagaggttatgggagctgatctgtaccaagcactgggctaatattggctgtggtaatcaacaactgagatctgttgttttagctcttggtgggtttcgtcgacttcactctcagtatctctggcccctgtcaaaaccacactcaactcctgcaccctcttcttcctcttctccttccgcctggaacccgttcccgaagatgattgggaacaagccaccggctaggtggggcaaggatgaggtgcatctgtctctgtctttgctttcaattcggtattatgagaagatgaattttagtaacagaggaagatttaatgtttatgtccaaatgaggggtagtgggaggattacgccttaa

SEQ ID NO: 1646 - protein, 198 aa, Populus balsamifera subsp. trichocarpa
  misc_feature (1)..(198): Ceres ANNOT ID no. 1486562
  misc_feature (44)..(89): Pfam Name: F-box Pfam Description: F-box domain
  misc_feature: SWISSPROT Homolog: GID2_ARATH F-box protein GID2 (Protein SLEEPY1) with e-value of 8.3e-79 and BLAST sequence identity of 99.3
  misc_feature: SWISSPROT Homolog: GID2_ORYSA F-box protein GID2 (Gibberellin-insensitive dwarf protein 2) (Protein GIBBERELLIN INSENSITIVE DWARF2) with e-value of 2.4e-26 and BLAST sequence identity of 44.3
  misc_feature: SWISSPROT Homolog: SNE_ARATH F-box protein SNE (Protein SNEEZY) (Sleepy protein 2) with e-value of 1.1e-14 and BLAST sequence identity of 30.6
  misc_feature 182546:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(198): Functional Homolog of  Ceres CLONE ID no. 37543 at SEQ ID NO. 1686 with e-value of 6.69E-44 and BLAST sequence identity of 74.4
MKRPLDTGPEIHNKTDMKMKKKRHQEEGEIKEEIESETNTGTGFMNLDENLLFEVLKHVDARTLGRASCVSKQWHRTVQDERLWELICTKHWANIGCGNQQLRSVVLALGGFRRLHSQYLWPLSKPHSTPAPSSSSSPSAWNPFPKMIGNKPPARWGKDEVHLSLSLLSIRYYEKMNFSNRGRFNVYVQMRGSGRITP

SEQ ID NO: 1647 - DNA, 549 bp, Populus balsamifera subsp. trichocarpa
  misc_feature (1)..(549): Ceres ANNOT ID no. 1496735
  misc_feature 182639:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atgaagcgcccactcgacaccgatcccggaaaccaaaacaaaattgacataaaaatgaagaagaagaggtaccaagaagacgaaaacaaggaagaaatagaatctgcggtcaatacaggatctgggtttatgaatttagacgagaatttactttttgaggtgttgaagcacgtggacgcgaggactttgggtagtgcagcgtgtgtgagcaagcagtggcaccggacagtacaggatgagaggttatgggagctggtctgtacaaaacactggggtaacatgggctgtggtaatcaacaaatgagatctgttgttttagctcttggtgggtttcgtcgacttcactcccagtacctctggcctctatcaaagccacagtcaaattccgcaggctctgcttcaacttcttcttctgcctggaatccgttctcgcctatgattggaaataagccaccggctaggtgggggaaggatgaggtgcatctgtctttgtccttgctttcaattcggtattatgagaagatgaattttagcaacagagggagatga

SEQ ID NO: 1648 - protein, 164 aa, Populus balsamifera subsp. trichocarpa
  misc_feature (1)..(164): Ceres ANNOT ID no. 1496735
  misc_feature (25)..(70): Pfam Name: F-box Pfam Description: F-box domain
  misc_feature: SWISSPROT Homolog: GID2_ARATH F-box protein GID2 (Protein SLEEPY1) with e-value of 8.3e-79 and BLAST sequence identity of 99.3
  misc_feature: SWISSPROT Homolog: GID2_ORYSA F-box protein GID2 (Gibberellin-insensitive dwarf protein 2) (Protein GIBBERELLIN INSENSITIVE DWARF2) with e-value of 2.4e-26 and BLAST sequence identity of 44.3
  misc_feature: SWISSPROT Homolog: SNE_ARATH F-box protein SNE (Protein SNEEZY) (Sleepy protein 2) with e-value of 1.1e-14 and BLAST sequence identity of 30.6
  misc_feature 182735:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(164): Functional Homolog of  Ceres CLONE ID no. 37543 at SEQ ID NO. 1686 with e-value of 3.29E-42 and BLAST sequence identity of 68.4
MKKKRYQEDENKEEIESAVNTGSGFMNLDENLLFEVLKHVDARTLGSAACVSKQWHRTVQDERLWELVCTKHWGNMGCGNQQMRSVVLALGGFRRLHSQYLWPLSKPQSNSAGSASTSSSAWNPFSPMIGNKPPARWGKDEVHLSLSLLSIRYYEKMNFSNRGR

SEQ ID NO: 1649 - DNA, 537 bp, Populus balsamifera subsp. trichocarpa
  misc_feature (1)..(537): Ceres ANNOT ID no. 1443794
  misc_feature 182822:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atgaagaagaagaggtaccaagaagacgaaaacaaggaagaaatagaatctgcggtcaatacaggatctgggtttatgaatttagacgagaatttactttttgaggtgttgaagcacgtggacgcgaggactttgggtagtgcagcgtgtgtgagcaagcagtggcaccggacagtacaggatgagaggttatgggagctggtctgtacaaaacactggggtaacatgggctgtggtaatcaacaaatgagatctgttgttttagctcttggtgggtttcgtcgacttcactcccagtacctctggcctctatcaaagccacagtcaaattccgcaggctctgcttcaacttcttcttctgcctggaatccgttctcgcctatgattggaaataagccaccggctaggtgggggaaggatgaggtgcatctgtctttgtccttgctttcaattcgtaaaggggtggttaaggaagggttttcattgcaggaacaggcttcaacagaaagggccaaaatgggtagggcacagttgtaa

SEQ ID NO: 1650 - protein, 178 aa, Populus balsamifera subsp. trichocarpa
  misc_feature (1)..(178): Ceres ANNOT ID no. 1443794
  misc_feature (25)..(70): Pfam Name: F-box Pfam Description: F-box domain
  misc_feature: SWISSPROT Homolog: GID2_ARATH F-box protein GID2 (Protein SLEEPY1) with e-value of 8.3e-79 and BLAST sequence identity of 99.3
  misc_feature: SWISSPROT Homolog: GID2_ORYSA F-box protein GID2 (Gibberellin-insensitive dwarf protein 2) (Protein GIBBERELLIN INSENSITIVE DWARF2) with e-value of 2.4e-26 and BLAST sequence identity of 44.3
  misc_feature: SWISSPROT Homolog: SNE_ARATH F-box protein SNE (Protein SNEEZY) (Sleepy protein 2) with e-value of 1.1e-14 and BLAST sequence identity of 30.6
  misc_feature 182916:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(178): Functional Homolog of  Ceres CLONE ID no. 37543 at SEQ ID NO. 1686 with e-value of 9.39E-38 and BLAST sequence identity of 68.3
MKKKRYQEDENKEEIESAVNTGSGFMNLDENLLFEVLKHVDARTLGSAACVSKQWHRTVQDERLWELVCTKHWGNMGCGNQQMRSVVLALGGFRRLHSQYLWPLSKPQSNSAGSASTSSSAWNPFSPMIGNKPPARWGKDEVHLSLSLLSIRKGVVKEGFSLQEQASTERAKMGRAQL

SEQ ID NO: 1651 - protein, 256 aa, Arabidopsis thaliana
  misc_feature (1)..(256): Ceres CLONE ID no. 37589
  misc_feature (70)..(157): Pfam Name: Phosducin Pfam Description: Phosducin
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MADYHFVYKDIEGASTQWDDIQRKLGNLPEKAPAFKPPAYTPAEDESSAPKDQAWFDKKTEEELEDLEDDKDLDDDRFLEEYRKKRLSELREAAKVKRYGTVTPISGSDFVREVTQASAEDWVVVCLYKDGVAECSLLLGCLDELGSRYPATKFVKIISTDCIPNYPDCNLPTLLVYHHGAIKGTHVGLKSFGRRCTPESVALLLCQSEPVLNDGKGGDDDSSREAVMAGVRRQFIERVVKDHEDNDNDDGGYNSD

SEQ ID NO: 1652 - DNA, 756 bp, Populus balsamifera subsp. trichocarpa
  misc_feature (1)..(756): Ceres ANNOT ID no. 1440727
  misc_feature 183113:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgggagattatcattttgtgtacaaggatgtagaaggagcttctacacaatgggatgatatacagagaaagcttggaaacttgccagaaaaaccacctgcttttaagccaccgcctttcactccagcttctgaccaagattctatccctaaagacaaatcctttattgattccaaaactgaagaggaacttgagttccttgaagatgatctcgatctcgatgacgaccgcttcctccaagaatacaggaagaagagattgacagaaatgagggaggctacaaagattgtgaggtttggatcagtggtgccgatatcgggttcggattttgtgagggaagtgtcgcaggcaggtccggatgtttgggttgtggtgcttttgtttaaggatgggtatgcggaatgtggtgtgcttatgaaatgtttggaagaattggcagtgaaatatccagggacaaagtttgttaagattgtgtctactgattgtataccgaattatcctgatcataatcttcctactttgttggtttataataatggtgctgtgaaagctaactatgccggattaaggagttttggacggagatgcacacctgaaggtgttgccttagttctctgccaatcagatcctgtactaaatgatggtcagggtggaactgatagatcaagagattctgtgattgaaggagttcggaggaagctcattgagaaggttgtgaaggagcatgaagatgatgatggatcatcaagtgattag

SEQ ID NO: 1653 - protein, 251 aa, Populus balsamifera subsp. trichocarpa
  misc_feature (1)..(251): Ceres ANNOT ID no. 1440727
  misc_feature (72)..(180): Pfam Name: Phosducin Pfam Description: Phosducin
  misc_feature: SWISSPROT Homolog: PDCL3_HUMAN Phosducin-like protein 3 (Viral IAP-associated factor 1) (VIAF-1) (HTPHLP) with e-value of 1.4e-35 and BLAST sequence identity of 37.9
  misc_feature: SWISSPROT Homolog: PDCL3_MOUSE Phosducin-like protein 3 (Viral IAP-associated factor 1) (VIAF-1) with e-value of 1.2e-33 and BLAST sequence identity of 36.9
  misc_feature: SWISSPROT Homolog: VIAF1_DROME Viral IAP-associated factor homolog with e-value of 1.7e-32 and BLAST sequence identity of 36.1
  misc_feature: SWISSPROT Homolog: PDCL3_BRARE Phosducin-like protein 3 (Viral IAP-associated factor 1 homolog) with e-value of 2.8e-32 and BLAST sequence identity of 37.6
  misc_feature: SWISSPROT Homolog: PHLP_MOUSE Phosducin-like protein (PHLP) with e-value of 1.5e-12 and BLAST sequence identity of 29.0
  misc_feature 183237:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(251): Functional Homolog of  Ceres CLONE ID no. 37589 at SEQ ID NO. 1695 with e-value of 9.59E-100 and BLAST sequence identity of 72.7
MGDYHFVYKDVEGASTQWDDIQRKLGNLPEKPPAFKPPPFTPASDQDSIPKDKSFIDSKTEEELEFLEDDLDLDDDRFLQEYRKKRLTEMREATKIVRFGSVVPISGSDFVREVSQAGPDVWVVVLLFKDGYAECGVLMKCLEELAVKYPGTKFVKIVSTDCIPNYPDHNLPTLLVYNNGAVKANYAGLRSFGRRCTPEGVALVLCQSDPVLNDGQGGTDRSRDSVIEGVRRKLIEKVVKEHEDDDGSSSD

SEQ ID NO: 1654 - protein, 428 aa, Arabidopsis thaliana
  misc_feature (1)..(428): Ceres CLONE ID no. 37658
  misc_feature (89)..(393): Pfam Name: E1_dh Pfam Description: Dehydrogenase E1 component
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
MATAFAPTKLTATVPLHGSHENRLLLPIRLAPPSSFLGSTRSLSLRRLNHSNATRRSPVVSVQEVVKEKQSTNNTSLLITKEEGLDLYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 1655 - DNA, 1329 bp, Populus balsamifera subsp. trichocarpa
  misc_feature (1)..(1329): Ceres ANNOT ID no. 1497485
  misc_feature 183483:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
atggcatcagcttcagctttctctgctaccaaattcacccagccgttttctctcaacggcactacctccagatctcatgaaaagcaccaatctttctttgatcctcttaggactgccccttcttcttcctctttccttggatccacccgcaaacttcgccttagttctgcttccaaatccaagcttgtggccaatcccaaccgacgatcggctgttgtcgctgtctctgatgttgtcaaggaaaagaaggtcaaatctaccaccaatctgttgatcactaaagaagaaggattggaggtatatgaagatatgatattgggcagagctttcgaggacatgtgtgcccagatgtattatagaggcaaaatgtttggttttgttcatctttacaatggtcaagaggctgtctcaactgggttcatcaagcttttgaagcgggaggattctgttgtcagtacttatcgtgatcatgtacatgctttaagtaagggggtcccagctcgtgctgtcatgagcgagctctttggcaagactactgggtgttgccggggccaaggtggatctatgcacatgttctcgaaagagcacaacttgattggtgggtttgcttttattggagagggaattccagtggctactggtgcagcattttccagcaagtataggagggaggttttgaaggaggcggattgtgatcatgtgacattggccttttttggtgatggtacttgtaacaatgggcagttctttgagtgtttgaacatggcagcattgtggaaattgcccatcgtgtttgttgttgagaataacttgtgggctattgggatgtcacacgtgagggcaacttcggatccagagatttggaagaagggtccagcatttgggatgccaggtgttcatgttgatggaatggatgttttgaaggtgagggaggtggccaaggaggcaattggaagggctaggagaggagaaggaccaacattggtggaatgtgaaacttacaggtttagaggacactcattggctgatcctgatgagcttcgtgaccctgctgagaaggctcgctatgctgctagagatcccatcgcagccttgaagaagtacatgattgagaacagccttgccagtgaagcagagctaaaggctattgagaagaagatagacgaagtggttgaggaggctgttgaatttgcagatgagagccctcatccatcacgcagccagctacttgagaatgtctttgctgatccaaagggctttggaattggacctgatggccggtatagatgcgaggatccaaaattcacagaaggtacggctcgtgtctag

SEQ ID NO: 1656 - protein, 442 aa, Populus balsamifera subsp. trichocarpa
  misc_feature (1)..(442): Ceres ANNOT ID no. 1497485
  misc_feature (178)..(331): Pfam Name: TPP_enzyme_C Pfam Description: Thiamine pyrophosphate enzyme C-terminal TPP binding domain
  misc_feature: SWISSPROT Homolog: ODPA_PORPU Pyruvate dehydrogenase E1 component alpha subunit (EC 1.2.4.1) with e-value of 1.1e-117 and BLAST sequence identity of 67.2
  misc_feature: SWISSPROT Homolog: ODPA_RHIME Pyruvate dehydrogenase E1 component, alpha subunit (EC 1.2.4.1) with e-value of 4.0e-72 and BLAST sequence identity of 42.7
  misc_feature: SWISSPROT Homolog: ODPA_RICCN Pyruvate dehydrogenase E1 component, alpha subunit (EC 1.2.4.1) with e-value of 2.8e-71 and BLAST sequence identity of 40.8
  misc_feature: SWISSPROT Homolog: ODPA_RICPR Pyruvate dehydrogenase E1 component, alpha subunit (EC 1.2.4.1) with e-value of 1.2e-68 and BLAST sequence identity of 39.4
  misc_feature: SWISSPROT Homolog: ODPA_ZYMMO Pyruvate dehydrogenase E1 component, alpha subunit (EC 1.2.4.1) with e-value of 1.6e-66 and BLAST sequence identity of 43.6
  misc_feature 183629:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(442): Functional Homolog of  Ceres CLONE ID no. 37658 at SEQ ID NO. 1698 with e-value of 3.39E-191 and BLAST sequence identity of 84.7
MASASAFSATKFTQPFSLNGTTSRSHEKHQSFFDPLRTAPSSSSFLGSTRKLRLSSASKSKLVANPNRRSAVVAVSDVVKEKKVKSTTNLLITKEEGLEVYEDMILGRAFEDMCAQMYYRGKMFGFVHLYNGQEAVSTGFIKLLKREDSVVSTYRDHVHALSKGVPARAVMSELFGKTTGCCRGQGGSMHMFSKEHNLIGGFAFIGEGIPVATGAAFSSKYRREVLKEADCDHVTLAFFGDGTCNNGQFFECLNMAALWKLPIVFVVENNLWAIGMSHVRATSDPEIWKKGPAFGMPGVHVDGMDVLKVREVAKEAIGRARRGEGPTLVECETYRFRGHSLADPDELRDPAEKARYAARDPIAALKKYMIENSLASEAELKAIEKKIDEVVEEAVEFADESPHPSRSQLLENVFADPKGFGIGPDGRYRCEDPKFTEGTARV

SEQ ID NO: 1657 - protein, 342 aa, Arabidopsis thaliana
  misc_feature (1)..(342): Ceres CLONE ID no. 37663
  misc_feature (48)..(110): Pfam Name: zf-Dof Pfam Description: Dof domain, zinc finger
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: ROSETTE LEAVES - Other Useful for making ornamental plants with modified leaves
MDTAQWPQEIVVKPLEEIVTNTCPKPQPQPLQTQQPPSVGGERKARPEKDQAVNCPRCNSTNTKFCYYNNYSLTQPRYFCKGCRRYWTEGGSLRNIPVGGGSRKNKRSHSFSSDISNNHSDSTQPATKKHLSDHHHHLMSMSQQGLTGQNPKFLETTQQDLNLGFSPHGMIRTNFTDLIHNIGNNTNKSNNNNNPLIVSSCSTMATSSLDLIRNNSNNGNSSNSSFMGFPVHNEDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 1658 - DNA, 840 bp, Populus balsamifera subsp. trichocarpa
  misc_feature (1)..(840): Ceres ANNOT ID no. 1447659
  misc_feature 183910:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: ROSETTE LEAVES - Other Useful for making ornamental plants with modified leaves
atggatactgctcagtggccacaggagatagtggtgaaaccaatagaagagatagttacgaatacatgtccaaagcctcctgctttagagaggaaggcaaggcctcagaaagaacaagccctcaactgtccaaggtgcaattcaactaacaccaagttctgttactataacaactacagccttacacagcctaggtacttttgtaagacttgtagaaggtattggacagaagggggttctctgagaaatattccggtcggaggaggttcaagaaagaacaagagatcatcagcttcttcttcatcttcttcaaagaaacttcctgatctgattacaccaacaagtttgtcacaaacttctacacaaaaccctaagatccatgaaggccaagatctaaacctagctttcccatccactcaaagtattagaagtttctctgaattgattcaagtaccgagcattaatgaaaacaacaacaagaacccaatatcttcctctacttctgcatctactaccacatcccaactttcagctttggagctgttaactggaatctcctcaaggggtttgaattcttttcctatgccagttcaagatccaagcacactttacacatcaagttttcctcttcacgatttcaaaccaaccttgaatttctctttggatgggcttggaagttgttatgggagtctccaaggggttcaggaaactaatggaagacttttgtttccatttgaagatttaaagcaagtttcaagcacggctgatattgagcataataaagagcatggtgattctacaggatattggactggaatgttaggtggaggatcatggtaa

SEQ ID NO: 1659 - protein, 279 aa, Populus balsamifera subsp. trichocarpa
  misc_feature (1)..(279): Ceres ANNOT ID no. 1447659
  misc_feature (36)..(98): Pfam Name: zf-Dof Pfam Description: Dof domain, zinc finger
  misc_feature: SWISSPROT Homolog: DOF46_ARATH Dof zinc finger protein DOF4.6 (AtDOF4.6) with e-value of 1.3e-192 and BLAST sequence identity of 98.8
  misc_feature: SWISSPROT Homolog: DOF18_ARATH Dof zinc finger protein DOF1.8 (AtDOF1.8) with e-value of 6.8e-61 and BLAST sequence identity of 46.3
  misc_feature: SWISSPROT Homolog: DOF25_ARATH Dof zinc finger protein DOF2.5 (AtDOF2.5) (Dof affecting germination 2) with e-value of 4.5e-48 and BLAST sequence identity of 40.1
  misc_feature: SWISSPROT Homolog: DOF37_ARATH Dof zinc finger protein DOF3.7  (Dof affecting germination 1) (Transcription factor BBFa) (AtBBFa) (RolB domain B factor a) with e-value of 6.4e-45 and BLAST sequence identity of 81.3
  misc_feature: SWISSPROT Homolog: PBF_MAIZE Dof zinc finger protein PBF (Prolamin box-binding factor) with e-value of 2.0e-36 and BLAST sequence identity of 58.1
  misc_feature 184053:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: ROSETTE LEAVES - Other Useful for making ornamental plants with modified leaves
  misc_feature (1)..(279): Functional Homolog of  Ceres CLONE ID no. 37663 at SEQ ID NO. 1701 with e-value of 1.30E-65 and BLAST sequence identity of 63.3
MDTAQWPQEIVVKPIEEIVTNTCPKPPALERKARPQKEQALNCPRCNSTNTKFCYYNNYSLTQPRYFCKTCRRYWTEGGSLRNIPVGGGSRKNKRSSASSSSSSKKLPDLITPTSLSQTSTQNPKIHEGQDLNLAFPSTQSIRSFSELIQVPSINENNNKNPISSSTSASTTTSQLSALELLTGISSRGLNSFPMPVQDPSTLYTSSFPLHDFKPTLNFSLDGLGSCYGSLQGVQETNGRLLFPFEDLKQVSSTADIEHNKEHGDSTGYWTGMLGGGSW

SEQ ID NO: 1660 - DNA, 846 bp, Populus balsamifera subsp. trichocarpa
  misc_feature (1)..(846): Ceres ANNOT ID no. 1438478
  misc_feature 184182:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: ROSETTE LEAVES - Other Useful for making ornamental plants with modified leaves
atggatactgctcagtggccacaggagatagtggtgaaaccaatagaagagatagttgtaaatacatgctcgaagcctcctgctttggagaggaaggtaaggcctcaaaaggaacaggccctcaactgtccgaggtgcaattcaactaacaccaagttctgttactataacaactacagtcttacacaacctaggtacttttgtaagacttgtagaaggtattggacggaaggtggttctctaaggagcattcctgttggtggaggttcaagaaagaacaagagatcatcagcttcttcttcatcttcttcaaagaaacttcctgatctgatatcaccaccaactttgtcacaaacctctactgagaaccataagatccatgaaggccaagatctaaacctagctttcccatccactcaaggtattagaagtttctctgaattgatccaatttccgagcattaacgaaaacaacaacaagacccaaatatcttcctctacttcggcatccactaacacatcccaactttcagctttagagctgttaactggaatctcttcaaggggcttgaattcttttcccatgccagttcatcaagatccaagtacactttacccatctggttttcctcttcaagatttcaaaccaaccttgagtttctctctggatgggcttggaagtggttatggagatctccaaggggttcatgaaactaatggaagacttttgtttccatttgaagatttaaagcaacaagtttcaagcacagctgatattgagcaaaataaagagcatggtgattccacaggatattggactgggatgttaggtggaggatcatggtaa

SEQ ID NO: 1661 - protein, 281 aa, Populus balsamifera subsp. trichocarpa
  misc_feature (1)..(281): Ceres ANNOT ID no. 1438478
  misc_feature (36)..(98): Pfam Name: zf-Dof Pfam Description: Dof domain, zinc finger
  misc_feature: SWISSPROT Homolog: DOF46_ARATH Dof zinc finger protein DOF4.6 (AtDOF4.6) with e-value of 1.3e-192 and BLAST sequence identity of 98.8
  misc_feature: SWISSPROT Homolog: DOF18_ARATH Dof zinc finger protein DOF1.8 (AtDOF1.8) with e-value of 6.8e-61 and BLAST sequence identity of 46.3
  misc_feature: SWISSPROT Homolog: DOF25_ARATH Dof zinc finger protein DOF2.5 (AtDOF2.5) (Dof affecting germination 2) with e-value of 4.5e-48 and BLAST sequence identity of 40.1
  misc_feature: SWISSPROT Homolog: DOF37_ARATH Dof zinc finger protein DOF3.7  (Dof affecting germination 1) (Transcription factor BBFa) (AtBBFa) (RolB domain B factor a) with e-value of 6.4e-45 and BLAST sequence identity of 81.3
  misc_feature: SWISSPROT Homolog: PBF_MAIZE Dof zinc finger protein PBF (Prolamin box-binding factor) with e-value of 2.0e-36 and BLAST sequence identity of 58.1
  misc_feature 184325:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: ROSETTE LEAVES - Other Useful for making ornamental plants with modified leaves
  misc_feature (1)..(281): Functional Homolog of  Ceres CLONE ID no. 37663 at SEQ ID NO. 1701 with e-value of 1.89E-64 and BLAST sequence identity of 60.1
MDTAQWPQEIVVKPIEEIVVNTCSKPPALERKVRPQKEQALNCPRCNSTNTKFCYYNNYSLTQPRYFCKTCRRYWTEGGSLRSIPVGGGSRKNKRSSASSSSSSKKLPDLISPPTLSQTSTENHKIHEGQDLNLAFPSTQGIRSFSELIQFPSINENNNKTQISSSTSASTNTSQLSALELLTGISSRGLNSFPMPVHQDPSTLYPSGFPLQDFKPTLSFSLDGLGSGYGDLQGVHETNGRLLFPFEDLKQQVSSTADIEQNKEHGDSTGYWTGMLGGGSW

SEQ ID NO: 1662 - protein, 315 aa, Arabidopsis thaliana
  misc_feature (1)..(315): Ceres CLONE ID no. 37792
  misc_feature (1)..(315): Also Known As Ceres CDNA ID no. 23361117
  misc_feature (1)..(315): Also Known As Ceres GEMINI ID 552B11
  misc_feature (3)..(129): Pfam Name: NAM Pfam Description: No apical meristem (NAM) protein
  misc_feature 184474:<222: Transcription Factor
  misc_feature: Phenotype: Activates expression of the gene endogenous to the AtDXPR (SEQ ID NO 4143) regalutory region Useful for modulating Terpenoid Biosynthesis
MDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 1663 - DNA, 1080 bp, Populus balsamifera subsp. trichocarpa
  misc_feature (1)..(1080): Ceres ANNOT ID no. 1467441
  misc_feature 184559:<222: Transcription Factor
  misc_feature: Phenotype: Activates expression of the gene endogenous to the AtDXPR (SEQ ID NO 4143) regalutory region Useful for modulating Terpenoid Biosynthesis
atggaaaacatttctggacttggcaaggaagatgatgataagatggatttgcctcctggattccggttccatccgactgacgaagagcttatttctcactacttatacaagaaggttcttgacatcaacttctctgctagagcaatcggagatgtggacttgaacaagtctgaaccctgggaactgccatggaaggcgaagatgggagagaaagagtggtactttttctgtgttagggacagaaagtacccaacaggtctcagaacaaatagggcaactgaagctggttactggaaagccacggggaaagataaggagatctacagaggaaaatccctggttggaatgaaaaagacccttgttttctacaagggcagagcccctaaaggagagaaaaccaactgggtcatgcatgaatacagattagagggtaaattctctgcccacaatctccccaaaactgccaagaatgaatgggtgatttgcagggtgtttcaaaagagctcggctggaaagaagacctatatttcaggtctagtgagactaggttcttttggtaatgaatttagcccttatggtctgccaccattgacggattcttcaccctccaatggcaagattaagccggtggccgagtcggcctacgtgccctgcttctccaatctcagtgatgatcaaagaaaccaacaagacacaactgatagcttcaacaatcatctttttgcagtttcttcgaacccttcagaggtttttcctcgaatcccacttctgaattcattctactctccccaggctgtcgcagcatcaggaaatttgcaatatccaggttctgtttcaattcaagaccgctcagttttaaaagccttgattgagaaccaaggctcaaacatgaagcagcaaagttccaagcttgaaagggacatggccagtgtctcacaagatagcgctgcagatatgaacaatgaaatctcttctgtcatatcaaatcttgaagcgggaaaaaggtcatttgatgaacaagaggcaccaccttgtacattagtccaatcaatggaccttgattgtttctggaactattga

SEQ ID NO: 1664 - protein, 345 aa, Populus balsamifera subsp. trichocarpa
  misc_feature (1)..(345): Ceres ANNOT ID no. 1467441
  misc_feature (3)..(129): Pfam Name: NAM Pfam Description: No apical meristem (NAM) protein
  misc_feature: SWISSPROT Homolog: NAC22_ARATH NAC domain-containing protein 21/22 (ANAC021) (ANAC022) with e-value of 4.8e-51 and BLAST sequence identity of 43.9
  misc_feature: SWISSPROT Homolog: NAC77_ORYSA NAC domain-containing protein 77 (ONAC077) (ONAC300) with e-value of 1.3e-50 and BLAST sequence identity of 65.3
  misc_feature: SWISSPROT Homolog: NAC48_ORYSA NAC domain-containing protein 48 (ONAC048) with e-value of 3.5e-48 and BLAST sequence identity of 47.8
  misc_feature: SWISSPROT Homolog: NAC19_ARATH NAC domain-containing protein 19 (ANAC019) (ANAC) (Abscicic-acid-responsive NAC) with e-value of 2.2e-46 and BLAST sequence identity of 44.3
  misc_feature: SWISSPROT Homolog: NAC78_ARATH NAC domain-containing protein 78 (ANAC078) with e-value of 1.2e-45 and BLAST sequence identity of 55.0
  misc_feature 184668:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(345): Functional Homolog of  Ceres CLONE ID no. 37792 at SEQ ID NO. 1706 with e-value of 1.30E-102 and BLAST sequence identity of 67.1
MDLPPGFRFHPTDEELISHYLYKKVLDINFSARAIGDVDLNKSEPWELPWKAKMGEKEWYFFCVRDRKYPTGLRTNRATEAGYWKATGKDKEIYRGKSLVGMKKTLVFYKGRAPKGEKTNWVMHEYRLEGKFSAHNLPKTAKNEWVICRVFQKSSAGKKTYISGLVRLGSFGNEFSPYGLPPLTDSSPSNGKIKPVAESAYVPCFSNLSDDQRNQQDTTDSFNNHLFAVSSNPSEVFPRIPLLNSFYSPQAVAASGNLQYPGSVSIQDRSVLKALIENQGSNMKQQSSKLERDMASVSQDSAADMNNEISSVISNLEAGKRSFDEQEAPPCTLVQSMDLDCFWNY

SEQ ID NO: 1665 - DNA, 1080 bp, Populus balsamifera subsp. trichocarpa
  misc_feature (1)..(1080): Ceres ANNOT ID no. 1473092
  misc_feature 184767:<222: Transcription Factor
  misc_feature: Phenotype: Activates expression of the gene endogenous to the AtDXPR (SEQ ID NO 4143) regalutory region Useful for modulating Terpenoid Biosynthesis
atggaaaacatttctgggcttggtaaggaaggtgatgatcagatggatttgcctcctggattccggttccatccaaccgatgaagagcttatctctcactacttatacaagaaggttcttgacatcaccttctcggctaaagcaattggagatgtggatttgaacaagtctgaaccctgggaactgccatggaaagcgaagatgggagagaaagagtggtactttttctgtgtcagggacagaaagtaccctacaggtctcaggacaaatagggcaacagaagctggttactggaaagccacagggaaagacaaggagatctatagaggaaaattcctggttggaatgaaaaagacccttgtattctacaagggtagagcccctaaaggagggaaaaccaattgggtcatgcatgaatacagattagagggtaaattttctgtccataatctccccaaaactgccaagaatgaatgggtgatctgcagggtgtttcaaaagagttctgctggaaagaaaacccatatttcaggtctagtgagattaggctcgtttagtaatgaatttagcccttctggtctgccaccattgatggattcttcaccctacaattgcaagattaagccagtggccgagtcggcctacgtgccctgcttctccaatcccattaatgttcaaagaaaccaacaagacacgattgatagctttgacaatcatcttttagcattttcaacaaaccctttagaggtttttccacgaatcccacttttgaatccattctacactcctcaggctgtcccggtatcaggaaacttacaatatccaggttctgttttaatgcaagaccactcgatcttaagagccttgattgcaaaccaaggcacaaacatgaagcagcaaagtttcaagattgaaagggatatggtcggtgtctcacaagacagtactacagatatgaatactgaaatctattcagtcatatcaaatcttgaagtgggaaaaaggtcaggtgatgatcaagatgcaacaccttctacattagttgcatcaacggaccttgattctttttggaactattga

SEQ ID NO: 1666 - protein, 345 aa, Populus balsamifera subsp. trichocarpa
  misc_feature (1)..(345): Ceres ANNOT ID no. 1473092
  misc_feature (3)..(129): Pfam Name: NAM Pfam Description: No apical meristem (NAM) protein
  misc_feature: SWISSPROT Homolog: NAC22_ARATH NAC domain-containing protein 21/22 (ANAC021) (ANAC022) with e-value of 4.8e-51 and BLAST sequence identity of 43.9
  misc_feature: SWISSPROT Homolog: NAC77_ORYSA NAC domain-containing protein 77 (ONAC077) (ONAC300) with e-value of 1.3e-50 and BLAST sequence identity of 65.3
  misc_feature: SWISSPROT Homolog: NAC48_ORYSA NAC domain-containing protein 48 (ONAC048) with e-value of 3.5e-48 and BLAST sequence identity of 47.8
  misc_feature: SWISSPROT Homolog: NAC19_ARATH NAC domain-containing protein 19 (ANAC019) (ANAC) (Abscicic-acid-responsive NAC) with e-value of 2.2e-46 and BLAST sequence identity of 44.3
  misc_feature: SWISSPROT Homolog: NAC78_ARATH NAC domain-containing protein 78 (ANAC078) with e-value of 1.2e-45 and BLAST sequence identity of 55.0
  misc_feature 184876:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(345): Functional Homolog of  Ceres CLONE ID no. 37792 at SEQ ID NO. 1706 with e-value of 5.10E-101 and BLAST sequence identity of 66.5
MDLPPGFRFHPTDEELISHYLYKKVLDITFSAKAIGDVDLNKSEPWELPWKAKMGEKEWYFFCVRDRKYPTGLRTNRATEAGYWKATGKDKEIYRGKFLVGMKKTLVFYKGRAPKGGKTNWVMHEYRLEGKFSVHNLPKTAKNEWVICRVFQKSSAGKKTHISGLVRLGSFSNEFSPSGLPPLMDSSPYNCKIKPVAESAYVPCFSNPINVQRNQQDTIDSFDNHLLAFSTNPLEVFPRIPLLNPFYTPQAVPVSGNLQYPGSVLMQDHSILRALIANQGTNMKQQSFKIERDMVGVSQDSTTDMNTEIYSVISNLEVGKRSGDDQDATPSTLVASTDLDSFWNY

SEQ ID NO: 1667 - DNA, 1059 bp, Populus balsamifera subsp. trichocarpa
  misc_feature (1)..(1059): Ceres ANNOT ID no. 1476838
  misc_feature 184975:<222: Transcription Factor
  misc_feature: Phenotype: Activates expression of the gene endogenous to the AtDXPR (SEQ ID NO 4143) regalutory region Useful for modulating Terpenoid Biosynthesis
atggaaaacaattgtgtgtatagtgaggaagatgagcagatggaattgcctccgggatttagattccatccaactgatgaagagctcataactcactacctgtctcagaaggttctggacaactacttttgtgctagagctattggtgaggtcgatttaaacaagtgtgagccatgggatttgccttggagggctaaaatgggtgaaaaggaatggtatttcttctgtgttatagaccggaagtatcccaccggtttaaggacgaatagggctactgatgctggttattggaaagccacaggcaaagacaaggaaatttacagggctaaaacacttgttggcatgaagaagaccttggttttctacaaagggagagcccccaaaggagaaaaaaccaactgggttatgcatgagtatagattagaggggaaaaaccccgtctataatccccctaaaacagcaaagaatgattgggtcatctgtagaatttttgagaagagttgtggaggaaagaaaacacatatttcagggttggtgaggttaagctcgtatggaaatgaattaaagccaacaatattgcctccattgatggattcttctcaacacaataacgacaagaggactaacataggtgataagtctcacgtgacctgcttctccaatccaacggaggaccagaaaccccatgaaaccattgctgattgctttaacatttctcttagagctcctttgtcttcttcaaacatgtccccttcctcagttctgttttcaaaaccctcacctccaaactctttctattcctctcatattttaccaaacatagcaaattttcaatacccagattctgttatgatgccagaacactccatgttgaggatattgcttgaaaaccaaggacccggcatgaacctaaactcaaaacgggagctctcagaggacactggcctcagcactgatatgtcttcagtggtaaccaaccatgaattggttcatgggtcctttgaggatccatcaagttctgccggaccagttgatcttgattacctttggaattactga

SEQ ID NO: 1668 - protein, 352 aa, Populus balsamifera subsp. trichocarpa
  misc_feature (1)..(352): Ceres ANNOT ID no. 1476838
  misc_feature (16)..(142): Pfam Name: NAM Pfam Description: No apical meristem (NAM) protein
  misc_feature: SWISSPROT Homolog: NAC22_ARATH NAC domain-containing protein 21/22 (ANAC021) (ANAC022) with e-value of 4.8e-51 and BLAST sequence identity of 43.9
  misc_feature: SWISSPROT Homolog: NAC77_ORYSA NAC domain-containing protein 77 (ONAC077) (ONAC300) with e-value of 1.3e-50 and BLAST sequence identity of 65.3
  misc_feature: SWISSPROT Homolog: NAC48_ORYSA NAC domain-containing protein 48 (ONAC048) with e-value of 3.5e-48 and BLAST sequence identity of 47.8
  misc_feature: SWISSPROT Homolog: NAC19_ARATH NAC domain-containing protein 19 (ANAC019) (ANAC) (Abscicic-acid-responsive NAC) with e-value of 2.2e-46 and BLAST sequence identity of 44.3
  misc_feature: SWISSPROT Homolog: NAC78_ARATH NAC domain-containing protein 78 (ANAC078) with e-value of 1.2e-45 and BLAST sequence identity of 55.0
  misc_feature 185082:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(352): Functional Homolog of  Ceres CLONE ID no. 37792 at SEQ ID NO. 1706 with e-value of 1.09E-91 and BLAST sequence identity of 61.7
MENNCVYSEEDEQMELPPGFRFHPTDEELITHYLSQKVLDNYFCARAIGEVDLNKCEPWDLPWRAKMGEKEWYFFCVIDRKYPTGLRTNRATDAGYWKATGKDKEIYRAKTLVGMKKTLVFYKGRAPKGEKTNWVMHEYRLEGKNPVYNPPKTAKNDWVICRIFEKSCGGKKTHISGLVRLSSYGNELKPTILPPLMDSSQHNNDKRTNIGDKSHVTCFSNPTEDQKPHETIADCFNISLRAPLSSSNMSPSSVLFSKPSPPNSFYSSHILPNIANFQYPDSVMMPEHSMLRILLENQGPGMNLNSKRELSEDTGLSTDMSSVVTNHELVHGSFEDPSSSAGPVDLDYLWNY

SEQ ID NO: 1669 - protein, 431 aa, Arabidopsis thaliana
  misc_feature (1)..(431): Ceres CLONE ID no. 37952
  misc_feature (161)..(346): Pfam Name: Pec_lyase_C Pfam Description: Pectate lyase
  misc_feature: Utility: ABA Useful for making plants with enhanced tolerance to drought
  misc_feature: Phenotype: WHOLE PLANT - ABA Useful for making plants with enhanced tolerance to drought
MAVLPTWLLAMMCLLFFVGAMENTTHDNISSLPRSDETEWNQHAVTNPDEVADEVLALTEMSVRNHTERRKLGYFTCGTGNPIDDCWRCDPNWHKNRKRLADCGIGFGRNAIGGRDGRFYVVTDPRDDNPVNPRPGTLRHAVIQDRPLWIVFKRDMVIQLKQELIVNSFKTIDGRGANVHIANGGCITIQFVTNVIVHGLHIHDCKPTGNAMVRSSETHFGWRTMADGDAISIFGSSHVWIDHNSLSHCADGLVDAVMGSTAITISNNHLTHHNEVMLLGHSDSYMRDKAMQVTIAYNHFGVGLIQRMPRCRHGYFHVVNNDYTHWEMYAIGGSANPTINSQGNRYAAPKNPFAKEVTKRVDTPASHWKGWNWRSEGDLLQNGAYFTSSGAAASGSYARASSLSAKSSSLVGHITSDAGALPCRRGRQCSS

SEQ ID NO: 1670 - DNA, 1353 bp, Populus balsamifera subsp. trichocarpa
  misc_feature (1)..(1353): Ceres ANNOT ID no. 1438071
  misc_feature: Utility: ABA Useful for making plants with enhanced tolerance to drought
  misc_feature 185305:<222: Transcription Factor
  misc_feature: Phenotype: WHOLE PLANT - ABA Useful for making plants with enhanced tolerance to drought
atggcggtgtctaggaaatgggcttgtatgttttctgctgtgcttctgttgttgttcgttggtgtaatgcctactacttcaggaaccaatggtgggatctctgctcttaccaggagtgtggaaacagagaaggtacagagctcaagcaacacaactatggcggccaggtctcaagaagaggcggatgcattaaatgagaaagcagttgccgataaccctgaagaggttgtttcaatggttgagatgagcatccgcaacagtactgaaaggaggagacttggttacttctcttgtggaacaggcaatcctattgatgattgctggcgttgtgaccccaactggcagaagaaccgcaagcgccttgctgactgtggcattggttttggaagaaatgctattggtggccgtgatggtcgcttctatgttgttactgatcctagtgataatgaccctgtgaacccaaggcctggtactttgcgccatgctgtgatccaggacgctcctctatggattgtgttcaaaagggacatggtgattcaattgaagcaggaacttatcatgaacagctttaagacaattgacggccgtggggtcaatgttcacatcgctaatggagggtgcattaccatccaatttgttaccaatgtgatcattcatggattacacattcatgattgcaagcccactggcaatgctatggtgcggagctcgccttctcactacggatggaggacaatggctgatggtgatgccgtatctatttttggatcaagccacatttgggttgatcacaattcgctttctaattgcgctgatggtctggttgatgctgtcatgggttctactgccattaccgtctccaacaaccacttcacccaccataatgaggtaatgctattgggccatagtgactcttacaccagagacaagcaaatgcaagtgaccattgcgtacaaccattttggagagggactgatccagagaatgccaaggtgtagacacgggtacttccatgtggtgaacaatgattacactcactgggaaatgtatgccatcggtggcagtgcagaacccaccatcaacagccagggcaacagatataatgctccagtcaacccttttgcaaaggaggtgacaaagagggtagatacagccgcgggctattggaaaaactggaattggaggtcagagggagacctgctgctgaatggtgcttacttcactccatctggagctggagcttcgtctagctatgctcgcgcttcaagcttgggtgccaagtcttcttccatggtcggggcaatgactgctaatgctggtgctcttggctgccgcagggcccgccagtgctag

SEQ ID NO: 1671 - protein, 450 aa, Populus balsamifera subsp. trichocarpa
  misc_feature (1)..(450): Ceres ANNOT ID no. 1438071
  misc_feature (182)..(367): Pfam Name: Pec_lyase_C Pfam Description: Pectate lyase
  misc_feature: SWISSPROT Homolog: PEL1_ARATH Probable pectate lyase 1 precursor (EC 4.2.2.2) (Pectate lyase A1) with e-value of 5.2e-244 and BLAST sequence identity of 100.0
  misc_feature: SWISSPROT Homolog: PEL15_ARATH Probable pectate lyase 15 precursor (EC 4.2.2.2) (Pectate lyase A11) with e-value of 1.0e-185 and BLAST sequence identity of 82.5
  misc_feature: SWISSPROT Homolog: PEL8_ARATH Probable pectate lyase 8 precursor (EC 4.2.2.2) with e-value of 4.6e-181 and BLAST sequence identity of 77.2
  misc_feature: SWISSPROT Homolog: PEL20_ARATH Probable pectate lyase 20 precursor (EC 4.2.2.2) with e-value of 5.4e-178 and BLAST sequence identity of 74.2
  misc_feature: SWISSPROT Homolog: PEL10_ARATH Probable pectate lyase 10 precursor (EC 4.2.2.2) with e-value of 5.6e-176 and BLAST sequence identity of 71.6
  misc_feature: Utility: ABA Useful for making plants with enhanced tolerance to drought
  misc_feature 185428:<222: Transcription Factor
  misc_feature: Phenotype: WHOLE PLANT - ABA Useful for making plants with enhanced tolerance to drought
  misc_feature (1)..(450): Functional Homolog of  Ceres CLONE ID no. 37952 at SEQ ID NO. 1713 with e-value of 1.19E-193 and BLAST sequence identity of 82.5
MAVSRKWACMFSAVLLLLFVGVMPTTSGTNGGISALTRSVETEKVQSSSNTTMAARSQEEADALNEKAVADNPEEVVSMVEMSIRNSTERRRLGYFSCGTGNPIDDCWRCDPNWQKNRKRLADCGIGFGRNAIGGRDGRFYVVTDPSDNDPVNPRPGTLRHAVIQDAPLWIVFKRDMVIQLKQELIMNSFKTIDGRGVNVHIANGGCITIQFVTNVIIHGLHIHDCKPTGNAMVRSSPSHYGWRTMADGDAVSIFGSSHIWVDHNSLSNCADGLVDAVMGSTAITVSNNHFTHHNEVMLLGHSDSYTRDKQMQVTIAYNHFGEGLIQRMPRCRHGYFHVVNNDYTHWEMYAIGGSAEPTINSQGNRYNAPVNPFAKEVTKRVDTAAGYWKNWNWRSEGDLLLNGAYFTPSGAGASSSYARASSLGAKSSSMVGAMTANAGALGCRRARQC

SEQ ID NO: 1672 - DNA, 1353 bp, Populus balsamifera subsp. trichocarpa
  misc_feature (1)..(1353): Ceres ANNOT ID no. 1448019
  misc_feature: Utility: ABA Useful for making plants with enhanced tolerance to drought
  misc_feature 185554:<222: Transcription Factor
  misc_feature: Phenotype: WHOLE PLANT - ABA Useful for making plants with enhanced tolerance to drought
atggcggtgcctcagaaatgggtttgtgtgttttctgctgtgattgtattgttgttcgttggtgtcgtggctacttcaagacccgatgttgttgggatctctgctcttaccaggaatgtagaagcagagaaggaacagagctcaagcaactcaacaatggcggccaggtctcaagaagaggctgatgcatttaatgagaaagcagttgctgctgatcctgaagaggtggtttcaatggttgagatgaacatccgcaacagtactgaaaggaggaggttaggctacttctcttgtggaacaggcaatcctattgatgattgctggcgttgtgaccccaactggcacaagaaccgcaagcgccttgctgactgtggcattggttttggcagaaatgccatcggtggccgtgatggtcgcttctatgttgttactgattctagtgaccatgaccctgtgaacccaaggcctggaactttgcgccatgccgtgatccaggacgctcctctatggatcgtgttcaaaagggacatggtgattcaattgaagcaggaacttatcatgaacagctttaagaccatagatggccgtggggtcaatgttcacattgctaatggtgggtgcatcactatccaatttgttaccaatgtgatcattcatggtctacacatccatgactgcaaacccactggcaatgctatggtgcgtagctcaccatctcattacggatggaggacaatggctgatggtgatgccatctctatttttggatcaagtcacatttgggtggatcacaattccctttctaactgtgctgatggcctggttgatgctgttatgggttcgactgccatcaccgtctccaacaatcacttcacccaccataatgaggtaatgctcctgggccacagtgactcttataccagagacaagcaaatgcaagtgaccattgcgtacaaccattttggagagggactgatccagagaatgccaaggtgtagacatgggtacttccacgtggtaaacaatgactacactcactgggaaatgtatgccatcggtggcagtgcagaacccaccatcaacagccagggcaacagatataatgctccagccaacccttttgcaaaggaggtgacaaagagggtggatacagctccaggcaaatggaaaagctggaattggaggtcagaaggagacctgttggcgaatggagcttacttcactccatccggggctggagcttcagctagctatgctcgcgcttcaagcttgggtgccaagtcttcttccatggtcggagcaatgactgctaattccggtgttcttggctgccgcaggggccatcagtgctag

SEQ ID NO: 1673 - protein, 450 aa, Populus balsamifera subsp. trichocarpa
  misc_feature (1)..(450): Ceres ANNOT ID no. 1448019
  misc_feature (182)..(367): Pfam Name: Pec_lyase_C Pfam Description: Pectate lyase
  misc_feature: SWISSPROT Homolog: PEL1_ARATH Probable pectate lyase 1 precursor (EC 4.2.2.2) (Pectate lyase A1) with e-value of 5.2e-244 and BLAST sequence identity of 100.0
  misc_feature: SWISSPROT Homolog: PEL15_ARATH Probable pectate lyase 15 precursor (EC 4.2.2.2) (Pectate lyase A11) with e-value of 1.0e-185 and BLAST sequence identity of 82.5
  misc_feature: SWISSPROT Homolog: PEL8_ARATH Probable pectate lyase 8 precursor (EC 4.2.2.2) with e-value of 4.6e-181 and BLAST sequence identity of 77.2
  misc_feature: SWISSPROT Homolog: PEL20_ARATH Probable pectate lyase 20 precursor (EC 4.2.2.2) with e-value of 5.4e-178 and BLAST sequence identity of 74.2
  misc_feature: SWISSPROT Homolog: PEL10_ARATH Probable pectate lyase 10 precursor (EC 4.2.2.2) with e-value of 5.6e-176 and BLAST sequence identity of 71.6
  misc_feature: Utility: ABA Useful for making plants with enhanced tolerance to drought
  misc_feature 185677:<222: Transcription Factor
  misc_feature: Phenotype: WHOLE PLANT - ABA Useful for making plants with enhanced tolerance to drought
  misc_feature (1)..(450): Functional Homolog of  Ceres CLONE ID no. 37952 at SEQ ID NO. 1713 with e-value of 1.70E-189 and BLAST sequence identity of 80.4
MAVPQKWVCVFSAVIVLLFVGVVATSRPDVVGISALTRNVEAEKEQSSSNSTMAARSQEEADAFNEKAVAADPEEVVSMVEMNIRNSTERRRLGYFSCGTGNPIDDCWRCDPNWHKNRKRLADCGIGFGRNAIGGRDGRFYVVTDSSDHDPVNPRPGTLRHAVIQDAPLWIVFKRDMVIQLKQELIMNSFKTIDGRGVNVHIANGGCITIQFVTNVIIHGLHIHDCKPTGNAMVRSSPSHYGWRTMADGDAISIFGSSHIWVDHNSLSNCADGLVDAVMGSTAITVSNNHFTHHNEVMLLGHSDSYTRDKQMQVTIAYNHFGEGLIQRMPRCRHGYFHVVNNDYTHWEMYAIGGSAEPTINSQGNRYNAPANPFAKEVTKRVDTAPGKWKSWNWRSEGDLLANGAYFTPSGAGASASYARASSLGAKSSSMVGAMTANSGVLGCRRGHQC

SEQ ID NO: 1674 - DNA, 1329 bp, Populus balsamifera subsp. trichocarpa
  misc_feature (1)..(1329): Ceres ANNOT ID no. 1498609
  misc_feature: Utility: ABA Useful for making plants with enhanced tolerance to drought
  misc_feature 185803:<222: Transcription Factor
  misc_feature: Phenotype: WHOLE PLANT - ABA Useful for making plants with enhanced tolerance to drought
atggaggtttcgctgagaagcttttgtgtacggacaatgctggttctggttgtgcttatcagtgtaaacgctgcggaggagaaagacgagcaaaaattgaggttgaaggaaacgcaagagttgttgagctcaaagaactcgtcaatggcggactggtatgatgatgcatggaacgagcatactatggaggatccggaggaagttgcggcaatggttgacgagagcatacgcaacagcacagaaaggaggaaattgggatttttctcatgcgtaactggcaatcctattgatgattgttggcgatgtgatccccattggcaactccacagaaagcgccttgctaactgtggcattggttttggacgcaatgccgtaggtggtcgcgatggaagattctatgttgttagtaaccctggcgatgatgatcctgttaacccaaaaccagggacactacgccatgctgtcattcaagacgagcctttgtggattgtgttcaagagggacatggtgattaccctcaagcaagagctcatcatgaacagcttcaagaccatcgatgctcgtggaaccaatgttcacattgccaatggggcttgcatcaccatccagtttatcacaaatgtcataattcatggtctccacgtacatgattgtaagcctacagggaacgcaatggttcgtagctcgcctagccattatgggtggagaacaatagctgacggagatggtatttccatttttggatcaagccacatttggattgatcacaattctctttcaaactgcgctgatggcctcattgatgctataatagggtcaacagccattaccatttcgaacaactatttcactcaccataacgaggttatgctattgggccatagtgactcctaccaaagagataagcagatgcaagtgaccattgcctacaaccattttggtgagggtcttatccagaggatgccaaggtgcaggcatgggtatttccatgtagtgaacaatgactacacccactgggaaatgtatgccattggaggaagtgctgatcccaccattaacagccagggcaacagatatcttgcccctgccaacgcttttgccaaagaggtgacaaaaagggtggagacgaatgctggagtatggaagcattggaattggagatcagagggagacctgctgctaaatggagcctacttcactgcatcaggagccggagctgcagccagctatgccagggcctcaagcttaggggcaaagtcctcatcgatggtcggggacattacttcaaatgccggtgccctttcctgccgcaggggccgccgatgttaa

SEQ ID NO: 1675 - protein, 430 aa, Populus balsamifera subsp. trichocarpa
  misc_feature (1)..(430): Ceres ANNOT ID no. 1498609
  misc_feature (162)..(347): Pfam Name: Pec_lyase_C Pfam Description: Pectate lyase
  misc_feature: SWISSPROT Homolog: PEL1_ARATH Probable pectate lyase 1 precursor (EC 4.2.2.2) (Pectate lyase A1) with e-value of 5.2e-244 and BLAST sequence identity of 100.0
  misc_feature: SWISSPROT Homolog: PEL15_ARATH Probable pectate lyase 15 precursor (EC 4.2.2.2) (Pectate lyase A11) with e-value of 1.0e-185 and BLAST sequence identity of 82.5
  misc_feature: SWISSPROT Homolog: PEL8_ARATH Probable pectate lyase 8 precursor (EC 4.2.2.2) with e-value of 4.6e-181 and BLAST sequence identity of 77.2
  misc_feature: SWISSPROT Homolog: PEL20_ARATH Probable pectate lyase 20 precursor (EC 4.2.2.2) with e-value of 5.4e-178 and BLAST sequence identity of 74.2
  misc_feature: SWISSPROT Homolog: PEL10_ARATH Probable pectate lyase 10 precursor (EC 4.2.2.2) with e-value of 5.6e-176 and BLAST sequence identity of 71.6
  misc_feature: Utility: ABA Useful for making plants with enhanced tolerance to drought
  misc_feature 185926:<222: Transcription Factor
  misc_feature: Phenotype: WHOLE PLANT - ABA Useful for making plants with enhanced tolerance to drought
  misc_feature (1)..(430): Functional Homolog of  Ceres CLONE ID no. 37952 at SEQ ID NO. 1713 with e-value of 7.99E-183 and BLAST sequence identity of 80.3
MLVLVVLISVNAAEEKDEQKLRLKETQELLSSKNSSMADWYDDAWNEHTMEDPEEVAAMVDESIRNSTERRKLGFFSCVTGNPIDDCWRCDPHWQLHRKRLANCGIGFGRNAVGGRDGRFYVVSNPGDDDPVNPKPGTLRHAVIQDEPLWIVFKRDMVITLKQELIMNSFKTIDARGTNVHIANGACITIQFITNVIIHGLHVHDCKPTGNAMVRSSPSHYGWRTIADGDGISIFGSSHIWIDHNSLSNCADGLIDAIIGSTAITISNNYFTHHNEVMLLGHSDSYQRDKQMQVTIAYNHFGEGLIQRMPRCRHGYFHVVNNDYTHWEMYAIGGSADPTINSQGNRYLAPANAFAKEVTKRVETNAGVWKHWNWRSEGDLLLNGAYFTASGAGAAASYARASSLGAKSSSMVGDITSNAGALSCRRGRRC

SEQ ID NO: 1676 - DNA, 1329 bp, Populus balsamifera subsp. trichocarpa
  misc_feature (1)..(1329): Ceres ANNOT ID no. 1472308
  misc_feature: Utility: ABA Useful for making plants with enhanced tolerance to drought
  misc_feature 186046:<222: Transcription Factor
  misc_feature: Phenotype: WHOLE PLANT - ABA Useful for making plants with enhanced tolerance to drought
atggcggtttcgctaagatgcttttgtacatggacattgctggttctagttatgtttctcagtgtaaacgctgcggaagagaaagacgagctgaaattgaggttgaaggaaacgcaggagttgctaaggtcaaagaactcgtcgatggcagagtggtctgatgatgcatggaacgagcatactgtagaggattcagaggaggtggctgcaatggttgatgagagcatacgcaacagcactgaaaggaggaaattgggatttttctcatgcgtaactggcaatcctattgatgattgttggcgatgtgatccccattggcaactccacagaaagcgccttgctaactgtggcattggttttggacgcaatgctgtcggaggtcgcgatggaaaatactatgttgttagcaaccctggcgatgatgaccctgttaacccaagaccagggactctacgccatgctgtcattcaagaccagcctttgtggattgtgttcaagagggacatggtgattaccctcaagcaagagcttatcatgaacagcttcaagaccatagatgctcgtggaaccaatgtccacattgccaacggggcttgcatcaccatccagtttgtctcgaatgtcataattcatggtctccatatacatgattgtaagagtacaggcaatgcgatggttcgtagctcgcctagccattacgggtggagaactatggctgacggagatggtatctccatttttggagcaagccacatatggatcgatcacaattctctttcaaattgcgcagatggccttattgatgctataatggggtccaccgccattaccatctcgaacaactatttcactcaccataacgaggttatgctattaggccacagtgactcctataaaagagataagcagatgcaagtgaccattgcctataaccattttggtgaaggtcttatccagagaatgcccaggtgcaggcatgggtatttccacgtagtgaacaatgactacacgcactgggaaatgtatgccattggagggagtgctaatcccacgattaatagccagggcaacagatatcttgcccctgccaacgcttttgccaaagaggtgacaaaaagggtagacacggaaactggagtctggagtcattggaattggagatcagaaggcgacctcctgctaaacggagcctacttcattccatcaggagctggagctgcagccagctatgccagggcctcaagcttaggggccaagtcctcatcgatggtcggggtcatcacttcaaatgctggagccctagtctgccgcaggggccgccgatgttaa

SEQ ID NO: 1677 - protein, 442 aa, Populus balsamifera subsp. trichocarpa
  misc_feature (1)..(442): Ceres ANNOT ID no. 1472308
  misc_feature (174)..(359): Pfam Name: Pec_lyase_C Pfam Description: Pectate lyase
  misc_feature: SWISSPROT Homolog: PEL1_ARATH Probable pectate lyase 1 precursor (EC 4.2.2.2) (Pectate lyase A1) with e-value of 5.2e-244 and BLAST sequence identity of 100.0
  misc_feature: SWISSPROT Homolog: PEL15_ARATH Probable pectate lyase 15 precursor (EC 4.2.2.2) (Pectate lyase A11) with e-value of 1.0e-185 and BLAST sequence identity of 82.5
  misc_feature: SWISSPROT Homolog: PEL8_ARATH Probable pectate lyase 8 precursor (EC 4.2.2.2) with e-value of 4.6e-181 and BLAST sequence identity of 77.2
  misc_feature: SWISSPROT Homolog: PEL20_ARATH Probable pectate lyase 20 precursor (EC 4.2.2.2) with e-value of 5.4e-178 and BLAST sequence identity of 74.2
  misc_feature: SWISSPROT Homolog: PEL10_ARATH Probable pectate lyase 10 precursor (EC 4.2.2.2) with e-value of 5.6e-176 and BLAST sequence identity of 71.6
  misc_feature: Utility: ABA Useful for making plants with enhanced tolerance to drought
  misc_feature 186169:<222: Transcription Factor
  misc_feature: Phenotype: WHOLE PLANT - ABA Useful for making plants with enhanced tolerance to drought
  misc_feature (1)..(442): Functional Homolog of  Ceres CLONE ID no. 37952 at SEQ ID NO. 1713 with e-value of 6.49E-181 and BLAST sequence identity of 80.0
MAVSLRCFCTWTLLVLVMFLSVNAAEEKDELKLRLKETQELLRSKNSSMAEWSDDAWNEHTVEDSEEVAAMVDESIRNSTERRKLGFFSCVTGNPIDDCWRCDPHWQLHRKRLANCGIGFGRNAVGGRDGKYYVVSNPGDDDPVNPRPGTLRHAVIQDQPLWIVFKRDMVITLKQELIMNSFKTIDARGTNVHIANGACITIQFVSNVIIHGLHIHDCKSTGNAMVRSSPSHYGWRTMADGDGISIFGASHIWIDHNSLSNCADGLIDAIMGSTAITISNNYFTHHNEVMLLGHSDSYKRDKQMQVTIAYNHFGEGLIQRMPRCRHGYFHVVNNDYTHWEMYAIGGSANPTINSQGNRYLAPANAFAKEVTKRVDTETGVWSHWNWRSEGDLLLNGAYFIPSGAGAAASYARASSLGAKSSSMVGVITSNAGALVCRRGRRC

SEQ ID NO: 1678 - DNA, 1323 bp, Populus balsamifera subsp. trichocarpa
  misc_feature (1)..(1323): Ceres ANNOT ID no. 1525715
  misc_feature: Utility: ABA Useful for making plants with enhanced tolerance to drought
  misc_feature 186292:<222: Transcription Factor
  misc_feature: Phenotype: WHOLE PLANT - ABA Useful for making plants with enhanced tolerance to drought
atggcggtttcgctaagatgcttttgtacatggacattgctggttctagttatgtttctcagtgtaaacgctgcggaagagaaagacgagctgaaattgaggttgaaggaaacgcaggagttgctaaggtcaaagaactcgtcgatggcagagtggtctgatgatgcatggaacgagcatactgtagaggattcagaggaggtggctgcaatggttgatgagagcatacgcaacagcactgaaaggaggaaattgggatttttctcatgcgtaactggcaatcctattgatgattgttggcgatgtgatccccattggcaactccacagaaagcgccttgctaactgtggcattggttttggacgcaatgctgtcggaggtcgcgatggaaaatactatgttgttagcaaccctggcgatgatgaccctgttaacccaagaccagggactctacgccatgctgtcattcaagaccagcctttgtggattgtgttcaagagggacatggtgattaccctcaagcaagagcttatcatgaacagcttcaagaccatagatgctcgtggaaccaatgtccacattgccaacggggcttgcatcaccatccagtttgtctcgaatgtcataattcatggtctccatatacatgattgtaagagtacaggcaatgcgatggttcgtagctcgcctagccattacgggtggagaactatggctgacggagatggtatctccatttttggagcaagccacatatggatcgatcacaattctctttcaaattgcgcagatggccttattgatgctataatggggtccaccgccattaccatctcgaacaactatttcactcaccataacgaggttatgctattaggccacagtgactcctataaaagagataagcagatgcaagtgaccattgcctataaccattttggtgaaggtcttatccagagaatgcccaggcatgggtatttccacgtagtgaacaatgactacacgcactgggaaatgtatgccattggagggagtgctaatcccacgattaatagccagggcaacagatatcttgcccctgccaacgcttttgccaaagaggtgacaaaaagggtagacacggaaactggagtctggagtcattggaattggagatcagaaggcgacctcctgctaaacggagcctacttcattccatcaggagctggagctgcagccagctatgccagggcctcaagcttaggggccaagtcctcatcgatggtcggggtcatcacttcaaatgctggagccctagtctgccgcaggggccgccgatgttaa

SEQ ID NO: 1679 - protein, 440 aa, Populus balsamifera subsp. trichocarpa
  misc_feature (1)..(440): Ceres ANNOT ID no. 1525715
  misc_feature (174)..(357): Pfam Name: Pec_lyase_C Pfam Description: Pectate lyase
  misc_feature: SWISSPROT Homolog: PEL1_ARATH Probable pectate lyase 1 precursor (EC 4.2.2.2) (Pectate lyase A1) with e-value of 5.2e-244 and BLAST sequence identity of 100.0
  misc_feature: SWISSPROT Homolog: PEL15_ARATH Probable pectate lyase 15 precursor (EC 4.2.2.2) (Pectate lyase A11) with e-value of 1.0e-185 and BLAST sequence identity of 82.5
  misc_feature: SWISSPROT Homolog: PEL8_ARATH Probable pectate lyase 8 precursor (EC 4.2.2.2) with e-value of 4.6e-181 and BLAST sequence identity of 77.2
  misc_feature: SWISSPROT Homolog: PEL20_ARATH Probable pectate lyase 20 precursor (EC 4.2.2.2) with e-value of 5.4e-178 and BLAST sequence identity of 74.2
  misc_feature: SWISSPROT Homolog: PEL10_ARATH Probable pectate lyase 10 precursor (EC 4.2.2.2) with e-value of 5.6e-176 and BLAST sequence identity of 71.6
  misc_feature: Utility: ABA Useful for making plants with enhanced tolerance to drought
  misc_feature 186415:<222: Transcription Factor
  misc_feature: Phenotype: WHOLE PLANT - ABA Useful for making plants with enhanced tolerance to drought
  misc_feature (1)..(440): Functional Homolog of  Ceres CLONE ID no. 37952 at SEQ ID NO. 1713 with e-value of 2.89E-178 and BLAST sequence identity of 79.9
MAVSLRCFCTWTLLVLVMFLSVNAAEEKDELKLRLKETQELLRSKNSSMAEWSDDAWNEHTVEDSEEVAAMVDESIRNSTERRKLGFFSCVTGNPIDDCWRCDPHWQLHRKRLANCGIGFGRNAVGGRDGKYYVVSNPGDDDPVNPRPGTLRHAVIQDQPLWIVFKRDMVITLKQELIMNSFKTIDARGTNVHIANGACITIQFVSNVIIHGLHIHDCKSTGNAMVRSSPSHYGWRTMADGDGISIFGASHIWIDHNSLSNCADGLIDAIMGSTAITISNNYFTHHNEVMLLGHSDSYKRDKQMQVTIAYNHFGEGLIQRMPRHGYFHVVNNDYTHWEMYAIGGSANPTINSQGNRYLAPANAFAKEVTKRVDTETGVWSHWNWRSEGDLLLNGAYFIPSGAGAAASYARASSLGAKSSSMVGVITSNAGALVCRRGRRC

SEQ ID NO: 1680 - DNA, 1494 bp, Populus balsamifera subsp. trichocarpa
  misc_feature (1)..(1494): Ceres ANNOT ID no. 1445629
  misc_feature: Utility: ABA Useful for making plants with enhanced tolerance to drought
  misc_feature 186538:<222: Transcription Factor
  misc_feature: Phenotype: WHOLE PLANT - ABA Useful for making plants with enhanced tolerance to drought
atggaggtttcgctgagaagcttttgtgtacggacaatgctggttctggttgtgcttatcagtgtaaacgctgcggaggagaaagacgagcaaaaattgaggttgaaggaaacgcaagagttgttgagctcaaagaactcgtcaatggcggactggtatgatgatgcatggaacgagcatactatggaggatccggaggaagttgcggcaatggttgacgaaaaacttggaactcaaagcctaacccaagctaaatctcaggatggtaatagcggtttcataaatgtgatttctgattttaccaggagcatacgcaacagcacagaaaggaggaaattgggatttttctcatgcgtaactggcaatcctattgatgattgttggcgatgtgatccccattggcaactccacagaaagcgccttgctaactgtggcattggttttggacgcaatgccgtaggtggtcgcgatggaagattctatgttgttagtaaccctggcgatgatgatcctgttaacccaaaaccagggacactacgccatgctgtcattcaagacgagcctttgtggattgtgttcaagagggacatggtgattaccctcaagcaagagctcatcatgaacagcttcaagaccatcgatgctcgtggaaccaatgttcacattgccaatggggcttgcatcaccatccagtttatcacaaatgtcataattcatggtctccacgtacatgattgtaagcctacagggaacgcaatggttcgtagctcgcctagccattatgggtggagaacaatagctgacggagatggtatttccatttttggatcaagccacatttggattgatcacaattctctttcaaactgcgctgatggcctcattgatgctataatagggtcaacagccattaccatttcgaacaactatttcactcaccataacgaggttatgctattgggccatagtgactcctaccaaagagataagcagatgcaagtgaccattgcctacaaccattttggtgagggtcttatccagaggatgccaaggtgcaggcatgggtatttccatgtagtgaacaatgactacacccactgggaaatgtatgccattggaggaagtgctgatcccaccattaacagccagggcaacagatatcttgcccctgccaacgcttttgccaaagagattataacaatcatgggaaaattgatattggcaggtgacaaaaagggtggagacgaatgctggagtatggaagcattggaattggagatcagagggagacctgctgctaaatggagcctacttcactgcatcaggagccggagctgcagccagctatgccagggcctcaagcttaggggcaaagtcctcatcgatggtcggggacattacttcaaatgccggtgccctttcctgccgcaggggccgccgatgttaattctcattaatcccatcaacactaagaaacgagaaaacaaaatttga

SEQ ID NO: 1681 - protein, 497 aa, Populus balsamifera subsp. trichocarpa
  misc_feature (1)..(497): Ceres ANNOT ID no. 1445629
  misc_feature (202)..(387): Pfam Name: Pec_lyase_C Pfam Description: Pectate lyase
  misc_feature: SWISSPROT Homolog: PEL1_ARATH Probable pectate lyase 1 precursor (EC 4.2.2.2) (Pectate lyase A1) with e-value of 5.2e-244 and BLAST sequence identity of 100.0
  misc_feature: SWISSPROT Homolog: PEL15_ARATH Probable pectate lyase 15 precursor (EC 4.2.2.2) (Pectate lyase A11) with e-value of 1.0e-185 and BLAST sequence identity of 82.5
  misc_feature: SWISSPROT Homolog: PEL8_ARATH Probable pectate lyase 8 precursor (EC 4.2.2.2) with e-value of 4.6e-181 and BLAST sequence identity of 77.2
  misc_feature: SWISSPROT Homolog: PEL20_ARATH Probable pectate lyase 20 precursor (EC 4.2.2.2) with e-value of 5.4e-178 and BLAST sequence identity of 74.2
  misc_feature: SWISSPROT Homolog: PEL10_ARATH Probable pectate lyase 10 precursor (EC 4.2.2.2) with e-value of 5.6e-176 and BLAST sequence identity of 71.6
  misc_feature: Utility: ABA Useful for making plants with enhanced tolerance to drought
  misc_feature 186665:<222: Transcription Factor
  misc_feature: Phenotype: WHOLE PLANT - ABA Useful for making plants with enhanced tolerance to drought
  misc_feature (1)..(497): Functional Homolog of  Ceres CLONE ID no. 37952 at SEQ ID NO. 1713 with e-value of 5.90E-148 and BLAST sequence identity of 80.7
MEVSLRSFCVRTMLVLVVLISVNAAEEKDEQKLRLKETQELLSSKNSSMADWYDDAWNEHTMEDPEEVAAMVDEKLGTQSLTQAKSQDGNSGFINVISDFTRSIRNSTERRKLGFFSCVTGNPIDDCWRCDPHWQLHRKRLANCGIGFGRNAVGGRDGRFYVVSNPGDDDPVNPKPGTLRHAVIQDEPLWIVFKRDMVITLKQELIMNSFKTIDARGTNVHIANGACITIQFITNVIIHGLHVHDCKPTGNAMVRSSPSHYGWRTIADGDGISIFGSSHIWIDHNSLSNCADGLIDAIIGSTAITISNNYFTHHNEVMLLGHSDSYQRDKQMQVTIAYNHFGEGLIQRMPRCRHGYFHVVNNDYTHWEMYAIGGSADPTINSQGNRYLAPANAFAKEIITIMGKLILAGDKKGGDECWSMEALELEIRGRPAAKWSLLHCIRSRSCSQLCQGLKLRGKVLIDGRGHYFKCRCPFLPQGPPMLILINPINTKKRENKI

SEQ ID NO: 1682 - protein, 377 aa, Arabidopsis thaliana
  misc_feature (1)..(377): Ceres CLONE ID no. 38101
  misc_feature (8)..(377): Pfam Name: Actin Pfam Description: Actin
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 1683 - DNA, 1134 bp, Populus balsamifera subsp. trichocarpa; identical to SEQ ID NO: 158
  misc_feature (1)..(1134): Ceres ANNOT ID no. 1454656
  misc_feature 186936:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1684 - protein, 377 aa, Populus balsamifera subsp. trichocarpa; identical to SEQ ID NO: 159
  misc_feature (1)..(377): Ceres ANNOT ID no. 1454656
  misc_feature (8)..(377): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 187082:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(377): Functional Homolog of  Ceres CLONE ID no. 38101 at SEQ ID NO. 1726 with e-value of 5.59E-198 and BLAST sequence identity of 97.0

SEQ ID NO: 1685 - DNA, 1134 bp, Populus balsamifera subsp. trichocarpa; identical to SEQ ID NO: 160
  misc_feature (1)..(1134): Ceres ANNOT ID no. 1528263
  misc_feature 187229:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1686 - protein, 377 aa, Populus balsamifera subsp. trichocarpa; identical to SEQ ID NO: 159
  misc_feature (1)..(377): Ceres ANNOT ID no. 1528263
  misc_feature (8)..(377): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 187375:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(377): Functional Homolog of  Ceres CLONE ID no. 38101 at SEQ ID NO. 1726 with e-value of 5.59E-198 and BLAST sequence identity of 97.0

SEQ ID NO: 1687 - DNA, 1134 bp, Populus balsamifera subsp. trichocarpa; identical to SEQ ID NO: 164
  misc_feature (1)..(1134): Ceres ANNOT ID no. 1458103
  misc_feature 187522:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1688 - protein, 377 aa, Populus balsamifera subsp. trichocarpa; identical to SEQ ID NO: 165
  misc_feature (1)..(377): Ceres ANNOT ID no. 1458103
  misc_feature (8)..(377): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 187668:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(377): Functional Homolog of  Ceres CLONE ID no. 38101 at SEQ ID NO. 1726 with e-value of 2.40E-197 and BLAST sequence identity of 96.5

SEQ ID NO: 1689 - DNA, 1134 bp, Populus balsamifera subsp. trichocarpa; identical to SEQ ID NO: 162
  misc_feature (1)..(1134): Ceres ANNOT ID no. 1464899
  misc_feature 187815:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1690 - protein, 377 aa, Populus balsamifera subsp. trichocarpa; identical to SEQ ID NO: 163
  misc_feature (1)..(377): Ceres ANNOT ID no. 1464899
  misc_feature (8)..(377): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 187961:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(377): Functional Homolog of  Ceres CLONE ID no. 38101 at SEQ ID NO. 1726 with e-value of 6.50E-197 and BLAST sequence identity of 96.2

SEQ ID NO: 1691 - DNA, 1134 bp, Populus balsamifera subsp. trichocarpa; identical to SEQ ID NO: 156
  misc_feature (1)..(1134): Ceres ANNOT ID no. 1482966
  misc_feature 188108:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1692 - protein, 377 aa, Populus balsamifera subsp. trichocarpa; identical to SEQ ID NO: 157
  misc_feature (1)..(377): Ceres ANNOT ID no. 1482966
  misc_feature (8)..(377): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 188254:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(377): Functional Homolog of  Ceres CLONE ID no. 38101 at SEQ ID NO. 1726 with e-value of 5.79E-196 and BLAST sequence identity of 95.7

SEQ ID NO: 1693 - DNA, 1134 bp, Populus balsamifera subsp. trichocarpa; identical to SEQ ID NO: 154
  misc_feature (1)..(1134): Ceres ANNOT ID no. 1441039
  misc_feature 188401:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1694 - protein, 377 aa, Populus balsamifera subsp. trichocarpa; identical to SEQ ID NO: 155
  misc_feature (1)..(377): Ceres ANNOT ID no. 1441039
  misc_feature (8)..(377): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 188547:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(377): Functional Homolog of  Ceres CLONE ID no. 38101 at SEQ ID NO. 1726 with e-value of 5.79E-196 and BLAST sequence identity of 95.7

SEQ ID NO: 1695 - DNA, 1104 bp, Populus balsamifera subsp. trichocarpa; identical to SEQ ID NO: 168
  misc_feature (1)..(1104): Ceres ANNOT ID no. 1520449
  misc_feature 188694:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size

SEQ ID NO: 1696 - protein, 367 aa, Populus balsamifera subsp. trichocarpa; identical to SEQ ID NO: 169
  misc_feature (1)..(367): Ceres ANNOT ID no. 1520449
  misc_feature (8)..(367): Pfam Name: Actin Pfam Description: Actin
  misc_feature: SWISSPROT Homolog: ACT11_ARATH Actin-11 with e-value of 6.8e-203 and BLAST sequence identity of 100.0
  misc_feature: SWISSPROT Homolog: ACT11_SOLTU Actin-97 with e-value of 2.7e-199 and BLAST sequence identity of 97.9
  misc_feature: SWISSPROT Homolog: ACT1_ORYSA Actin-1 with e-value of 3.5e-199 and BLAST sequence identity of 97.6
  misc_feature: SWISSPROT Homolog: ACT_GOSHI Actin with e-value of 1.9e-198 and BLAST sequence identity of 97.1
  misc_feature: SWISSPROT Homolog: ACT1_TOBAC Actin with e-value of 2.5e-198 and BLAST sequence identity of 97.1
  misc_feature 188840:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Misc. Dwarf Useful for modulating plant size
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(367): Functional Homolog of  Ceres CLONE ID no. 38101 at SEQ ID NO. 1726 with e-value of 2.59E-184 and BLAST sequence identity of 93.7

SEQ ID NO: 1697 - protein, 304 aa, Arabidopsis thaliana
  misc_feature (1)..(304): Ceres CLONE ID no. 38105
  misc_feature (137)..(288): Pfam Name: Nuclear_move Pfam Description: Nuclear movement protein
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKDEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 1698 - DNA, 933 bp, Populus balsamifera subsp. trichocarpa
  misc_feature (1)..(933): Ceres ANNOT ID no. 1473032
  misc_feature 189086:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
atggcgataatctctgattacgaagaagaccaaacagacacaaaaccattaccatcatcatcccgtacccctcccaaaacgtcgacgtttactgcaacatttgatccacaaaaccccatgaggattgtggagggagttcttgatttcctggggaaagagagcgattttctcgagaaggagacggcggagaaggagatctttgcggtggtgaagaaggcagtggaggaggcgaagaggaagaaggcggcggaggaggcgaaggtgaaggcagcggaggaggcggaggtgaaggcgcagagtaagaggttgaaggtggagaagagagaaggagaaggagaaggagaagaaggagaaaatggacgaaaacgagaacaaagaggagagtgcaaagggaagttgagaattgaagagcaaaagactattccaaataatggcaacgggcttgatctggagaaatattcctggacacagaccttgcaagaggttaatgtacaaattccagttccttctggaactaaatcaagatttgtcatatgtgacatcaagaaaaaccatctaaaagttggactcaagggccagcctccaatagttgagggagagctctataagcccatcaaggttgatgattgttattggagcatagaggaccagaataccatctcaatccttttgacaaagcatgaccaaatggattggtggaagtctttggtgaaaggagatcctgaaattgatactcagaaagtggagcctgaaaacagcaaactatctgaccttgattctgaaacacggcagactgttgaaaagatgatgtttgatcagagacagaagtctatggggcttccaaccagtgatgagatgcagaaacaggagattctgaagaagttcatgtctgagcatccggagatggatttctcaagggcaaagatagcataa

SEQ ID NO: 1699 - protein, 310 aa, Populus balsamifera subsp. trichocarpa
  misc_feature (1)..(310): Ceres ANNOT ID no. 1473032
  misc_feature (143)..(294): Pfam Name: Nuclear_move Pfam Description: Nuclear movement protein
  misc_feature: SWISSPROT Homolog: NUDC_RAT Nuclear migration protein nudC Nuclear distribution protein C homolog (c15) with e-value of 3.8e-58 and BLAST sequence identity of 48.8
  misc_feature: SWISSPROT Homolog: NUDC_MOUSE Nuclear migration protein nudC (Silica-induced gene 92 protein) (SIG-92) with e-value of 4.9e-58 and BLAST sequence identity of 48.2
  misc_feature: SWISSPROT Homolog: NUDC_CHICK Nuclear migration protein nudC with e-value of 5.6e-57 and BLAST sequence identity of 48.4
  misc_feature: SWISSPROT Homolog: NUDC_HUMAN Nuclear migration protein nudC with e-value of 7.2e-57 and BLAST sequence identity of 47.6
  misc_feature: SWISSPROT Homolog: NUDC_EMENI Nuclear movement protein nudC with e-value of 3.2e-38 and BLAST sequence identity of 43.9
  misc_feature 189202:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(310): Functional Homolog of  Ceres CLONE ID no. 38105 at SEQ ID NO. 1741 with e-value of 9.10E-88 and BLAST sequence identity of 62.7
MAIISDYEEDQTDTKPLPSSSRTPPKTSTFTATFDPQNPMRIVEGVLDFLGKESDFLEKETAEKEIFAVVKKAVEEAKRKKAAEEAKVKAAEEAEVKAQSKRLKVEKREGEGEGEEGENGRKREQRGECKGKLRIEEQKTIPNNGNGLDLEKYSWTQTLQEVNVQIPVPSGTKSRFVICDIKKNHLKVGLKGQPPIVEGELYKPIKVDDCYWSIEDQNTISILLTKHDQMDWWKSLVKGDPEIDTQKVEPENSKLSDLDSETRQTVEKMMFDQRQKSMGLPTSDEMQKQEILKKFMSEHPEMDFSRAKIA

SEQ ID NO: 1700 - DNA, 870 bp, Populus balsamifera subsp. trichocarpa
  misc_feature (1)..(870): Ceres ANNOT ID no. 1467499
  misc_feature 189309:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
atggcaatactttctgattacgaagaagaccaaaacgacaaaaaatcatcaccgtcgccatcctgtacttctcccaagacgccgatgtttacggcagcatttaatccacaaaaccccataaggattgtggagacggttcttgatttcttggggaaagagagtaattttcttgagaaggacacggcggagaaggagatctttgctgtggtgaagagggcagtggaggagaagaagaggaagaaggcggaggaagaagcgaaggtgaaggaggagaacaagaggttgaagaaggaggaggtgaaggaaaatgaggagaaggtgcaggagggagagaataaagagcagagtgcaaagagagttccaaataagggaaatggtcttgatctggagaaatattcctggacacagaccttgcaagaggttaatatacaagttccagtcccttctggaacaaaatcaagatttgttgtatgtgacataaagaaaaaccatctaaaagttggactcaagggtctgcccccaataattgagggagagccttataagcctgtcaaggttgatgattgttactggagcatagaggaccagaatacaatctcaatccttttgacaaagcatgaccaaatggattggtggaaatctttggtgaaaggagatccagaaattgatactcagaaagttgaacctgaaaacagcaagctatctgatctggatgctgaaacgcggcaaactgttgaaaagatgatgtttgatcagagacagaagaagatgggccttccaaccagtgatgagatgcagaaacaggagattctgaagaagttcatggctgagcatccggagatggatttctcaaaggcgaagatagcataa

SEQ ID NO: 1701 - protein, 289 aa, Populus balsamifera subsp. trichocarpa
  misc_feature (1)..(289): Ceres ANNOT ID no. 1467499
  misc_feature (122)..(273): Pfam Name: Nuclear_move Pfam Description: Nuclear movement protein
  misc_feature: SWISSPROT Homolog: NUDC_RAT Nuclear migration protein nudC Nuclear distribution protein C homolog (c15) with e-value of 3.8e-58 and BLAST sequence identity of 48.8
  misc_feature: SWISSPROT Homolog: NUDC_MOUSE Nuclear migration protein nudC (Silica-induced gene 92 protein) (SIG-92) with e-value of 4.9e-58 and BLAST sequence identity of 48.2
  misc_feature: SWISSPROT Homolog: NUDC_CHICK Nuclear migration protein nudC with e-value of 5.6e-57 and BLAST sequence identity of 48.4
  misc_feature: SWISSPROT Homolog: NUDC_HUMAN Nuclear migration protein nudC with e-value of 7.2e-57 and BLAST sequence identity of 47.6
  misc_feature: SWISSPROT Homolog: NUDC_EMENI Nuclear movement protein nudC with e-value of 3.2e-38 and BLAST sequence identity of 43.9
  misc_feature 189423:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(289): Functional Homolog of  Ceres CLONE ID no. 38105 at SEQ ID NO. 1741 with e-value of 4.59E-84 and BLAST sequence identity of 64.3
MAILSDYEEDQNDKKSSPSPSCTSPKTPMFTAAFNPQNPIRIVETVLDFLGKESNFLEKDTAEKEIFAVVKRAVEEKKRKKAEEEAKVKEENKRLKKEEVKENEEKVQEGENKEQSAKRVPNKGNGLDLEKYSWTQTLQEVNIQVPVPSGTKSRFVVCDIKKNHLKVGLKGLPPIIEGEPYKPVKVDDCYWSIEDQNTISILLTKHDQMDWWKSLVKGDPEIDTQKVEPENSKLSDLDAETRQTVEKMMFDQRQKKMGLPTSDEMQKQEILKKFMAEHPEMDFSKAKIA

SEQ ID NO: 1702 - DNA, 810 bp, Populus balsamifera subsp. trichocarpa
  misc_feature (1)..(810): Ceres ANNOT ID no. 1526442
  misc_feature 189527:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
atggcgataatctctgattacgaagaagaccaaacagacacaaaaccattaccatcatcatcccgtacccctcccaaaacgtcgacgtttactgcaacatttgatccacaaaaccccatgaggattgtggagggagttcttgatttcctggggaaagagagcgattttctcgagaaggagacggcggagaaggagatctttgcggtggtgaagaaggcagtggaggaggcgaagaggaagaaggcggcggaggaggcgaaggtgaaggcagcggaggaggcggaggtgaaggcgcagattccaaataatggcaacgggcttgatctggagaaatattcctggacacagaccttgcaagaggttaatgtacaaattccagttccttctggaactaaatcaagatttgtcatatgtgacatcaagaaaaaccatctaaaagttggactcaagggccagcctccaatagttgagggagagctctataagcccatcaaggttgatgattgttattggagcatagaggaccagaataccatctcaatccttttgacaaagcatgaccaaatggattggtggaagtctttggtgaaaggagatcctgaaattgatactcagaaagtggagcctgaaaacagcaaactatctgaccttgattctgaaacacggcagactgttgaaaagatgatgtttgatcagagacagaagtctatggggcttccaaccagtgatgagatgcagaaacaggagattctgaagaagttcatgtctgagcatccggagatggatttctcaagggcaaagatagcataa

SEQ ID NO: 1703 - protein, 269 aa, Populus balsamifera subsp. trichocarpa
  misc_feature (1)..(269): Ceres ANNOT ID no. 1526442
  misc_feature (102)..(253): Pfam Name: Nuclear_move Pfam Description: Nuclear movement protein
  misc_feature: SWISSPROT Homolog: NUDC_RAT Nuclear migration protein nudC Nuclear distribution protein C homolog (c15) with e-value of 3.8e-58 and BLAST sequence identity of 48.8
  misc_feature: SWISSPROT Homolog: NUDC_MOUSE Nuclear migration protein nudC (Silica-induced gene 92 protein) (SIG-92) with e-value of 4.9e-58 and BLAST sequence identity of 48.2
  misc_feature: SWISSPROT Homolog: NUDC_CHICK Nuclear migration protein nudC with e-value of 5.6e-57 and BLAST sequence identity of 48.4
  misc_feature: SWISSPROT Homolog: NUDC_HUMAN Nuclear migration protein nudC with e-value of 7.2e-57 and BLAST sequence identity of 47.6
  misc_feature: SWISSPROT Homolog: NUDC_EMENI Nuclear movement protein nudC with e-value of 3.2e-38 and BLAST sequence identity of 43.9
  misc_feature 189639:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(269): Functional Homolog of  Ceres CLONE ID no. 38105 at SEQ ID NO. 1741 with e-value of 2.70E-79 and BLAST sequence identity of 68.9
MAIISDYEEDQTDTKPLPSSSRTPPKTSTFTATFDPQNPMRIVEGVLDFLGKESDFLEKETAEKEIFAVVKKAVEEAKRKKAAEEAKVKAAEEAEVKAQIPNNGNGLDLEKYSWTQTLQEVNVQIPVPSGTKSRFVICDIKKNHLKVGLKGQPPIVEGELYKPIKVDDCYWSIEDQNTISILLTKHDQMDWWKSLVKGDPEIDTQKVEPENSKLSDLDSETRQTVEKMMFDQRQKSMGLPTSDEMQKQEILKKFMSEHPEMDFSRAKIA

SEQ ID NO: 1704 - protein, 288 aa, Arabidopsis thaliana
  misc_feature (1)..(288): Ceres CLONE ID no. 38206
  misc_feature: Utility: ABA Useful for making plants with enhanced tolerance to drought
  misc_feature: Phenotype: WHOLE PLANT - ABA Useful for making plants with enhanced tolerance to drought
MSSSLPLRLLLPLTTSLISPPPPPPDSFHAPSSFRSKNPNFKRRLSSSSCCSSQSQLFSGRCRSYSRCVTMCLPEHMRNQENTEILTDKDDHIECVLESDEDSGLRIPTQAQAIVEGSGSVAVSELKPAADVDYIQELLAIQQQGPRSIGFFGTRNMGFMHQELIEILSYAMVITKNHIYTSGASGTNAAVIRGALRAERPELLTVILPQSLKKQPPESQELLSKVQNVVEKPHNDHLPLLEARLCNMDIISQVQQVICFAFHDSKLLMETCQEAKNLRKIVTLFYLD

SEQ ID NO: 1705 - DNA, 732 bp, Populus balsamifera subsp. trichocarpa
  misc_feature (1)..(732): Ceres ANNOT ID no. 1543295
  misc_feature: Utility: ABA Useful for making plants with enhanced tolerance to drought
  misc_feature 189828:<222: Transcription Factor
  misc_feature: Phenotype: WHOLE PLANT - ABA Useful for making plants with enhanced tolerance to drought
atggatagttggaaagctgaagaggagaacattgagtgcatgtttggttcaaatgaagatactggcagccaaattccaacacaagcccaaactattgtggaaggatcagggacagttgtgttgtcagaatttaaacctgttcctgatgtagactatctacaggagttattggccatccaacaacaaggaccaagatctattgggttttttggaacccggaacatgggcttcatgcatcaagaacttattgagattctcagttatgctttggttataacagtaagatgctatgacataaatctcatttattttatttctatttgtctccttggaatactcattaagcattctagaaatttacttgataccggcctcaccgtggaccataaaaaccatatttatacatcaggtgcatctgggactaatgcagctgttataaggggtgctttaagagcagaaaaacctgaactacttacagtaatcttgcctcaaagtttgaaaaaacaaccgcctgagagccaggagctattggcaaaagtgcagaatgtgatagagaagcctcacaatgaccatctaccactgattgaagccagcaggctgtgtaatatggacattatttcccatgtacaacaagttatttgctttgccttccatgatagcaggttgctcatggaaacttgtcaggaggccaaaaatctccggaaaattgttactctcttttatctggactga

SEQ ID NO: 1706 - protein, 243 aa, Populus balsamifera subsp. trichocarpa
  misc_feature (1)..(243): Ceres ANNOT ID no. 1543295
  misc_feature: Utility: ABA Useful for making plants with enhanced tolerance to drought
  misc_feature 189885:<222: Transcription Factor
  misc_feature: Phenotype: WHOLE PLANT - ABA Useful for making plants with enhanced tolerance to drought
  misc_feature (1)..(243): Functional Homolog of  Ceres CLONE ID no. 38206 at SEQ ID NO. 1748 with e-value of 2.29E-82 and BLAST sequence identity of 87.0
MDSWKAEEENIECMFGSNEDTGSQIPTQAQTIVEGSGTVVLSEFKPVPDVDYLQELLAIQQQGPRSIGFFGTRNMGFMHQELIEILSYALVITVRCYDINLIYFISICLLGILIKHSRNLLDTGLTVDHKNHIYTSGASGTNAAVIRGALRAEKPELLTVILPQSLKKQPPESQELLAKVQNVIEKPHNDHLPLIEASRLCNMDIISHVQQVICFAFHDSRLLMETCQEAKNLRKIVTLFYLD

SEQ ID NO: 1707 - protein, 364 aa, Arabidopsis thaliana
  misc_feature (1)..(364): Ceres CLONE ID no. 38214
  misc_feature (17)..(145): Pfam Name: NAM Pfam Description: No apical meristem (NAM) protein
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHHHHHNVSRSMNFFPGKFSGGGYGIFSDGGNTSIYDGGGMINNIGTDSVDHDNNADVVGLNHASSSGPMMMANLKRTLPVPYWPVAEEEQDASPSKRFHGVGGGGGDCSNMSSSMMEETPPLMQQQGGVLGDGLFRTTSYQLPGLNWYSS

SEQ ID NO: 1708 - DNA, 1068 bp, Populus balsamifera subsp. trichocarpa
  misc_feature (1)..(1068): Ceres ANNOT ID no. 1466779
  misc_feature 190091:<222: Transcription Factor
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
atggaaagcactgattcatccacaggaggtgccggaggcggcggcggcggctctcaacaaccaaaccttccaccagggttccggttccaccccacagatgaagagctagttgttcactacctcaagaaaaagaccacttctgctcctctccctatggcgattattgcagaagttgatctttacaagtttgatccatgggaattaccagctaaggccacgtttggtgaacaagaatggtacttttttagtccgagggaccggaagtacccaaatggaactaggccaaacagggcagcaacttcagggtattggaaggctacgggaactgataagccaatattaactttaggtggtacacagaaagttggggtaaaaaaagccctggtcttctatggtggtaagcctcctaaagggatcaaaaccaattggatcatgcacgaataccggttagctgataacaaagtcaaaaacaagccaccaggatgtgacttgggaaacaagaaaaactccttgaggcttgatgattgggtgttatgtcgaatatacaagaaaaacaacacacatagaccaatagatcacgataaagatgattatatggatgatattcttggatcaataccgccttcgatactggttggtaaccatcagaatggaacacttcatcttgctaaaggcacaaactatgagacattgcttgacaatgaccataatttattcgaaggaataataagcagcaatgatggcatcagaagcagcagttctatgtctcacgtggcttcttcagtatccaagccagatcacctacccatgcttccactcaaaagaacactcccatcactgtattggaccgacgaggacatggctgtcccttcatcaagtaagagatttcaaggggatattaatggagatgaaagtgttgtggggaatgatgggaatagttccatagttactcttctcagtcaacttccacagacatctcaattgcaccaacagacaatgctggggtctatgggaaatggaatttttaggccaccatatcaaattccaggcatgaactggtactcttaa

SEQ ID NO: 1709 - protein, 355 aa, Populus balsamifera subsp. trichocarpa
  misc_feature (1)..(355): Ceres ANNOT ID no. 1466779
  misc_feature (23)..(151): Pfam Name: NAM Pfam Description: No apical meristem (NAM) protein
  misc_feature: SWISSPROT Homolog: NAC18_ARATH NAC domain-containing protein 18 (ANAC018) NO APICAL MERISTEM protein (AtNAM) with e-value of 2.4e-102 and BLAST sequence identity of 66.9
  misc_feature: SWISSPROT Homolog: NAC68_ORYSA NAC domain-containing protein 68 (ONAC068) with e-value of 3.6e-66 and BLAST sequence identity of 71.7
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 4.2e-61 and BLAST sequence identity of 66.1
  misc_feature: SWISSPROT Homolog: NAC48_ORYSA NAC domain-containing protein 48 (ONAC048) with e-value of 1.1e-60 and BLAST sequence identity of 69.9
  misc_feature: SWISSPROT Homolog: NAC2_ARATH NAC domain-containing protein 2 (ANAC002) with e-value of 8.9e-59 and BLAST sequence identity of 68.9
  misc_feature 190226:<222: Transcription Factor
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature (1)..(355): Functional Homolog of  Ceres CLONE ID no. 38214 at SEQ ID NO. 1751 with e-value of 2.80E-102 and BLAST sequence identity of 64.4
MESTDSSTGGAGGGGGGSQQPNLPPGFRFHPTDEELVVHYLKKKTTSAPLPMAIIAEVDLYKFDPWELPAKATFGEQEWYFFSPRDRKYPNGTRPNRAATSGYWKATGTDKPILTLGGTQKVGVKKALVFYGGKPPKGIKTNWIMHEYRLADNKVKNKPPGCDLGNKKNSLRLDDWVLCRIYKKNNTHRPIDHDKDDYMDDILGSIPPSILVGNHQNGTLHLAKGTNYETLLDNDHNLFEGIISSNDGIRSSSSMSHVASSVSKPDHLPMLPLKRTLPSLYWTDEDMAVPSSSKRFQGDINGDESVVGNDGNSSIVTLLSQLPQTSQLHQQTMLGSMGNGIFRPPYQIPGMNWYS

SEQ ID NO: 1710 - DNA, 1065 bp, Populus balsamifera subsp. trichocarpa
  misc_feature (1)..(1065): Ceres ANNOT ID no. 1465769
  misc_feature 190356:<222: Transcription Factor
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
atggagagcaccgattcatcgtctgggtcgcagcacccacagctgccaccggggttcaggttccaccctactgatgaagagctagtggtccactacctaaaaaagaaggttgcatcagttccattaccggttacaattatagctgagattgatctatacaaatttgatccatgggagctaccaagtaaggctacgtttggagagcaagagtggtattttttcagtcctagagacaggaaataccccaacggtgcaaggcctaatagagctgcaacttcagggtattggaaagctactggaactgataagcctatattaacatctaatggagctcaaaaggttggtgtcaaaaaggccctggttttttatggtggtaagccaccaaaagggattaaaaccaattggattatgcatgaatatcgccttatcaataacaatcctagctcaaaacctcctggtgattctgccaacaagaaaggcggctctttaaggcttgatgactgggttctatgccggatttacaagaaaaacaaccctcaaagacagatggatcaaatggaggaggattcaatggagggaatgtttactacactgccaagtacttctagcaacaaaaatccaaaacacccttcagtttcaaagcctacaggttatgcttcattacttgagaatgaagataccttctttgaagggatactaacaggagatggcatgcaaaacagttccatttctcaattaccatcttcaagctcgaagccaaatatgtccatgacctcagtctctacaaatactctttcggaaaaacgttccctcccttatcatcagtattggaatgagactacaggattaccaatggggctggctaattcatcagcaaagcgttttcatggtgatcttaatagtggcattactggcactcaagaggataacaactcctttgtttctttgcttaaccagtttccacagagcacaccattggttcacccaagcactcttcttggttctctgggcgatggtgttttgagacaaacctttcaactttctagcttgaattggaactcataa

SEQ ID NO: 1711 - protein, 354 aa, Populus balsamifera subsp. trichocarpa
  misc_feature (1)..(354): Ceres ANNOT ID no. 1465769
  misc_feature (15)..(143): Pfam Name: NAM Pfam Description: No apical meristem (NAM) protein
  misc_feature: SWISSPROT Homolog: NAC18_ARATH NAC domain-containing protein 18 (ANAC018) NO APICAL MERISTEM protein (AtNAM) with e-value of 2.4e-102 and BLAST sequence identity of 66.9
  misc_feature: SWISSPROT Homolog: NAC68_ORYSA NAC domain-containing protein 68 (ONAC068) with e-value of 3.6e-66 and BLAST sequence identity of 71.7
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 4.2e-61 and BLAST sequence identity of 66.1
  misc_feature: SWISSPROT Homolog: NAC48_ORYSA NAC domain-containing protein 48 (ONAC048) with e-value of 1.1e-60 and BLAST sequence identity of 69.9
  misc_feature: SWISSPROT Homolog: NAC2_ARATH NAC domain-containing protein 2 (ANAC002) with e-value of 8.9e-59 and BLAST sequence identity of 68.9
  misc_feature 190491:<222: Transcription Factor
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature (1)..(354): Functional Homolog of  Ceres CLONE ID no. 38214 at SEQ ID NO. 1751 with e-value of 1.09E-89 and BLAST sequence identity of 59.3
MESTDSSSGSQHPQLPPGFRFHPTDEELVVHYLKKKVASVPLPVTIIAEIDLYKFDPWELPSKATFGEQEWYFFSPRDRKYPNGARPNRAATSGYWKATGTDKPILTSNGAQKVGVKKALVFYGGKPPKGIKTNWIMHEYRLINNNPSSKPPGDSANKKGGSLRLDDWVLCRIYKKNNPQRQMDQMEEDSMEGMFTTLPSTSSNKNPKHPSVSKPTGYASLLENEDTFFEGILTGDGMQNSSISQLPSSSSKPNMSMTSVSTNTLSEKRSLPYHQYWNETTGLPMGLANSSAKRFHGDLNSGITGTQEDNNSFVSLLNQFPQSTPLVHPSTLLGSLGDGVLRQTFQLSSLNWNS

SEQ ID NO: 1712 - DNA, 1014 bp, Populus balsamifera subsp. trichocarpa
  misc_feature (1)..(1014): Ceres ANNOT ID no. 1538318
  misc_feature 190621:<222: Transcription Factor
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
atggaggccaaagccagctcaggcattcaacttcctccaggatttagattccatccatctgatgaggagctcatagtgcactatttgaagaacagagtcagttcaagtccacttcctgcatctattattgctgagatagatctctataagtataacccatgggagctaccaaagaaagctttgtttggcgtggatgaatggtatttctttacaccaagggataggaagtaccccaatggagcgcggcctaacagggcagcagcttcaggttattggaaggcaacagggacagataaatcgatttttaattccttcggaacagccaaaataggcgtcaagaagactctcgtgttctacgaaggacgccctcccaaaggactaaagacagactggaacatgcatgaatacagattgctagatgccatgatttggaacaattccaagagaaaaggatctatgaggttggatgattgggtgctgtgtcgagttaggcagaagaacagcatccccagaaacacatggcaagatcaaaatattccaagttgtgcatctgcacccaccggcttgttcccaaaagtgaatgagctacagcaaatgaacatcaaccccaacactgagatggtcacgaattatttttacgatgattgcccaatgttaccttgtatcttttctccccagaattttccatcaactgaaagagcctcaagcataaacttcctaagtagcgacaaatcttgcacttcttttcacaatttgttaaacctactgaaaagaaaacctgcggaaacaaaccaacagcgagggaattgttttccacccggcaagatgcttagaacaaaggcagatatagaggaggacgttgtatctatcagaaacgatggcactgatgagaatttcagcggaacagatcagtctgagagtggcaatttcagcactgagcaatggaattctcccatgcaatatcaagagtgtaatcacctaaccttcacaggaaatcacctaactcttgattag

SEQ ID NO: 1713 - protein, 337 aa, Populus balsamifera subsp. trichocarpa
  misc_feature (1)..(337): Ceres ANNOT ID no. 1538318
  misc_feature (11)..(139): Pfam Name: NAM Pfam Description: No apical meristem (NAM) protein
  misc_feature: SWISSPROT Homolog: NAC18_ARATH NAC domain-containing protein 18 (ANAC018) NO APICAL MERISTEM protein (AtNAM) with e-value of 2.4e-102 and BLAST sequence identity of 66.9
  misc_feature: SWISSPROT Homolog: NAC68_ORYSA NAC domain-containing protein 68 (ONAC068) with e-value of 3.6e-66 and BLAST sequence identity of 71.7
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 4.2e-61 and BLAST sequence identity of 66.1
  misc_feature: SWISSPROT Homolog: NAC48_ORYSA NAC domain-containing protein 48 (ONAC048) with e-value of 1.1e-60 and BLAST sequence identity of 69.9
  misc_feature: SWISSPROT Homolog: NAC2_ARATH NAC domain-containing protein 2 (ANAC002) with e-value of 8.9e-59 and BLAST sequence identity of 68.9
  misc_feature 190754:<222: Transcription Factor
  misc_feature: Phenotype: WHOLE PLANT - Dark Green Useful for increasing chlorophyll and photosynthetic capacity
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature (1)..(337): Functional Homolog of  Ceres CLONE ID no. 38214 at SEQ ID NO. 1751 with e-value of 3.09E-62 and BLAST sequence identity of 66.6
MEAKASSGIQLPPGFRFHPSDEELIVHYLKNRVSSSPLPASIIAEIDLYKYNPWELPKKALFGVDEWYFFTPRDRKYPNGARPNRAAASGYWKATGTDKSIFNSFGTAKIGVKKTLVFYEGRPPKGLKTDWNMHEYRLLDAMIWNNSKRKGSMRLDDWVLCRVRQKNSIPRNTWQDQNIPSCASAPTGLFPKVNELQQMNINPNTEMVTNYFYDDCPMLPCIFSPQNFPSTERASSINFLSSDKSCTSFHNLLNLLKRKPAETNQQRGNCFPPGKMLRTKADIEEDVVSIRNDGTDENFSGTDQSESGNFSTEQWNSPMQYQECNHLTFTGNHLTLD

SEQ ID NO: 1714 - protein, 55 aa, Arabidopsis thaliana
  misc_feature (1)..(55): Ceres CLONE ID no. 38277
  misc_feature (1)..(43): Pfam Name: SPC12 Pfam Description: Microsomal signal peptidase 12 kDa subunit SPC12)
  misc_feature: Utility: Cold Growth Useful for making plants with increased tolerance to cold stress
  misc_feature: Phenotype: WHOLE PLANT - Cold Growth Useful for making plants with increased tolerance to cold stress
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Glossy Useful for making plants with enhanced abiotic stress tolerance
MLIYAGGVVLTTLVTVPNWPFYNLHPLKWLDPSEAEKHPKPEVVSVASKKKFSKK

SEQ ID NO: 1715 - DNA, 285 bp, Populus balsamifera subsp. trichocarpa
  misc_feature (1)..(285): Ceres ANNOT ID no. 1512884
  misc_feature: Utility: Cold Growth Useful for making plants with increased tolerance to cold stress
  misc_feature 190955:<222: Transcription Factor
  misc_feature: Phenotype: WHOLE PLANT - Cold Growth Useful for making plants with increased tolerance to cold stress
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Glossy Useful for making plants with enhanced abiotic stress tolerance
atggattggcaagggcagaaactagcggagctatggatgcaggtactgctgatagttttcgctgtggtggccttcgctaccggttatatcatgggatcgtttcgaacaatgatgctaatttacgccggtggagtggttttcacctcacttgttactgtccctaattggcctttcttcaatcgccatcctctcaagtggttggacccaagcgaagccgagaagcaccctaagccacagcagcaggttgtggcttccaaggacaagaagaaatcgtccaagaagtag

SEQ ID NO: 1716 - protein, 64 aa, Populus balsamifera subsp. trichocarpa
  misc_feature (1)..(64): Ceres ANNOT ID no. 1512884
  misc_feature (3)..(50): Pfam Name: SPC12 Pfam Description: Microsomal signal peptidase 12 kDa subunit SPC12)
  misc_feature: SWISSPROT Homolog: SPCS1_ARATH Probable signal peptidase complex subunit 1 with e-value of 2.4e-26 and BLAST sequence identity of 100.0
  misc_feature: SWISSPROT Homolog: SPCS1_ARATH EC 3.4.-.- Microsomal signal peptidase 12 kDa subunit SPase 12 kDa subunit
  misc_feature: Utility: Cold Growth Useful for making plants with increased tolerance to cold stress
  misc_feature 191040:<222: Transcription Factor
  misc_feature: Phenotype: WHOLE PLANT - Cold Growth Useful for making plants with increased tolerance to cold stress
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Glossy Useful for making plants with enhanced abiotic stress tolerance
  misc_feature (1)..(64): Functional Homolog of  Ceres CLONE ID no. 38277 at SEQ ID NO. 1758 with e-value of 2.89E-20 and BLAST sequence identity of 83.6
MGSFRTMMLIYAGGVVFTSLVTVPNWPFFNRHPLKWLDPSEAEKHPKPQQQVVASKDKKKSSKK

SEQ ID NO: 1717 - protein, 243 aa, Arabidopsis thaliana
  misc_feature (1)..(243): Ceres CLONE ID no. 38286
  misc_feature (6)..(234): Pfam Name: AUX_IAA Pfam Description: AUX/IAA family
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 1718 - DNA, 747 bp, Populus balsamifera subsp. trichocarpa
  misc_feature (1)..(747): Ceres ANNOT ID no. 1459467
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191235:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atgacaacttctgtgctaggtaccgagcgaactgatttgaactacaaagagactgagctgtgtctgggattgcctggtgctgttggtgccaagaatgaagttgagacacctaataaggctactgggaaaagagggtttgctgagactgttgacttgaagcttaatcttcaggctaaagagggtgtcatggatctgaatgagaatatcaagaatattacttcaaaggacaagaaccaccttcctgctgttaccatcaaggaccctgctaagccaccggccaaggcacaagttgtaggttggccaccagttcgatcttacaggaagaacgttatggctcagaagaacgccagtgaggaaggcgagaaggcaagcactggcggcagcagtgcagcatttgtgaaggtctgcatggatggtgcaccctatcttcgcaaggtggacttgaagatgtacaggagctaccaagaattatctgatgccttggccaaaatgttcagttccttcaccatgggtaattatggagcccagggaatgatagactttatgaatgagagcaagttgatggatctacttaatagttccgagtatgtgccatcctacgaagacaaggatggtgattggatgctcgtgggtgatgttccatgggagatgtttgtcaattcatgcaagcgcctgcgcatcatgaaaggatctgaagccattggacttgcaccaagagccatggagaaatgcaagagcagaacctga

SEQ ID NO: 1719 - protein, 248 aa, Populus balsamifera subsp. trichocarpa
  misc_feature (1)..(248): Ceres ANNOT ID no. 1459467
  misc_feature (13)..(240): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191364:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(248): Functional Homolog of  Ceres CLONE ID no. 38286 at SEQ ID NO. 1761 with e-value of 1.19E-85 and BLAST sequence identity of 79.6
MTTSVLGTERTDLNYKETELCLGLPGAVGAKNEVETPNKATGKRGFAETVDLKLNLQAKEGVMDLNENIKNITSKDKNHLPAVTIKDPAKPPAKAQVVGWPPVRSYRKNVMAQKNASEEGEKASTGGSSAAFVKVCMDGAPYLRKVDLKMYRSYQELSDALAKMFSSFTMGNYGAQGMIDFMNESKLMDLLNSSEYVPSYEDKDGDWMLVGDVPWEMFVNSCKRLRIMKGSEAIGLAPRAMEKCKSRT

SEQ ID NO: 1720 - DNA, 834 bp, Populus balsamifera subsp. trichocarpa
  misc_feature (1)..(834): Ceres ANNOT ID no. 1516688
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191477:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atggcaacagctaccgtgttaggtaccgagatggcagatttgaactacaaagagactgagctgtgtctaggattgcctggtgctgttggtgtcaaaaatgaagttgagacacctaataaggctactgggaaaagagggtttgctgagactgttgatttgaagcttaatcttcaggctaaagaaggtgtcatggatctgaatgagaatatcaagaatattgcttcaaaggacaagaaccaccttcctgctgataccatcaaggaccctgctaagccaccagccaaggcacaagttgtaggttggccaccagttagatcttacaggaagaacgttttggctcagaagaacgccagtgaggaaggtttcagggcacaagttgtaggttggccaccacttagatcttacaggaagaacgttttgactcagaagaacgccagtgaggaaggtgataaggcaagcactggcggaagcagtgcagcatttgtgaaggtttgcatggatggtgcaccctatcttcgcaaggtggacttgaagatgtacaagagctaccaagaattatctgatgccttggccaaaatgttcagttccttcaccatgggtaattatggagcccaaggaatgatagactttatgaatgaaagcaagctgatggatctacttaacagttccgagtatgtgccatcctatgaagacaaggatggtgattggatgcttgtgggtgatgttccatgggagatgtttgttgattcatgcaagcgcctgcgcataatgaaaggatctgaagccattggacttgcaccaagagcaatggagaaatgcaagagcagaacctga

SEQ ID NO: 1721 - protein, 267 aa, Populus balsamifera subsp. trichocarpa
  misc_feature (1)..(267): Ceres ANNOT ID no. 1516688
  misc_feature (114)..(259): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191608:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(267): Functional Homolog of  Ceres CLONE ID no. 38286 at SEQ ID NO. 1761 with e-value of 4.79E-82 and BLAST sequence identity of 76.0
MADLNYKETELCLGLPGAVGVKNEVETPNKATGKRGFAETVDLKLNLQAKEGVMDLNENIKNIASKDKNHLPADTIKDPAKPPAKAQVVGWPPVRSYRKNVLAQKNASEEGFRAQVVGWPPLRSYRKNVLTQKNASEEGDKASTGGSSAAFVKVCMDGAPYLRKVDLKMYKSYQELSDALAKMFSSFTMGNYGAQGMIDFMNESKLMDLLNSSEYVPSYEDKDGDWMLVGDVPWEMFVDSCKRLRIMKGSEAIGLAPRAMEKCKSRT

SEQ ID NO: 1722 - DNA, 741 bp, Populus balsamifera subsp. trichocarpa
  misc_feature (1)..(741): Ceres ANNOT ID no. 1488767
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191724:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atgggagcagaaacagctgacacctacagcatgattaattatgaagagactgaattacgcctagggttacctggaggtgctagtaatggaaatgatggtgaggctgcaaagggtaatgggaagagagggttttcagagacggttgacttgaagcttaacctttcaactaaagaaactggaaaggatggatcagatcaggagaaagtagtaatgaaggagaaaactgttgctcctcgccccaatgatcctgcaaagccaccgtccaaggcacaagttgtgggttggccacccattagatcattccgtaaaaatgtcatggccgtccagaagaacagcaacgatgagggtgaaaaggccagtagcagtggcactactggtactgcagctttcgttaaggttagcatggatggtgccccatacttgcgaaaagtggacttgaaattatacaagagctaccgagaactctctgatgctctaggcaaaatgttcagctccttcaccatcggtaactgtggctcacaaggaacgaaagatttcatgaatgaaagcaaattgatagatcttttgaatagttctgagtatgtgccaacttatgaagacaaggatggagattggatgcttgtaggagatgttccatggggaatgtttgtcgattcatgcaagcgcttgaggatcatgaaagggtctgaggccattggacttgccccaagagctgtggagaagtgcaagaacagaagttga

SEQ ID NO: 1723 - protein, 236 aa, Populus balsamifera subsp. trichocarpa
  misc_feature (1)..(236): Ceres ANNOT ID no. 1488767
  misc_feature (2)..(228): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191853:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(236): Functional Homolog of  Ceres CLONE ID no. 38286 at SEQ ID NO. 1761 with e-value of 4.60E-77 and BLAST sequence identity of 69.3
MINYEETELRLGLPGGASNGNDGEAAKGNGKRGFSETVDLKLNLSTKETGKDGSDQEKVVMKEKTVAPRPNDPAKPPSKAQVVGWPPIRSFRKNVMAVQKNSNDEGEKASSSGTTGTAAFVKVSMDGAPYLRKVDLKLYKSYRELSDALGKMFSSFTIGNCGSQGTKDFMNESKLIDLLNSSEYVPTYEDKDGDWMLVGDVPWGMFVDSCKRLRIMKGSEAIGLAPRAVEKCKNRS

SEQ ID NO: 1724 - DNA, 885 bp, Populus balsamifera subsp. trichocarpa
  misc_feature (1)..(885): Ceres ANNOT ID no. 1463396
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 191963:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atggcaacagctaccgtgttaggtaccgagatggcagatttgaactacaaagagactgagctgtgtctaggattgcctggtgctgttggtgtcaaaaatgaagttgagacacctaataaggctactgggaaaagagggtttgctgagactgttgatttgaagcttaatcttcaggctaaagaaggtgtcatggatctgaatgagaatatcaagaatattgcttcaaaggacaagaaccaccttcctgctgataccatcaaggaccctgctaagccaccagccaaggcacaagttgtaggttggccaccagttagatcttacaggaagaacgttttggctcagaagaacgccagtgaggaaggtttcagggcacaagttgtaggttggccaccacttagatcttacaggaagaacgttttgactcagaagaacgccagtgaggaaggtgataaggcaagcactggcggaagcagtgcagcatttgtgaaggtttgcatggatggtgcaccctatcttcgcaaggtggacttgaagatgtacaagagctaccaagaattatctgatgccttggccaaaatgttcagttccttcaccatgggtaattatggagcccaaggaatgatagactttatgaatgaaagcaagctgatggatctacttaacagttccgagtatgtgccatcctatgaagacaaggatggtgattggatgcttgtgggtgatgttccatgggagatgtttgttgattcatgcaagcgcctgcgcataatgaaaggatctgaagccattggacttggttccctgctggattccccctttttagccttgcttccatatatgaagactagcagacaaggcacttgcgcaacatggatggatcagtag

SEQ ID NO: 1725 - protein, 294 aa, Populus balsamifera subsp. trichocarpa
  misc_feature (1)..(294): Ceres ANNOT ID no. 1463396
  misc_feature (14)..(269): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192096:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(294): Functional Homolog of  Ceres CLONE ID no. 38286 at SEQ ID NO. 1761 with e-value of 4.60E-77 and BLAST sequence identity of 75.6
MATATVLGTEMADLNYKETELCLGLPGAVGVKNEVETPNKATGKRGFAETVDLKLNLQAKEGVMDLNENIKNIASKDKNHLPADTIKDPAKPPAKAQVVGWPPVRSYRKNVLAQKNASEEGFRAQVVGWPPLRSYRKNVLTQKNASEEGDKASTGGSSAAFVKVCMDGAPYLRKVDLKMYKSYQELSDALAKMFSSFTMGNYGAQGMIDFMNESKLMDLLNSSEYVPSYEDKDGDWMLVGDVPWEMFVDSCKRLRIMKGSEAIGLGSLLDSPFLALLPYMKTSRQGTCATWMDQ

SEQ ID NO: 1726 - DNA, 714 bp, Populus balsamifera subsp. trichocarpa
  misc_feature (1)..(714): Ceres ANNOT ID no. 1495750
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192218:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atggaagtggagaagggaacaaagatggggtttgaggagacagagctaaggctagggttgccagggaatggtggaggggctgaaggagagatggtgaggaagagaggattctctgagactgtggacttgaagctcaaactttcttccaaggagagcggtgctgatccaaatcatgagaagaccagcagtttgcaaagggagaagaatcttctggccactgatccagcaaagcctccagctaaggcacaggttgtgggatggcctccagtacgatctttccgaaagaacatgttagcagtccaaaagagcagcactgatcaagagtgtgagaaggttcctggcggcaatgctacctttgtgaaggttagcatggatggggcaccttacctccgtaaagtggacctgaagatgtacaagacctaccaggagctttctgatgccttagggaaaatgttcagttcctttactataggcaattgtggatcccatggattgaaagatttcctcaatgagagcaagctcatagatcttctcaatggcactgattatgttccaacttatgaagacaaggacggtgattggatgctcgtcggtgacgtcccatgggacatgtttgttgaatcatgcaagaggctgcgaataatgaagggaacggaggctactggacttgcaccaagagccatggagaagtgcaagaacagaagctacaagtag

SEQ ID NO: 1727 - protein, 237 aa, Populus balsamifera subsp. trichocarpa
  misc_feature (1)..(237): Ceres ANNOT ID no. 1495750
  misc_feature (9)..(227): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192345:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(237): Functional Homolog of  Ceres CLONE ID no. 38286 at SEQ ID NO. 1761 with e-value of 3.29E-74 and BLAST sequence identity of 68.4
MEVEKGTKMGFEETELRLGLPGNGGGAEGEMVRKRGFSETVDLKLKLSSKESGADPNHEKTSSLQREKNLLATDPAKPPAKAQVVGWPPVRSFRKNMLAVQKSSTDQECEKVPGGNATFVKVSMDGAPYLRKVDLKMYKTYQELSDALGKMFSSFTIGNCGSHGLKDFLNESKLIDLLNGTDYVPTYEDKDGDWMLVGDVPWDMFVESCKRLRIMKGTEATGLAPRAMEKCKNRSYK

SEQ ID NO: 1728 - DNA, 690 bp, Populus balsamifera subsp. trichocarpa
  misc_feature (1)..(690): Ceres ANNOT ID no. 1452612
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192455:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atggaagtagagaagggaacaaagatgcggtttgaggagacagagctaaggctagggttaccagggaatggtggagggggtactgaaggaggggagttcgcaaggaagagaggattctctgagactgtggacttgaagctcaatctttcttccaaggaggggggtattgatccaaatcatgagaagactcaaagggagaagaaccttctggccactgatccagcaaaacctccagctaaggcacaggttgtgggttggcctccagtcagatctttccgaaagaacatgttagctgtccaaaaaagcagcaccgatcaggagagtactgacaaggttcctgggggcaatgcaacctttgtgaaggttagcatggatggcgcaccttacctccgtaaagtggacctgaagatgtacaagacctaccacgagctctctgatgccttgggcaaaatgttcagttccttcaccataggcaactgtggatcccatggaatgaaagatttcctgaatgaaagcaagctcatagatcttcttaatggcaccgactatgttccaacttatgaagataaggacggtgactggatgctcgtcggagatgtcccatgggacatgtttgttgaatcatgcaagcggctgcgaataatgaaaggaacggaggcgactggacttggtaatgagtatacagcataa

SEQ ID NO: 1729 - protein, 229 aa, Populus balsamifera subsp. trichocarpa
  misc_feature (1)..(229): Ceres ANNOT ID no. 1452612
  misc_feature (9)..(226): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192582:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(229): Functional Homolog of  Ceres CLONE ID no. 38286 at SEQ ID NO. 1761 with e-value of 4.49E-70 and BLAST sequence identity of 68.9
MEVEKGTKMRFEETELRLGLPGNGGGGTEGGEFARKRGFSETVDLKLNLSSKEGGIDPNHEKTQREKNLLATDPAKPPAKAQVVGWPPVRSFRKNMLAVQKSSTDQESTDKVPGGNATFVKVSMDGAPYLRKVDLKMYKTYHELSDALGKMFSSFTIGNCGSHGMKDFLNESKLIDLLNGTDYVPTYEDKDGDWMLVGDVPWDMFVESCKRLRIMKGTEATGLGNEYTA

SEQ ID NO: 1730 - DNA, 759 bp, Populus balsamifera subsp. trichocarpa
  misc_feature (1)..(759): Ceres ANNOT ID no. 1442831
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192692:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
atggaagtggagaagggaacaaagatggggtttgaggagacagagctaaggctagggttgccagggaatggtggaggggctgaaggagagatggtgaggaagagaggattctctgagactgtggacttgaagctcaaactttcttccaaggagagcggtgctgatccaaatcatgagaagaccagcagtttgcaaagggagaagaatcttctggccactgatccagcaaagcctccagctaaggcacaggttgtgggatggcctccagtacgatctttccgaaagaacatgttagcagtccaaaagagcagcactgatcaagagtgtgagaaggttcctggcggcaatgctacctttgtgaaggttagcatggatggggcaccttacctccgtaaagtggacctgaagatgtacaagacctaccaggagctttctgatgccttagggaaaatgttcagttcctttactataggcaattgtggatcccatggattgaaagatttcctcaatgagagcaagctcatagatcttctcaatggcactgattatgttccaacttatgaagacaaggacggtgattggatgctcgtcggtgacgtcccatgggacaccaagagccatggagaagtgcaagaacagaagctacaagtagtgagagccacagcctgctcctttgatctcgtgggtcgcaggaaccaaaaagatgataaaacgcgtagatggattgagcaggttgttctcgtggagctgtttctgtaa

SEQ ID NO: 1731 - protein, 252 aa, Populus balsamifera subsp. trichocarpa
  misc_feature (1)..(252): Ceres ANNOT ID no. 1442831
  misc_feature (9)..(203): Pfam Name: AUX_IAA Pfam Description: AUX/IAA family
  misc_feature: SWISSPROT Homolog: IAA7_ARATH Auxin-responsive protein IAA7 Indoleacetic acid-induced protein 7 (Auxin resistant 2) with e-value of 1.2e-127 and BLAST sequence identity of 99.6
  misc_feature: SWISSPROT Homolog: IAA14_ARATH Auxin-responsive protein IAA14 Indoleacetic acid-induced protein 14 (SOLITARY-ROOT protein) with e-value of 2.7e-98 and BLAST sequence identity of 82.8
  misc_feature: SWISSPROT Homolog: IAA16_ARATH Auxin-responsive protein IAA16 (Indoleacetic acid-induced protein 16) with e-value of 5.3e-77 and BLAST sequence identity of 65.7
  misc_feature: SWISSPROT Homolog: IAA17_ARATH Auxin-responsive protein IAA17 Indoleacetic acid-induced protein 17 (Auxin response 3) with e-value of 3.3e-75 and BLAST sequence identity of 64.7
  misc_feature: SWISSPROT Homolog: IAA30_ORYSA Auxin-responsive protein IAA30 (Indoleacetic acid-induced protein 30) with e-value of 1.5e-71 and BLAST sequence identity of 72.2
  misc_feature: Utility: pH (high) Useful for making plants tolerant to high pH or low phosphate
  misc_feature: Utility: LNABA Useful for making plants tolerant to low nitrogen
  misc_feature: Utility: MSX Useful for making plants tolerant to low nitrogen
  misc_feature 192821:<222: Transcription Factor
  misc_feature: Phenotype: WHOLE PLANT - LNABA Useful for making plants tolerant to low nitrogen and drought conditions
  misc_feature: Phenotype: WHOLE PLANT - MSX Useful for making plants tolerant to low nitrogen
  misc_feature: Phenotype: WHOLE PLANT - pH (high) Useful for making plants tolerant to high pH or low phosphate
  misc_feature (1)..(252): Functional Homolog of  Ceres CLONE ID no. 38286 at SEQ ID NO. 1761 with e-value of 9.80E-59 and BLAST sequence identity of 64.2
MEVEKGTKMGFEETELRLGLPGNGGGAEGEMVRKRGFSETVDLKLKLSSKESGADPNHEKTSSLQREKNLLATDPAKPPAKAQVVGWPPVRSFRKNMLAVQKSSTDQECEKVPGGNATFVKVSMDGAPYLRKVDLKMYKTYQELSDALGKMFSSFTIGNCGSHGLKDFLNESKLIDLLNGTDYVPTYEDKDGDWMLVGDVPWDTKSHGEVQEQKLQVVRATACSFDLVGRRNQKDDKTRRWIEQVVLVELFL

SEQ ID NO: 1732 - protein, 395 aa, Arabidopsis thaliana
  misc_feature (1)..(395): Ceres CLONE ID no. 38370
  misc_feature (244)..(394): Pfam Name: Chal_sti_synt_C Pfam Description: Chalcone and stilbene synthases C-terminal domain
  misc_feature (7)..(233): Pfam Name: Chal_sti_synt_N Pfam Description: Chalcone and stilbene synthases N-terminal domain
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
MVMAGASSLDEIRQAQRADGPAGILAIGTANPENHVLQAEYPDYYFRITNSEHMTDLKEKFKRMCDKSTIRKRHMHLTEEFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 1733 - DNA, 1191 bp, Populus balsamifera subsp. trichocarpa
  misc_feature (1)..(1191): Ceres ANNOT ID no. 1471869
  misc_feature 193062:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggcaccgtcgattgaggagatcagaaaggcccagcgagccagtggtccagccaccatcctggccattggcaaggccaccccggccaactgtgtctcccaggctgactatcctgactactacttccggatcaccaacagtgaacacatgactgagttgaaggagaaattcaaacgcatgtgtgacaaatctatgatcaagaaacggtacatgcacctaacggaggagatactgaaagagaactctagcatgtgtgaatacatggctccgtctcttgatgcacgccaagacatggtggttgtggaggtgccaaagctaggaaaagaagcagcagctaaggctataaaagagtggggtcagccaaaatccaagatcacccaccttgtattctgtacaacctcaggtgtagacatgccaggtgctgactaccagctcaccaagctcctcggcctgcgttcctccgtaaagagattcatgatgtatcagcagggctgcttcgccggcgggaccgtccttcgcttagctaaggacttggctgagaacaacaagggctcacgcgttcttgttgtctgctctgagatcactgctgtcacttttcgtggaccatctgatactcacttggattcaatggtaggtcaagcgctttttggcgatggtgctgcagcagttattgtaggtgctgatcctgacacttccattgagcgtccattattccagattgtttcagccgcacaaaccatccttcctgactctgatggggccatcgatggacacttacgtgaggttggtttaacctttcatctgctaaaggatgttcctgggctaatctcaaagaacatagagaaaagcctggttgaagcattcgctccaattggtatcaacgattggaactccatattttggattgcacaccctggtggccccgcgattcttgaccaggttgagattaagctagatctaaaggaagagaaactgagagctacaagaaacgtcctgagtgattatggcaacatgtcaagtgcttgtgttttgtttatcttggacgagatgagaaacaagtctctcgaggaagggaaaagcacaaccggtgaagggcttgagtggggtgttttgtttggattcggaccaggactcaccgttgagacagtggtgttacacagcgttccagtagaacaaacaatttactcatga

SEQ ID NO: 1734 - protein, 396 aa, Populus balsamifera subsp. trichocarpa
  misc_feature (1)..(396): Ceres ANNOT ID no. 1471869
  misc_feature (239)..(389): Pfam Name: Chal_sti_synt_C Pfam Description: Chalcone and stilbene synthases C-terminal domain
  misc_feature (3)..(229): Pfam Name: Chal_sti_synt_N Pfam Description: Chalcone and stilbene synthases N-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 193216:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(396): Functional Homolog of  Ceres CLONE ID no. 38370 at SEQ ID NO. 1776 with e-value of 1.29E-180 and BLAST sequence identity of 85.8
MAPSIEEIRKAQRASGPATILAIGKATPANCVSQADYPDYYFRITNSEHMTELKEKFKRMCDKSMIKKRYMHLTEEILKENSSMCEYMAPSLDARQDMVVVEVPKLGKEAAAKAIKEWGQPKSKITHLVFCTTSGVDMPGADYQLTKLLGLRSSVKRFMMYQQGCFAGGTVLRLAKDLAENNKGSRVLVVCSEITAVTFRGPSDTHLDSMVGQALFGDGAAAVIVGADPDTSIERPLFQIVSAAQTILPDSDGAIDGHLREVGLTFHLLKDVPGLISKNIEKSLVEAFAPIGINDWNSIFWIAHPGGPAILDQVEIKLDLKEEKLRATRNVLSDYGNMSSACVLFILDEMRNKSLEEGKSTTGEGLEWGVLFGFGPGLTVETVVLHSVPVEQTIYS

SEQ ID NO: 1735 - DNA, 1176 bp, Populus balsamifera subsp. trichocarpa
  misc_feature (1)..(1176): Ceres ANNOT ID no. 1448032
  misc_feature 193359:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggtgaccgttgatgaaattcggaagtcgcaacgggcggagggtcctgccaccatcatggccataggaacatcaacccctccaaactgtgttgatcagagcacgtatcctgactattattttcgcatcacaaacagtgagcataaggcggagcttaaagaaaaattcaagcgaatgtgtgagaaatccatgatcaagaagcggtacatgtacttgactgaggagatcttgaaagaaaatcctagtgtgtgtgaatacatggcaccttcattggatgctagacaggacatggtggtggtggaggtaccaaagttagggaaagaagcagctaccaaggccatcaaggaatggggtcagcccaagtccaaaataactcatttggtgttttgcacaaccagtggtgtggacatgcccggggctgactatcagctcactaagcttttgggtctccgctcatcggtcaaacgttttatgatgtatcaacaaggttgttttgctggtggcacggtgctccgccttgctaaggacctcgccgagaacaacaaaggcgctcgtgtgctagtcgtgtgctctgaaataacagccgtgacatttcgaggccctagcgatactcatcttgatagccttgttggtcaagcattgtttggcgatggcgcagctgctcttgtaataggctctgatccagtgataggagtcgagaagcctttatttgagctagtctcagcagcccaaactattctacccgacagcgatggggctatagatggacatctccgtgaagttgggcttacatttcacctcctcaaggatgttcctgggcttatttcaaagaatgttgagaagagcctgactgaggcgttcaagcctctgggcatctcggactggaactcccttttctggatagcgcaccctggtggaccagcaattctagaccaggtggaggctaagttggcgctgaaaccagagaaactgcgagccactagacatgtgctgagtgagtatggaaatatgtcgagtgcctgtgttctgtttattttggatgagatgagaaagaaatctgctgaggatgggcttcaatctactggagaagggctggaatggggtgtgctttttgggtttgggcctgggctcactgttgagactgtggtgctccacagcgtggctccaacaatctag

SEQ ID NO: 1736 - protein, 391 aa, Populus balsamifera subsp. trichocarpa
  misc_feature (1)..(391): Ceres ANNOT ID no. 1448032
  misc_feature (2)..(228): Pfam Name: Chal_sti_synt_N Pfam Description: Chalcone and stilbene synthases N-terminal domain
  misc_feature (238)..(388): Pfam Name: Chal_sti_synt_C Pfam Description: Chalcone and stilbene synthases C-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 193513:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(391): Functional Homolog of  Ceres CLONE ID no. 38370 at SEQ ID NO. 1776 with e-value of 6.70E-179 and BLAST sequence identity of 85.9
MVTVDEIRKSQRAEGPATIMAIGTSTPPNCVDQSTYPDYYFRITNSEHKAELKEKFKRMCEKSMIKKRYMYLTEEILKENPSVCEYMAPSLDARQDMVVVEVPKLGKEAATKAIKEWGQPKSKITHLVFCTTSGVDMPGADYQLTKLLGLRSSVKRFMMYQQGCFAGGTVLRLAKDLAENNKGARVLVVCSEITAVTFRGPSDTHLDSLVGQALFGDGAAALVIGSDPVIGVEKPLFELVSAAQTILPDSDGAIDGHLREVGLTFHLLKDVPGLISKNVEKSLTEAFKPLGISDWNSLFWIAHPGGPAILDQVEAKLALKPEKLRATRHVLSEYGNMSSACVLFILDEMRKKSAEDGLQSTGEGLEWGVLFGFGPGLTVETVVLHSVAPTI

SEQ ID NO: 1737 - DNA, 1176 bp, Populus balsamifera subsp. trichocarpa
  misc_feature (1)..(1176): Ceres ANNOT ID no. 1448031
  misc_feature 193656:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggtgaccgttgatgaaattaggaagacgcaacgggcggagggtcctgccaccatcatggccataggaacatcgacccctccaaactgtgttgatcaaagcgcgtaccctgactattattttcgcatcacaaacagtgagcataaggcggagcttaaagaaaaattcaagcgaatgtgtgagaaatccatgatcaagaagcggtacatgtacttgactgaggagatcttgaaagaaaatcctagtgtgtgtgaatacatggcgccttcattggatgctagacaggacatggtggtggtcgaggtaccaaggttagggaaagaagcagctaccaaggccatcaaggaatggggtcagcccaagtccaaaataactcatttggtgttttgcacaactagtggtgtggacatgcccggggctgactatcagctcactaagcttttaggtctccgctcatcggtcaaacgttttatgatgtatcaacaaggttgttttgctggtggcacggtgctccgtcttgctaaggacctcgccgagaacaacaaaggcgctcgtgtgctagtcgtgtgctctgaaataacagccgtgacatttcgaggccctagcgatactcatcttgatagccttgttggtcaagcattgtttggcgatggcgcagctgctcttataataggctctgacccagtgataggagtcgagaagcctttatttgagctagtctcagcagcccaaactattctacccgacagcgatggggctatagatggacatctccgtgaagttgggcttacatttcacctcctcaaggatgttcctgggcttatttcaaagaatgttgagaagagcctgactgaggcgttcaagcctctgggcatctcggactggaactcccttttctggatagcgcaccctggtggaccggcaattctagaccaggtggaggctaagttggcgctgaaaccagagaaactgcgagccactagacatgtgctgagtgagtatggaaatatgtccagcgcatgtgtgctgtttattttggatgagatgagaaagaaatctgctgaggatgggctgcaatctactggagaagggctggaatggggtgtgctttttgggtttgggcctgggctcactgttgagactgtggtgctccacagtgtggctccaacaatctag

SEQ ID NO: 1738 - protein, 391 aa, Populus balsamifera subsp. trichocarpa
  misc_feature (1)..(391): Ceres ANNOT ID no. 1448031
  misc_feature (2)..(228): Pfam Name: Chal_sti_synt_N Pfam Description: Chalcone and stilbene synthases N-terminal domain
  misc_feature (238)..(388): Pfam Name: Chal_sti_synt_C Pfam Description: Chalcone and stilbene synthases C-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 193810:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(391): Functional Homolog of  Ceres CLONE ID no. 38370 at SEQ ID NO. 1776 with e-value of 1.39E-178 and BLAST sequence identity of 85.9
MVTVDEIRKTQRAEGPATIMAIGTSTPPNCVDQSAYPDYYFRITNSEHKAELKEKFKRMCEKSMIKKRYMYLTEEILKENPSVCEYMAPSLDARQDMVVVEVPRLGKEAATKAIKEWGQPKSKITHLVFCTTSGVDMPGADYQLTKLLGLRSSVKRFMMYQQGCFAGGTVLRLAKDLAENNKGARVLVVCSEITAVTFRGPSDTHLDSLVGQALFGDGAAALIIGSDPVIGVEKPLFELVSAAQTILPDSDGAIDGHLREVGLTFHLLKDVPGLISKNVEKSLTEAFKPLGISDWNSLFWIAHPGGPAILDQVEAKLALKPEKLRATRHVLSEYGNMSSACVLFILDEMRKKSAEDGLQSTGEGLEWGVLFGFGPGLTVETVVLHSVAPTI

SEQ ID NO: 1739 - DNA, 1176 bp, Populus balsamifera subsp. trichocarpa
  misc_feature (1)..(1176): Ceres ANNOT ID no. 1438060
  misc_feature 193953:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggtgaccgttgatgaaattcggaaggcgcagagggcagagggccctgccaccatcttggccattggaacatcaacccctccgaattgtgttgatcaaagcacctatcctgactattattttcgtatcaccaacagcgagcataaggtggagcttaaagaaaagttcaagcgaatgtgcgagaaatccatgatcaagaagaggtacatgcacttgactgaggagatcttgaaagaaaatcctagtgtgtgcgaatacatggcaccttcattggatgctaggcaggacatggtggtggtcgagataccaaagttgggcaaagaagcagctgccaaggccatcaaggaatggggccagcccaagtccaaaataacccatttggtcttttgcacaaccagtggtgttgacatgcccggggctgactatcaactcactaagctcttgggtcttcgctcatcagtaaaacgtttcatgatgtaccagcaaggttgttttgctggtgggacggtgctccgcctagctaaagaccttgctgaaaacaacaaaggtgctcgcgtgctagtcgtgtgctcagaaataacagcagtgacatttcgtggccctagtgacacccacctcgatagtcttgtgggtcaagcgttgtttggtgacggcgcagctgctatcataataggctcggatcctgtgctgggggtcgagaagcctttgtttgagctggtgtctgccgcccagactattctacccgatagtgagggggctatagatggacatcttcgcgaagttgggcttacatttcaccttctcaaggatgtgcccgggcttatttcaaaaaacgtcgaaaagagtctaaccgaggctttcaagcccttgggcatctcggattggaactcccttttctggattgcgcaccctggtgggcccgcaattctggaccaggtggaggctaagttggagcttaaacctgaaaaactgcgagccactcgacaagtactggctgactatggtaacatgtccagtgcatgtgtgctatttattttggacgagatgaggaagaaatctgccaaggatgggcttaaatctactggagaagggttggaatggggcgtccttttcgggttcgggcctgggcttactgttgagacagtggtgctccacagtctgcctgccacaatttag

SEQ ID NO: 1740 - protein, 391 aa, Populus balsamifera subsp. trichocarpa
  misc_feature (1)..(391): Ceres ANNOT ID no. 1438060
  misc_feature (2)..(228): Pfam Name: Chal_sti_synt_N Pfam Description: Chalcone and stilbene synthases N-terminal domain
  misc_feature (238)..(388): Pfam Name: Chal_sti_synt_C Pfam Description: Chalcone and stilbene synthases C-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 194107:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(391): Functional Homolog of  Ceres CLONE ID no. 38370 at SEQ ID NO. 1776 with e-value of 1.39E-178 and BLAST sequence identity of 85.4
MVTVDEIRKAQRAEGPATILAIGTSTPPNCVDQSTYPDYYFRITNSEHKVELKEKFKRMCEKSMIKKRYMHLTEEILKENPSVCEYMAPSLDARQDMVVVEIPKLGKEAAAKAIKEWGQPKSKITHLVFCTTSGVDMPGADYQLTKLLGLRSSVKRFMMYQQGCFAGGTVLRLAKDLAENNKGARVLVVCSEITAVTFRGPSDTHLDSLVGQALFGDGAAAIIIGSDPVLGVEKPLFELVSAAQTILPDSEGAIDGHLREVGLTFHLLKDVPGLISKNVEKSLTEAFKPLGISDWNSLFWIAHPGGPAILDQVEAKLELKPEKLRATRQVLADYGNMSSACVLFILDEMRKKSAKDGLKSTGEGLEWGVLFGFGPGLTVETVVLHSLPATI

SEQ ID NO: 1741 - DNA, 1173 bp, Populus balsamifera subsp. trichocarpa
  misc_feature (1)..(1173): Ceres ANNOT ID no. 1438061
  misc_feature 194250:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggtgaccgtcgacgaagttcggaaggctcaacgggcagagggccctgccgtgatcctggctatcggaacatcaacccctccaaactgtgttgatcaaagcacgtaccctgactactactttcgcatcacaaacagtgagcataaggtcgagcttaaagaaaagttcaagcgaatgtgcgagaaatccatgatcaagaagaggtacatgcacttgactgaggagatcttgaaagaaaatcctagtgtgtgcgaatacatggcaccttcattggatgctaggcaggacatggtggtggtcgaggtaccaaagttgggcaaagaagcagctgccaaggccatcaaggaatggggccagcccaagtccaaaataacccatttggtcttttgcacaaccagtggtgttgacatgcccggggctgactatcaactcactaagctcttgggtctccgctcatcggtaaaacgtttcatgatgtaccagcaaggttgttttgctggtgggacggtgctccgcctagctaaagaccttgccgagaacaacaaaggtgctcgtgtgctagtcgtgtgctcagaaataacagcagtgacatttcgtggtcctagtgacactcaccttgatagccttgtgggtcaagcgttgtttggcgacggcgcagctgctatcataataggctcggaccctgtgctgggggtcgagaagcctttgtttgagctggtgtctgccgcccagactattctacccgatagtgatggggctatagatggacatcttcgtgaagttgggcttacatttcaccttctcaaggatgtgcccgggcttatttcaaaaaatattgaaaagagtctaaccgaggctttcaagcccttgggcatctcggattggaactcccttttctggattgcgcaccctggtgggcccgcaattctggaccaggtggaggctaagttggagcttaaacctgaaaaactgcgagccactcgacaagtactggctgactatggtaacatgtccagtgcatgtgtgctatttattttggacgagatgaggaagaaatctgccaaggacgggcttaaatctactggagaagggttggaatggggcgtccttttcgggttcgggcctgggcttactgttgagactgtcgtgctccatagtgtggcttctatctag

SEQ ID NO: 1742 - protein, 390 aa, Populus balsamifera subsp. trichocarpa
  misc_feature (1)..(390): Ceres ANNOT ID no. 1438061
  misc_feature (2)..(228): Pfam Name: Chal_sti_synt_N Pfam Description: Chalcone and stilbene synthases N-terminal domain
  misc_feature (238)..(388): Pfam Name: Chal_sti_synt_C Pfam Description: Chalcone and stilbene synthases C-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 194404:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(390): Functional Homolog of  Ceres CLONE ID no. 38370 at SEQ ID NO. 1776 with e-value of 1.39E-178 and BLAST sequence identity of 86.2
MVTVDEVRKAQRAEGPAVILAIGTSTPPNCVDQSTYPDYYFRITNSEHKVELKEKFKRMCEKSMIKKRYMHLTEEILKENPSVCEYMAPSLDARQDMVVVEVPKLGKEAAAKAIKEWGQPKSKITHLVFCTTSGVDMPGADYQLTKLLGLRSSVKRFMMYQQGCFAGGTVLRLAKDLAENNKGARVLVVCSEITAVTFRGPSDTHLDSLVGQALFGDGAAAIIIGSDPVLGVEKPLFELVSAAQTILPDSDGAIDGHLREVGLTFHLLKDVPGLISKNIEKSLTEAFKPLGISDWNSLFWIAHPGGPAILDQVEAKLELKPEKLRATRQVLADYGNMSSACVLFILDEMRKKSAKDGLKSTGEGLEWGVLFGFGPGLTVETVVLHSVASI

SEQ ID NO: 1743 - DNA, 1335 bp, Populus balsamifera subsp. trichocarpa
  misc_feature (1)..(1335): Ceres ANNOT ID no. 1448030
  misc_feature 194547:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggtgaccgtcgatgaggttcggaaggggcaacgggcagagggtcctgccacgatcatggccattggaacatcaaaccctccgaactgtgttgatcaaagcacctaccctgactactactttcgcgtcacaaacagtgagcatagggcggaacttaaagaaaaattcaagcgaatgtgcgagaagtccatgatcaagaagcggtacatctacttgaccgaggacatgttgaaggaaaatcctgatatgcgcgcctacatggcaccttcattggatgccaggcaagatatggtggtggtggaggtaccaaagttaggcaaagaagcagctaccaaggccatcaaggaatggggacagtccaagtccaaaataactcatctagtgttttgcacaaccagtggtgtggacatgcccggggctgactatcagctcactaaacttttaggccttcgtccatcagtcaaacgtttgatgatgtatcaacaaggttgttttgctggtggcacggtgctccgcctagctaaggacctcgccgaaaacaacaaaggtgctcgtgtgttagtcgtgtgctctgaaataacagccattatatttcgaggccctaacgatacccatcttgatagccttattggtcaagcattgttcggtgatggcgcggctgctatcataataggctctgacccagtggtaggagtcgagaagcctttatttgagatagtctctgcagcccaaactattctacccaacagcgctggggctatagatggacatctccgtgaagccgggcttacatttcatcttctcaaggatgttcccgggcttatttcaaataatgttgagaagagcctgacggaggcgttcaagcctctaggcatctcggactggaactctcttttctggatagcgcaccctggtggaccagcaattctagaccaggtggaggctaagttggggctgaaaccagagaaactgcgagccactagacatgtgctgagtgagtatggaaatatgtcgagcgcatgtgtgctgtttattctggatgagatgagaaagaaatctgctgaggatgggctgcaatctactggagaagggctggaatggggtgtgctttttgggtttgggcctgggctcactgttgagactgtggtgctccacaagtatgtctcttttgagagcaccaataaggagtgggggaaagagtcgaggtggttgtgtttggatttaaaaagggcagggcttggcatagcagggtatggtgggattacaagccccaggctacggacaattgatgttgaggctgctatgccctgtcacagagaattccataaacagtaa

SEQ ID NO: 1744 - protein, 444 aa, Populus balsamifera subsp. trichocarpa
  misc_feature (1)..(444): Ceres ANNOT ID no. 1448030
  misc_feature (2)..(228): Pfam Name: Chal_sti_synt_N Pfam Description: Chalcone and stilbene synthases N-terminal domain
  misc_feature (238)..(388): Pfam Name: Chal_sti_synt_C Pfam Description: Chalcone and stilbene synthases C-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 194707:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(444): Functional Homolog of  Ceres CLONE ID no. 38370 at SEQ ID NO. 1776 with e-value of 9.10E-175 and BLAST sequence identity of 83.8
MVTVDEVRKGQRAEGPATIMAIGTSNPPNCVDQSTYPDYYFRVTNSEHRAELKEKFKRMCEKSMIKKRYIYLTEDMLKENPDMRAYMAPSLDARQDMVVVEVPKLGKEAATKAIKEWGQSKSKITHLVFCTTSGVDMPGADYQLTKLLGLRPSVKRLMMYQQGCFAGGTVLRLAKDLAENNKGARVLVVCSEITAIIFRGPNDTHLDSLIGQALFGDGAAAIIIGSDPVVGVEKPLFEIVSAAQTILPNSAGAIDGHLREAGLTFHLLKDVPGLISNNVEKSLTEAFKPLGISDWNSLFWIAHPGGPAILDQVEAKLGLKPEKLRATRHVLSEYGNMSSACVLFILDEMRKKSAEDGLQSTGEGLEWGVLFGFGPGLTVETVVLHKYVSFESTNKEWGKESRWLCLDLKRAGLGIAGYGGITSPRLRTIDVEAAMPCHREFHKQ

SEQ ID NO: 1745 - DNA, 1131 bp, Populus balsamifera subsp. trichocarpa
  misc_feature (1)..(1131): Ceres ANNOT ID no. 1437831
  misc_feature 194859:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
atggcatccattctagctattggcactgcaaatccacccaactgtttcgaccaggctgactatccagacttctacttccgagtcactaaaagcgagcacatgacacagttaaaggacaagttcaagagaatatgtgaaaaatccaaaataaggaaacgttacatgtatatcaccgaagatactatcaagaagaacccaagcttaagcacctacgatgccgcgtccctcgatgcgcgtcaagaaattctggtcactgaggtacccaagctcggcaaggaagcagcattgaaggccattgaagaatggggccagcccaaatcaaagatcacccaccttatattttgcacttcttcaggtacccatatgccaggtgcagatcatgagcttactaagctccttggccttgaacgttctgtcaagagattcatgatgtatcaacaaggctgcttcacagcagccctagccctccgcctttccaaagaccttgctgagaataatcccggggcacgtgttctcatcgtgtgttctgagaacatgactgtttgtttccgagcaccatctgagactcacttggatattcttgtaggctctgcgattttctctgacggtgctgctgctatcattgttggggctgatcctgacacagctaccgagcgcccattatttcaacttgtgtcagccgagcagtgtattgttcctgactcggatgatggaatagttggtcacatacgtgaaatggggatttcctattacttgcataaaatggtgcccaaaatcgttgcggaaggcgctgcgcaatgcttggtggagacattcaatgctcgatatgggatcaaggactggaattctctgttttacgttgtccatcctggaggtacaggcgttttgaacaagtttgaagagcacattggcttgacgaaagataaattgagagcatctcggcatgtgctatctgagtatggaaacatgtggggtccaagtatgttcttcgttcttgatgagatgaggagaagatcagccaaggaagggaaagccaccactggagaaggattggatctaggtgtgctgttcgggttcggccctggcgtaactatcgagaccatagtgctccgtagtttcgctacggattga

SEQ ID NO: 1746 - protein, 376 aa, Populus balsamifera subsp. trichocarpa
  misc_feature (1)..(376): Ceres ANNOT ID no. 1437831
  misc_feature (2)..(213): Pfam Name: Chal_sti_synt_N Pfam Description: Chalcone and stilbene synthases N-terminal domain
  misc_feature (223)..(374): Pfam Name: Chal_sti_synt_C Pfam Description: Chalcone and stilbene synthases C-terminal domain
  misc_feature: SWISSPROT Homolog: CHSY_ARATH Chalcone synthase (EC 2.3.1.74) (Naringenin-chalcone synthase) (TRANSPARENT TESTA 4 protein) with e-value of 2.3e-211 and BLAST sequence identity of 100.0
  misc_feature: SWISSPROT Homolog: CHSY_CARAN Chalcone synthase (EC 2.3.1.74) (Naringenin-chalcone synthase) with e-value of 1.6e-203 and BLAST sequence identity of 95.7
  misc_feature: SWISSPROT Homolog: CHS3_SINAL Chalcone synthase 3 (EC 2.3.1.74) (Naringenin-chalcone synthase 3) with e-value of 1.8e-202 and BLAST sequence identity of 95.4
  misc_feature: SWISSPROT Homolog: CHSY_ARAAL Chalcone synthase (EC 2.3.1.74) (Naringenin-chalcone synthase) with e-value of 2.9e-202 and BLAST sequence identity of 96.7
  misc_feature: SWISSPROT Homolog: CHSY_MATIN Chalcone synthase (EC 2.3.1.74) (Naringenin-chalcone synthase) with e-value of 3.4e-201 and BLAST sequence identity of 94.9
  misc_feature 195011:<222: Transcription Factor
  misc_feature: Phenotype: WHOLE SEEDLING - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: SEED - Light Color Useful for modifying fiber content in seed
  misc_feature: Phenotype: FLOWER - Other Useful for making ornamental plants with modified flowers
  misc_feature (1)..(376): Functional Homolog of  Ceres CLONE ID no. 38370 at SEQ ID NO. 1776 with e-value of 1.09E-130 and BLAST sequence identity of 64.3
MASILAIGTANPPNCFDQADYPDFYFRVTKSEHMTQLKDKFKRICEKSKIRKRYMYITEDTIKKNPSLSTYDAASLDARQEILVTEVPKLGKEAALKAIEEWGQPKSKITHLIFCTSSGTHMPGADHELTKLLGLERSVKRFMMYQQGCFTAALALRLSKDLAENNPGARVLIVCSENMTVCFRAPSETHLDILVGSAIFSDGAAAIIVGADPDTATERPLFQLVSAEQCIVPDSDDGIVGHIREMGISYYLHKMVPKIVAEGAAQCLVETFNARYGIKDWNSLFYVVHPGGTGVLNKFEEHIGLTKDKLRASRHVLSEYGNMWGPSMFFVLDEMRRRSAKEGKATTGEGLDLGVLFGFGPGVTIETIVLRSFATD

SEQ ID NO: 1747 - protein, 441 aa, Arabidopsis thaliana
  misc_feature (1)..(441): Ceres CLONE ID no. 38419
  misc_feature (8)..(441): Pfam Name: Actin Pfam Description: Actin
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 1748 - DNA, 1263 bp, Populus balsamifera subsp. trichocarpa
  misc_feature (1)..(1263): Ceres ANNOT ID no. 1542971
  misc_feature 195333:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtacggtggtgatgaagtatcagctatagtcattgacttgggctcacacacttgcaaagttggttatgccggcgaggacgcaccgaaggccgtctttccttctgttgttgggtcgacggatcaaatggacgttgatgacactacaagcaaatgtaagttatatgtaggatctcaggctttagggtttcgtcgagaccatatggaggtgttatcaccttttaaggatgggatcgttgctgactgggatatggttgacaacatatggaatcatgctttcagagagtgtctattgattgacccaaaggagcacccgatgctacttgcagaaccttcatccaacagtcaacaacagagagaaaggacagcagagcttatttttgaaaagtacaatgttcctgcattatttttggccaagaatgctgttctaacatcttttgcatcaggacgtgctacctcgctagttgttgatggtggtggaggatcaactacaattgccccagtccatgatggttatgttcttcaaaaggcagtggcctcttctcctattggaggagaacttcttactgattgcttgctgaaaagcttggagagcaaaggtgtcatgataaaaccaaggtactctttcaaaagaaaggaaatacagctgggtgtgtttcagacggtggatcttgattttccaagtacaactgaaagctatagactctactctcagagagtgattgcaagtgatatcaaggaatgtgtgtgtcgagccccagatacaccatatgatgaaagttcatactcaaacattccaatgactccatatgagcttcctgacggccagacaattgaaattggagctgatagattcaagattccagatattctattcaatccatccttgattcagacaattcctggtatggataattttgtggagattgcttctagtgctcgtggtttgccgcaaatggctattgaaagcattaataagtgtgatgttgatatccgaagagaactgtttagtagtatactgcttgctggtggaacagcatcaatgcaacagttgaaggaacgacttgagaaagatttgcttgaggagtctcctccagctgccagagttaaagtgctggctagtggaaatgcaactgaaaggagattcagtgtatggataggaggtagtatactggcatctcttggttcattccagcagacgtggttctccaagtctgagtatgaagagcatggggtgtcttatgtacaaagaaaatgcccttga

SEQ ID NO: 1749 - protein, 420 aa, Populus balsamifera subsp. trichocarpa
  misc_feature (1)..(420): Ceres ANNOT ID no. 1542971
  misc_feature (8)..(420): Pfam Name: Actin Pfam Description: Actin
  misc_feature: SWISSPROT Homolog: ACL6A_MOUSE Actin-like protein 6A (53 kDa BRG1-associated factor A) (Actin-related protein Baf53a) with e-value of 3.6e-94 and BLAST sequence identity of 41.8
  misc_feature: SWISSPROT Homolog: ACL6A_HUMAN Actin-like protein 6A (53 kDa BRG1-associated factor A) (Actin-related protein Baf53a) (ArpNbeta) with e-value of 5.9e-94 and BLAST sequence identity of 42.2
  misc_feature: SWISSPROT Homolog: ACL6B_MOUSE Actin-like protein 6B (53 kDa BRG1-associated factor B) (Actin-related protein Baf53b) with e-value of 1.1e-92 and BLAST sequence identity of 41.1
  misc_feature: SWISSPROT Homolog: ACL6B_HUMAN Actin-like protein 6B (53 kDa BRG1-associated factor B) (Actin-related protein Baf53b) (ArpNalpha) with e-value of 2.3e-92 and BLAST sequence identity of 40.9
  misc_feature: SWISSPROT Homolog: ACT1_PNECA Actin-1 (Actin I) with e-value of 7.0e-82 and BLAST sequence identity of 44.0
  misc_feature 195518:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(420): Functional Homolog of  Ceres CLONE ID no. 38419 at SEQ ID NO. 1791 with e-value of 1.09E-180 and BLAST sequence identity of 79.0
MYGGDEVSAIVIDLGSHTCKVGYAGEDAPKAVFPSVVGSTDQMDVDDTTSKCKLYVGSQALGFRRDHMEVLSPFKDGIVADWDMVDNIWNHAFRECLLIDPKEHPMLLAEPSSNSQQQRERTAELIFEKYNVPALFLAKNAVLTSFASGRATSLVVDGGGGSTTIAPVHDGYVLQKAVASSPIGGELLTDCLLKSLESKGVMIKPRYSFKRKEIQLGVFQTVDLDFPSTTESYRLYSQRVIASDIKECVCRAPDTPYDESSYSNIPMTPYELPDGQTIEIGADRFKIPDILFNPSLIQTIPGMDNFVEIASSARGLPQMAIESINKCDVDIRRELFSSILLAGGTASMQQLKERLEKDLLEESPPAARVKVLASGNATERRFSVWIGGSILASLGSFQQTWFSKSEYEEHGVSYVQRKCP

SEQ ID NO: 1750 - DNA, 1266 bp, Populus balsamifera subsp. trichocarpa
  misc_feature (1)..(1266): Ceres ANNOT ID no. 1521332
  misc_feature 195702:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtacggtggtgatgaagtgtcagctatagtcattgacttgggttctcacacttgcaaagctggttatgccggcgaggacgcacccaaggccgtctttccttctgttagtctctacatctcatgttttcttgatacatggataactactgctcaggttgtgggatcaattgatcaaatggatgttgatgacatgacaagcaacgagaagaatgctgctgtagattctaaaaataatgtcaaagattctgagaaagggaagggaaaacgtaaattatttgtaggatctcaggccttagggtttcgtcgggaccatatggaggtgttatccccttttaaggatgggattgttgctgactgggatattgtggatagcatatgggatcatgctttcagggagtgtctattgattgatccaaaggagcatccaatgctacttgcagaaccttcatccaacagtcaacaacagagagaaagtggtggaggatcaactacaattgcaccagtccatgatggttatgttattcaaaaggctgtggccttttctcctattgggggagaacttcttactgattgcttgatgaaaagcttggagagcaaaggtgtcatgataaaaccaaggtactctttcaaaaggaaggaaatacagccgggcgtgtttcagactgtggatcttgattttacaaatacaactgacagctacagactctactctcagagagtgattgcaagtgatatcaaggaatgtgtgtgtcgtgcaccggatacgccctatgatgaaagttcatactcaaacattccaatgactccatatgagcttccggatggccagacaattgaaattggagctgatagattcaagattccagatattctattcaatccatccttggtccagacaattcctggtatggataattttgtggagattgctcctagtgttcgcggtttgccacaaatggttattgaaagcattaataagtgtgatgttgatattcgaagagaactgttcagtagtatactgcttgctggtggaacagcatcaatgcaacagttgaaggaacggcttgagaaagatttgcttgaggagtctcctcaagctgccagagttaaagtgctggctagtggaaatgcaactgaaaggagattcagtgtctggataggagggagtatattggcatctcttggttcattccagcagatgtggttctccaaggccgagtatgaagagcatggggcgtcttatgtacagagaaaatgcccttga

SEQ ID NO: 1751 - protein, 421 aa, Populus balsamifera subsp. trichocarpa
  misc_feature (1)..(421): Ceres ANNOT ID no. 1521332
  misc_feature (159)..(205): Pfam Name: Actin Pfam Description: Actin
  misc_feature: SWISSPROT Homolog: ACL6A_MOUSE Actin-like protein 6A (53 kDa BRG1-associated factor A) (Actin-related protein Baf53a) with e-value of 3.6e-94 and BLAST sequence identity of 41.8
  misc_feature: SWISSPROT Homolog: ACL6A_HUMAN Actin-like protein 6A (53 kDa BRG1-associated factor A) (Actin-related protein Baf53a) (ArpNbeta) with e-value of 5.9e-94 and BLAST sequence identity of 42.2
  misc_feature: SWISSPROT Homolog: ACL6B_MOUSE Actin-like protein 6B (53 kDa BRG1-associated factor B) (Actin-related protein Baf53b) with e-value of 1.1e-92 and BLAST sequence identity of 41.1
  misc_feature: SWISSPROT Homolog: ACL6B_HUMAN Actin-like protein 6B (53 kDa BRG1-associated factor B) (Actin-related protein Baf53b) (ArpNalpha) with e-value of 2.3e-92 and BLAST sequence identity of 40.9
  misc_feature: SWISSPROT Homolog: ACT1_PNECA Actin-1 (Actin I) with e-value of 7.0e-82 and BLAST sequence identity of 44.0
  misc_feature 195887:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(421): Functional Homolog of  Ceres CLONE ID no. 38419 at SEQ ID NO. 1791 with e-value of 6.90E-161 and BLAST sequence identity of 77.1
MYGGDEVSAIVIDLGSHTCKAGYAGEDAPKAVFPSVSLYISCFLDTWITTAQVVGSIDQMDVDDMTSNEKNAAVDSKNNVKDSEKGKGKRKLFVGSQALGFRRDHMEVLSPFKDGIVADWDIVDSIWDHAFRECLLIDPKEHPMLLAEPSSNSQQQRESGGGSTTIAPVHDGYVIQKAVAFSPIGGELLTDCLMKSLESKGVMIKPRYSFKRKEIQPGVFQTVDLDFTNTTDSYRLYSQRVIASDIKECVCRAPDTPYDESSYSNIPMTPYELPDGQTIEIGADRFKIPDILFNPSLVQTIPGMDNFVEIAPSVRGLPQMVIESINKCDVDIRRELFSSILLAGGTASMQQLKERLEKDLLEESPQAARVKVLASGNATERRFSVWIGGSILASLGSFQQMWFSKAEYEEHGASYVQRKCP

SEQ ID NO: 1752 - DNA, 1368 bp, Populus balsamifera subsp. trichocarpa
  misc_feature (1)..(1368): Ceres ANNOT ID no. 1467961
  misc_feature 196071:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtacggtggtgatgaagtgtcagctatagtcattgacttgggttctcacacttgcaaagctggttatgccggcgaggacgcacccaaggccgtctttccttctgttagtctctacatctcatgttttcttgatacatggataactactgctcaggttgtgggatcaattgatcaaatggatgttgatgacatgacaagcaacgagaagaatgctgctgtagattctaaaaataatgtcaaagattctgagaaagggaagggaaaacgtaaattatttgtaggatctcaggccttagggtttcgtcgggaccatatggaggtgttatccccttttaaggatgggattgttgctgactgggatattgtggatagcatatgggatcatgctttcagggagtgtctattgattgatccaaaggagcatccaatgctacttgcagaaccttcatccaacagtcaacaacagagagaaagtggtggaggatcaactacaattgcaccagtccatgatggttatgttattcaaaaggctgtggccttttctcctattgggggagaacttcttactgattgcttgatgaaaagcttggagagcaaaggtgtcatgataaaaccaaggtactctttcaaaaggaaggaaatacagccgggcgtgtttcagactgtggatcttgattttacaaatacaactgacagctacagactctactctcagagagtgattgcaagtgatatcaaggaatgtgtgtgtcgtgcaccggatacgccctatgatgaaagttcatactcaaacattccaatgactccatatgagcttccggatggccagacaattgaaattggagctgatagattcaagattccagatattctattcaatccatccttggtccagacaattcctggtatggataattttgtggagattgctcctagtgttcgcggtttgccacaaatggttattgaaagcattaataagtgtgatgttgatattcgaagagaactgttcagtagtatactgcttgctggtggaacagcatcaatgcaacagttgaaggaacggcttgagaaagatttgcttgaggagtctcctcaagctgccagagttaaagtgctggctagtggaaatgcaactgaaaggagattcagtgtctggataggagggagtatattggcatctcttggttcattccagcagatgtggttctccaaggccgaattccaagcaagttcagggcatccactgccaccacgaaaaattagcttagattacattattatcatcatcattttcctgactttgcttaacattagctttgtatcagcattttccatcttgcatccccttcacgcatgccgtgactaa

SEQ ID NO: 1753 - protein, 455 aa, Populus balsamifera subsp. trichocarpa
  misc_feature (1)..(455): Ceres ANNOT ID no. 1467961
  misc_feature (159)..(205): Pfam Name: Actin Pfam Description: Actin
  misc_feature: SWISSPROT Homolog: ACL6A_MOUSE Actin-like protein 6A (53 kDa BRG1-associated factor A) (Actin-related protein Baf53a) with e-value of 3.6e-94 and BLAST sequence identity of 41.8
  misc_feature: SWISSPROT Homolog: ACL6A_HUMAN Actin-like protein 6A (53 kDa BRG1-associated factor A) (Actin-related protein Baf53a) (ArpNbeta) with e-value of 5.9e-94 and BLAST sequence identity of 42.2
  misc_feature: SWISSPROT Homolog: ACL6B_MOUSE Actin-like protein 6B (53 kDa BRG1-associated factor B) (Actin-related protein Baf53b) with e-value of 1.1e-92 and BLAST sequence identity of 41.1
  misc_feature: SWISSPROT Homolog: ACL6B_HUMAN Actin-like protein 6B (53 kDa BRG1-associated factor B) (Actin-related protein Baf53b) (ArpNalpha) with e-value of 2.3e-92 and BLAST sequence identity of 40.9
  misc_feature: SWISSPROT Homolog: ACT1_PNECA Actin-1 (Actin I) with e-value of 7.0e-82 and BLAST sequence identity of 44.0
  misc_feature 196258:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Varying Petiole Lengths Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(455): Functional Homolog of  Ceres CLONE ID no. 38419 at SEQ ID NO. 1791 with e-value of 6.09E-153 and BLAST sequence identity of 76.2
MYGGDEVSAIVIDLGSHTCKAGYAGEDAPKAVFPSVSLYISCFLDTWITTAQVVGSIDQMDVDDMTSNEKNAAVDSKNNVKDSEKGKGKRKLFVGSQALGFRRDHMEVLSPFKDGIVADWDIVDSIWDHAFRECLLIDPKEHPMLLAEPSSNSQQQRESGGGSTTIAPVHDGYVIQKAVAFSPIGGELLTDCLMKSLESKGVMIKPRYSFKRKEIQPGVFQTVDLDFTNTTDSYRLYSQRVIASDIKECVCRAPDTPYDESSYSNIPMTPYELPDGQTIEIGADRFKIPDILFNPSLVQTIPGMDNFVEIAPSVRGLPQMVIESINKCDVDIRRELFSSILLAGGTASMQQLKERLEKDLLEESPQAARVKVLASGNATERRFSVWIGGSILASLGSFQQMWFSKAEFQASSGHPLPPRKISLDYIIIIIIFLTLLNISFVSAFSILHPLHACRD

SEQ ID NO: 1754 - protein, 549 aa, Arabidopsis thaliana
  misc_feature (1)..(549): Ceres CLONE ID no. 38529
  misc_feature (1)..(549): Also Known As Ceres CDNA ID no. 23396143
  misc_feature (1)..(549): Also Known As Ceres GEMINI ID 555F2
  misc_feature (9)..(137): Pfam Name: NAM Pfam Description: No apical meristem (NAM) protein
  misc_feature 196468:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MGRGSVTSLAPGFRFHPTDEELVRYYLKRKICNKPFKFDAISVTDVYKSEPWDLPDKSRLKSRDLEWYFFSMLNKKYRNGSKTNRATEMGYWKTTGKDREILNGSKVVGMKKTLVYHKGRAPRGERTNWVMHEYRLVDQDLDKTGVHQDAFVLCRIFQKSGSGPKNGEQYGAPFVEEEWEEEDDMTFVPDQEDLGSEDHVYVHMDDIDQKSENFVVYDAIPIPLNFIHGESSNNVETNYSDSINYIQQTGNYMDSGGYFEQPAESYEKDQKPIIRHRDGSLQNEGIGCGVQDKHSEILQSSDNIFGTDTSCYNDFPVESNYLIGEAFLDPNSNLLENDGLYLETNDLSSTQQDGFDFEDYLTFFDETFDPSQLMGNEDVFFDQEELFQEVETKELEKEETSRSKHVVEEKEKDEASCSKQVDADATEFEPDYKYPLLKKASHMLGAIPAPLANASEFPTKDAAIRLHAAQSSGSVHVTAGMITISDSNMGWSYGKNENLDLILSLGLVQGNTAPEKSGNSSAWAMLIFMCFWVLLLSVSFKVSILVSSR

SEQ ID NO: 1755 - DNA, 1674 bp, Populus balsamifera subsp. trichocarpa
  misc_feature (1)..(1674): Ceres ANNOT ID no. 1511049
  misc_feature 196599:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggccgtagtgactctgcaacttcactcgctccggggttccgattccacccgaccgatgaggaacttgtccggtactaccttaaacggaaggtcactaacaaaccgttccgcttcgacgccatctccgtcaccgatatttataaatctgagccgtgggatcttccagataagtcgaagttgaagagcagggatttagaatggtatttctttagcatgttggataagaagtatggaaatgggtctaagacgaatcgtgctactgagaaaggttactggaagacgactgggaaagatcggcctattcgtcagaactcacaagttgtggggatgaagaagacccttgtgtaccatcagggtcgagctccacgtggtcagcgctctaattgggtaatgcatgagtaccgccttgttgatgaggagctggagaaagcgggaattgctcaagatgcttttgtgctttgcaggattttccaaaagagcgggacaggaccaaagaatggggagcagtatggggcaccgtttattgaggaggaatgggatgatgatgaagtgcctctgttgccaagtgaagagatggtgttgactgaagaagcaccagttggtgatgatgcatacctggaaatgaatgagcttggccagaatttcgacactggaattacatctgaaaatactgcccttccacaaaacttctactatggggaagcaagcaactatgtggagcagcccagagacttcagtgaagatgatctaaagcccatgttaagaggggctgaaaatcgacatggtccatctctgccagctgaagaaaacttggacttacctgggcaatatgagacggatgcagtcaaaaatgaatacaacaacgcggagccaatgaataatgtgaatgctgttgatgtgaattatttgtttgatgaatcatacttggatgctctcaataatcttccacagagtgaaggacttttcctggaagctaatgatctttcaaatcctgtggagccagagactggcggagattcctcaggttttgacatgctggaagagtacctcaatttctttgatgctgatgatgagaatatgtcttttgatccctctgatatctttgcaagtgatactgctgtttccaatcaacaacctcctccccaagaggatgtcaagggtggaactgatgaagtgttgaaggcaatccaaaaaccattagaaacacatggcaatgttggtccatcctcatcaaagcaaaagccagaggctatggaatttgattctgatttcaaatatccattcatcaagcaggccagtcacatgttggggaaaattcctgcaccccctgcacttgcttccgagttcccttccaaggatgctgctcttcgcttacggtcagcatcttccagctcaattcatgttactgctggtgtgataagaatagaaaacatgagcttaggtggcaatgggacggagtggtcatttggcaagaatgggaatgttgatgtcatcctttcttttggtttgccacaacaagaaggtggtcctgccagttgggtgccgatgactagcttattctcaggcaaggcagagtctgtggtgtcacggggttggctcttcttgatgttcttttgggtcctaattctctctgtaagttataaaattgggacctgtatctgtgccaagtaa

SEQ ID NO: 1756 - protein, 557 aa, Populus balsamifera subsp. trichocarpa
  misc_feature (1)..(557): Ceres ANNOT ID no. 1511049
  misc_feature (10)..(138): Pfam Name: NAM Pfam Description: No apical meristem (NAM) protein
  misc_feature: SWISSPROT Homolog: NAC78_ARATH NAC domain-containing protein 78 (ANAC078) with e-value of 2.7e-192 and BLAST sequence identity of 66.8
  misc_feature: SWISSPROT Homolog: NAC74_ORYSA NAC domain-containing protein 74 (ONAC074) with e-value of 5.7e-48 and BLAST sequence identity of 48.4
  misc_feature: SWISSPROT Homolog: NAC2_ARATH NAC domain-containing protein 2 (ANAC002) with e-value of 1.2e-43 and BLAST sequence identity of 46.2
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 3.0e-42 and BLAST sequence identity of 44.9
  misc_feature: SWISSPROT Homolog: NAC76_ORYSA NAC domain-containing protein 76 (ONAC076) with e-value of 2.7e-41 and BLAST sequence identity of 43.9
  misc_feature 196727:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(557): Functional Homolog of  Ceres CLONE ID no. 38529 at SEQ ID NO. 1798 with e-value of 1.69E-134 and BLAST sequence identity of 57.5
MGRSDSATSLAPGFRFHPTDEELVRYYLKRKVTNKPFRFDAISVTDIYKSEPWDLPDKSKLKSRDLEWYFFSMLDKKYGNGSKTNRATEKGYWKTTGKDRPIRQNSQVVGMKKTLVYHQGRAPRGQRSNWVMHEYRLVDEELEKAGIAQDAFVLCRIFQKSGTGPKNGEQYGAPFIEEEWDDDEVPLLPSEEMVLTEEAPVGDDAYLEMNELGQNFDTGITSENTALPQNFYYGEASNYVEQPRDFSEDDLKPMLRGAENRHGPSLPAEENLDLPGQYETDAVKNEYNNAEPMNNVNAVDVNYLFDESYLDALNNLPQSEGLFLEANDLSNPVEPETGGDSSGFDMLEEYLNFFDADDENMSFDPSDIFASDTAVSNQQPPPQEDVKGGTDEVLKAIQKPLETHGNVGPSSSKQKPEAMEFDSDFKYPFIKQASHMLGKIPAPPALASEFPSKDAALRLRSASSSSIHVTAGVIRIENMSLGGNGTEWSFGKNGNVDVILSFGLPQQEGGPASWVPMTSLFSGKAESVVSRGWLFLMFFWVLILSVSYKIGTCICAK

SEQ ID NO: 1757 - DNA, 1683 bp, Populus balsamifera subsp. trichocarpa
  misc_feature (1)..(1683): Ceres ANNOT ID no. 1457826
  misc_feature 196866:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggccgtagtgactctgcaacttcactcgctccggggttccgattccacccgaccgatgaggaacttgtccggtactaccttaaacggaaggtcactaacaaaccgttccgcttcgacgccatctccgtcaccgatatttataaatctgagccgtgggatcttccagataagtcgaagttgaagagcagggatttagaatggtatttctttagcatgttggataagaagtatggaaatgggtctaagacgaatcgtgctactgagaaaggttactggaagacgactgggaaagatcggcctattcgtcagaactcacaagttgtggggatgaagaagacccttgtgtaccatcagggtcgagctccacgtggtcagcgctctaattgggtaatgcatgagtaccgccttgttgatgaggagctggagaaagcgggaattgctcaagatgcttttgtgctttgcaggattttccaaaagagcgggacaggaccaaagaatggggagcagtatggggcaccgtttattgaggaggaatgggatgatgatgaagtgcctctgttgccaagtgaagagatggtgttgactgaagaagcaccagttggtgatgatgcatacctggaaatgaatgagcttggccagaatttcgacactggaattacatctgaaaatactgcccttccacaaaacttctactatggggaagcaagcaactatgtggagcagcccagagacttcagtgaagatgatctaaagcccatgttaagaggggctgaaaatcgacatggtccatctctgccagctgaagaaaacttggacttacctgggcaatatgagacggatgcagtcaaaaatgaatacaacaacgcggagccaatgaataatgtgaatgctgttgatgtgaattatttgtttgatgaatcatacttggatgctctcaataatcttccacagagtgaaggacttttcctggaagctaatgatctttcaaatcctgtggagccagagactggcggagattcctcaggttttgacatgctggaagagtacctcaatttctttgatgctgatgatgagaatatgtcttttgatccctctgatatctttgcaagtgatactgctgtttccaatcaacaacctcctccccaagaggatgtcaagggtggaactgatgaagtgttgaaggcaatccaaaaaccattagaaacacatggcaatgttggtccatcctcatcaaagcaaaagccagaggctatggaatttgattctgatttcaaatatccattcatcaagcaggccagtcacatgttggggaaaattcctgcaccccctgcacttgcttccgagttcccttccaaggatgctgctcttcgcttacggtcagcatcttccagctcaattcatgttactgctggtgtgataagaatagaaaacatgagcttaggtggcaatgggacggagtggtcatttggcaagaatgggaatgttgatgtcatcctttcttttggtttgccacaacaagaaggtggtcctgccagttgggtgccgatgactagcttattctcaggcaaggcagagtctgtggtgtcacggggttggctcttcttgatgttcttttgggtcctaattctctctatgatggcctatggtgcagcaatcatgtatgttggcattgcggtttaa

SEQ ID NO: 1758 - protein, 560 aa, Populus balsamifera subsp. trichocarpa
  misc_feature (1)..(560): Ceres ANNOT ID no. 1457826
  misc_feature (10)..(138): Pfam Name: NAM Pfam Description: No apical meristem (NAM) protein
  misc_feature: SWISSPROT Homolog: NAC78_ARATH NAC domain-containing protein 78 (ANAC078) with e-value of 2.7e-192 and BLAST sequence identity of 66.8
  misc_feature: SWISSPROT Homolog: NAC74_ORYSA NAC domain-containing protein 74 (ONAC074) with e-value of 5.7e-48 and BLAST sequence identity of 48.4
  misc_feature: SWISSPROT Homolog: NAC2_ARATH NAC domain-containing protein 2 (ANAC002) with e-value of 1.2e-43 and BLAST sequence identity of 46.2
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 3.0e-42 and BLAST sequence identity of 44.9
  misc_feature: SWISSPROT Homolog: NAC76_ORYSA NAC domain-containing protein 76 (ONAC076) with e-value of 2.7e-41 and BLAST sequence identity of 43.9
  misc_feature 196996:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(560): Functional Homolog of  Ceres CLONE ID no. 38529 at SEQ ID NO. 1798 with e-value of 2.79E-132 and BLAST sequence identity of 58.2
MGRSDSATSLAPGFRFHPTDEELVRYYLKRKVTNKPFRFDAISVTDIYKSEPWDLPDKSKLKSRDLEWYFFSMLDKKYGNGSKTNRATEKGYWKTTGKDRPIRQNSQVVGMKKTLVYHQGRAPRGQRSNWVMHEYRLVDEELEKAGIAQDAFVLCRIFQKSGTGPKNGEQYGAPFIEEEWDDDEVPLLPSEEMVLTEEAPVGDDAYLEMNELGQNFDTGITSENTALPQNFYYGEASNYVEQPRDFSEDDLKPMLRGAENRHGPSLPAEENLDLPGQYETDAVKNEYNNAEPMNNVNAVDVNYLFDESYLDALNNLPQSEGLFLEANDLSNPVEPETGGDSSGFDMLEEYLNFFDADDENMSFDPSDIFASDTAVSNQQPPPQEDVKGGTDEVLKAIQKPLETHGNVGPSSSKQKPEAMEFDSDFKYPFIKQASHMLGKIPAPPALASEFPSKDAALRLRSASSSSIHVTAGVIRIENMSLGGNGTEWSFGKNGNVDVILSFGLPQQEGGPASWVPMTSLFSGKAESVVSRGWLFLMFFWVLILSMMAYGAAIMYVGIAV

SEQ ID NO: 1759 - DNA, 1671 bp, Populus balsamifera subsp. trichocarpa
  misc_feature (1)..(1671): Ceres ANNOT ID no. 1518508
  misc_feature 197138:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcagtagtgactcggcgacttcacttgctcccgggtttcgattccacccgacggatgaggagcttgtccgttactatcttaaacggaaggtcactaacaaaccgttccgtttggacgccatctccgtcaccgatgtttataaatctgagccgtgggatcttccagttaagtcaaaattgaaaagcagggatttagaatggtatttctttagtatgctggataagaagtatggaaatggggccaagacgaaccgggccactgagaaagggtactggaaaacgactgggaaagacaggcctattaattggaactcacgagttgtggggatgaagaagacccttgtgtatcatcagggtcgagccccacgtggtgagcgctcgaattgggtaatgcatgagtatcggcttgctgatgaggagctggagaaagcgggaattgctcaagatgcatttgtgctttgtaggattttccaaaagagcgggacagggccaaagaatggggagcagtatggggcaccgtttattgaggaggaatgggagaatgatgaggtgcctctcttgccaagtgaagagatggtgccagctggagaagcaccagttggtgatggctcatacctggaactgaatgagcttgaccagaattttgacagtggaattacatctgaaaatactgctcttccactaaacttctattatggggaaacaagcaaccatgtggaacagcccagtaacttcagtgacaatgatataaagcctgtgataagaggggcggagaatagaaatggtccagctccaccagctgaccaaaacttggatttacctggacaatatgagatggatgcagacaaaaaagaacacaatgcggagcctatcaatattgtgaatgctctcaatgcaaattatttgtttgatgaatcatacttggatgcacttggtgatcttccaccgagtgaaggatttttcctggaagctaatgatctttcaaagcctgtggagccagagaccggtggagattcctcaggttttgacatggtggatgagtacctcaatttctttgatgctgttgatgagaacatgtcttttgatccttctgatatcttcggaagtgagactgctgtttctgaccaacttccaccccaagaggatgtaaagggacaaactgaagaactgtccacggcaagcctaaacctattagaaacacatggcactattgatccatcttcatcaaagcaaaagccagaggccatgaaatttgattctggtgcagatttcaaatatccatttatcaagcaggctagtcacaggttggggaacattcctgcacctcctgcccttgcttctgagttcccttccaaggacgctgctcttcacttacatccagcatcttccagctcaattaacgttactgctggtatgataagaatagaaaacatgagcttaggtggcaatgagatggaatggtcatttggcaagaacgggaatgtcaatatcatcctttcttttggtttgccacaacaaggtggtcctgccagtctggtgccgatgaatagcttattcccaggcaaaacagagtcggtggtgtcgcgaggttggctgtacttgatgttcttttgggtcctaattctctctgtgagttataaaatcgggacctgtatctgtgccaagtaa

SEQ ID NO: 1760 - protein, 556 aa, Populus balsamifera subsp. trichocarpa
  misc_feature (1)..(556): Ceres ANNOT ID no. 1518508
  misc_feature (10)..(138): Pfam Name: NAM Pfam Description: No apical meristem (NAM) protein
  misc_feature: SWISSPROT Homolog: NAC78_ARATH NAC domain-containing protein 78 (ANAC078) with e-value of 2.7e-192 and BLAST sequence identity of 66.8
  misc_feature: SWISSPROT Homolog: NAC74_ORYSA NAC domain-containing protein 74 (ONAC074) with e-value of 5.7e-48 and BLAST sequence identity of 48.4
  misc_feature: SWISSPROT Homolog: NAC2_ARATH NAC domain-containing protein 2 (ANAC002) with e-value of 1.2e-43 and BLAST sequence identity of 46.2
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 3.0e-42 and BLAST sequence identity of 44.9
  misc_feature: SWISSPROT Homolog: NAC76_ORYSA NAC domain-containing protein 76 (ONAC076) with e-value of 2.7e-41 and BLAST sequence identity of 43.9
  misc_feature 197266:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(556): Functional Homolog of  Ceres CLONE ID no. 38529 at SEQ ID NO. 1798 with e-value of 1.60E-129 and BLAST sequence identity of 57.4
MGSSDSATSLAPGFRFHPTDEELVRYYLKRKVTNKPFRLDAISVTDVYKSEPWDLPVKSKLKSRDLEWYFFSMLDKKYGNGAKTNRATEKGYWKTTGKDRPINWNSRVVGMKKTLVYHQGRAPRGERSNWVMHEYRLADEELEKAGIAQDAFVLCRIFQKSGTGPKNGEQYGAPFIEEEWENDEVPLLPSEEMVPAGEAPVGDGSYLELNELDQNFDSGITSENTALPLNFYYGETSNHVEQPSNFSDNDIKPVIRGAENRNGPAPPADQNLDLPGQYEMDADKKEHNAEPINIVNALNANYLFDESYLDALGDLPPSEGFFLEANDLSKPVEPETGGDSSGFDMVDEYLNFFDAVDENMSFDPSDIFGSETAVSDQLPPQEDVKGQTEELSTASLNLLETHGTIDPSSSKQKPEAMKFDSGADFKYPFIKQASHRLGNIPAPPALASEFPSKDAALHLHPASSSSINVTAGMIRIENMSLGGNEMEWSFGKNGNVNIILSFGLPQQGGPASLVPMNSLFPGKTESVVSRGWLYLMFFWVLILSVSYKIGTCICAK

SEQ ID NO: 1761 - protein, 376 aa, Arabidopsis thaliana
  misc_feature (1)..(376): Ceres CLONE ID no. 38584
  misc_feature (151)..(367): Pfam Name: PAP_fibrillin Pfam Description: PAP_fibrillin
  misc_feature: Utility: MSX Useful for making plants tolerant to low nitrogen
  misc_feature: Phenotype: WHOLE PLANT - MSX Useful for making plants tolerant to low nitrogen
MATLFTVARPSSLLYVSSINPSKTFSPSISLKLNSLSFSFGYRPKPLRFSKIRSSLPSESESESDLDASAVTDEWGEKPGDANEPDSQPDNVTVNVITDEWGEKSGPELEESGTRFMESDPPRNEDEWGGEIGGETEADAGNGSAVSDPTWELKRCLADSVYGTELGFKAGSEVRAEVLELVNQLEALNPTPAPLENPELLDGNWVLLYTAFSELIPLLAAGSTPLLKVKSISQSIDTNNLIIDNSTTLSSPFADFSFSATASFEVRSPSRIEVSFKEGTLKPPVIKSSVDLPESVGVFGQQISLSLLKQSLNPLQDVAANISRALSGQPPLKLPFPGNRGSSWLLTTYLDKDLRISRGDGGLFVLAREGSSLLEL

SEQ ID NO: 1762 - DNA, 1110 bp, Populus balsamifera subsp. trichocarpa
  misc_feature (1)..(1110): Ceres ANNOT ID no. 1485549
  misc_feature: Utility: MSX Useful for making plants tolerant to low nitrogen
  misc_feature 197517:<222: Transcription Factor
  misc_feature: Phenotype: WHOLE PLANT - MSX Useful for making plants tolerant to low nitrogen
atggcactcttcttcacctcacactcctccctcttcctctccccttcgtcttccataaaccccaacaacccattccctctctccaaatccccacaactaccatccctctctttctcctgcaaatcctctaaaactctccgtttccatccccaaattactaaacaacccagattccctacccacctcacacgcacctcctcctctgttccgtcatctgacccggatccggaaccaaacccaactccagtaagtatcactgacgagtggggcgagaaggcagagcccgagcccgagtacccgaaagatgcggactcggatcctacgagaaatgatgacgagtggggggagcaatttgttgccgcgggaaatggcaccgcagcggcaccgagtaccagcagtgcggtggtcgtggagaaggatgggaggattgaggatttgaagaggtgtttggtagatacggtctacggcacggaatttgggtttcgggccaccccggagatccgggctgaagttttagagctggttaatcagttggaggctgtaaacccgacttcggcacctgtggatgctactggtgtgctcgatggaaaatgggtcttggtgtatactgcattttctgaactgttgccacttctggcagcaggtgctacacctttattgaaagtgaaaagcatatctcaaacaattgattccagcaatctatctattgtgaactcaactacattgtcaagcccttttgctactttctcttttagcgcatctgcaacttttgaggttcggactccttcaagaatacaggttgaatttaaggaaggtacactgcaacctccggaaataaattccaacatagatctcccagaaaatgttgaactatttgggcaaaagatcaatttgtctcctgtccagcaatctctcaatcctctgcaggaggcagcagcaaatattggaagaaccatttctggccagccaccacttaaggtacccattccaggcaaacaagcaagctcctggcttcttattacctaccttgatgaggatctccgtatctcaagaggggatggtggtctttttgttcttgctaaagaaggaagtcctcttctagaactgtag

SEQ ID NO: 1763 - protein, 369 aa, Populus balsamifera subsp. trichocarpa
  misc_feature (1)..(369): Ceres ANNOT ID no. 1485549
  misc_feature (144)..(360): Pfam Name: PAP_fibrillin Pfam Description: PAP_fibrillin
  misc_feature: SWISSPROT Homolog: PAP3_ARATH Probable plastid-lipid associated protein 3, (AtPap3) (Fibrillin 3) with e-value of 2.8e-197 and BLAST sequence identity of 100.0
  misc_feature: SWISSPROT Homolog: PAP3_BRACM Plastid lipid-associated protein 3, with e-value of 2.6e-146 and BLAST sequence identity of 78.8
  misc_feature: SWISSPROT Homolog: PAP3_ORYSA Probable plastid-lipid associated protein 3, with e-value of 5.4e-91 and BLAST sequence identity of 53.4
  misc_feature: SWISSPROT Homolog: PG1_PEA Plastoglobulin 1, with e-value of 1.1e-90 and BLAST sequence identity of 53.8
  misc_feature: SWISSPROT Homolog: PAP2_ORYSA Probable plastid-lipid-associated protein 2, (Fibrillin-like protein 2) with e-value of 2.8e-64 and BLAST sequence identity of 50.0
  misc_feature: Utility: MSX Useful for making plants tolerant to low nitrogen
  misc_feature 197629:<222: Transcription Factor
  misc_feature: Phenotype: WHOLE PLANT - MSX Useful for making plants tolerant to low nitrogen
  misc_feature (1)..(369): Functional Homolog of  Ceres CLONE ID no. 38584 at SEQ ID NO. 1805 with e-value of 1.19E-101 and BLAST sequence identity of 62.4
MALFFTSHSSLFLSPSSSINPNNPFPLSKSPQLPSLSFSCKSSKTLRFHPQITKQPRFPTHLTRTSSSVPSSDPDPEPNPTPVSITDEWGEKAEPEPEYPKDADSDPTRNDDEWGEQFVAAGNGTAAAPSTSSAVVVEKDGRIEDLKRCLVDTVYGTEFGFRATPEIRAEVLELVNQLEAVNPTSAPVDATGVLDGKWVLVYTAFSELLPLLAAGATPLLKVKSISQTIDSSNLSIVNSTTLSSPFATFSFSASATFEVRTPSRIQVEFKEGTLQPPEINSNIDLPENVELFGQKINLSPVQQSLNPLQEAAANIGRTISGQPPLKVPIPGKQASSWLLITYLDEDLRISRGDGGLFVLAKEGSPLLEL

SEQ ID NO: 1764 - DNA, 1122 bp, Populus balsamifera subsp. trichocarpa
  misc_feature (1)..(1122): Ceres ANNOT ID no. 1447057
  misc_feature: Utility: MSX Useful for making plants tolerant to low nitrogen
  misc_feature 197740:<222: Transcription Factor
  misc_feature: Phenotype: WHOLE PLANT - MSX Useful for making plants tolerant to low nitrogen
atggcactcctctacacctcacactcctccctcctgttctccccctcctcttccaaaaaacccaacaacccactccctctttccaaaaccccaccactaccatctctctctttcttccgtaaaccccctcaaaccctccgtttccttactcaaattactaaaaaacccaaattccggaccctccttacacacatctcctcttcctcctctgacccgacacctgactcagatcctgaaccaaactcacctccggtaggtatcactgacgagtggggtgagaaggcagaacccgaacttgaacctgaatacccgaaagctgcggacttggatcctccgagaaatgatgacgagtggggtggggaatttgttgccgtggaaaatggcaacgcagcggcaccgagttccagcagtgctgtggtcgtggagaaggatgagagggttgaggagttgaagaggggtttggtagatacggtctatggtactgattttgggtttcgggccagcccggaaatccgggctgaggctttggagttggttaatcagctggaggttgtaaatccgactccggcacctgtggatgctactggggtgcttgatggcaaatgggttttagtgtatactgcattttcagagctgttgccacttctggcagcaggcgctacacctttcttgaaagtgaaaagcatatctcaaacaattgatgctagcagtctatctatagtgaactcaaccacattgtcaggcccttttgctactttctcctttagcgcttctgctacttttgagtttcggactccttcaagaatacaggtggagtttaaggaaggcgtgctgcaacctccacagataaattccagcgtagaactcccagaaaatgttgatctttttgggcaaaagatcaatctgtctcccatccagcaatctcttggtcctctgcaggaggcagcagcaaatattggaagaaccatttctggccagccaccgcttaaggtacccattccaggcaaccgagcaagcacctggcttctcattacctaccttgatgaggatctccaaatctcaagaggggatggtggtcttttcgttcttgctaaagaaggaagccctcttctagaactgtag

SEQ ID NO: 1765 - protein, 373 aa, Populus balsamifera subsp. trichocarpa
  misc_feature (1)..(373): Ceres ANNOT ID no. 1447057
  misc_feature (148)..(364): Pfam Name: PAP_fibrillin Pfam Description: PAP_fibrillin
  misc_feature: SWISSPROT Homolog: PAP3_ARATH Probable plastid-lipid associated protein 3, (AtPap3) (Fibrillin 3) with e-value of 2.8e-197 and BLAST sequence identity of 100.0
  misc_feature: SWISSPROT Homolog: PAP3_BRACM Plastid lipid-associated protein 3, with e-value of 2.6e-146 and BLAST sequence identity of 78.8
  misc_feature: SWISSPROT Homolog: PAP3_ORYSA Probable plastid-lipid associated protein 3, with e-value of 5.4e-91 and BLAST sequence identity of 53.4
  misc_feature: SWISSPROT Homolog: PG1_PEA Plastoglobulin 1, with e-value of 1.1e-90 and BLAST sequence identity of 53.8
  misc_feature: SWISSPROT Homolog: PAP2_ORYSA Probable plastid-lipid-associated protein 2, (Fibrillin-like protein 2) with e-value of 2.8e-64 and BLAST sequence identity of 50.0
  misc_feature: Utility: MSX Useful for making plants tolerant to low nitrogen
  misc_feature 197852:<222: Transcription Factor
  misc_feature: Phenotype: WHOLE PLANT - MSX Useful for making plants tolerant to low nitrogen
  misc_feature (1)..(373): Functional Homolog of  Ceres CLONE ID no. 38584 at SEQ ID NO. 1805 with e-value of 5.30E-99 and BLAST sequence identity of 59.3
MALLYTSHSSLLFSPSSSKKPNNPLPLSKTPPLPSLSFFRKPPQTLRFLTQITKKPKFRTLLTHISSSSSDPTPDSDPEPNSPPVGITDEWGEKAEPELEPEYPKAADLDPPRNDDEWGGEFVAVENGNAAAPSSSSAVVVEKDERVEELKRGLVDTVYGTDFGFRASPEIRAEALELVNQLEVVNPTPAPVDATGVLDGKWVLVYTAFSELLPLLAAGATPFLKVKSISQTIDASSLSIVNSTTLSGPFATFSFSASATFEFRTPSRIQVEFKEGVLQPPQINSSVELPENVDLFGQKINLSPIQQSLGPLQEAAANIGRTISGQPPLKVPIPGNRASTWLLITYLDEDLQISRGDGGLFVLAKEGSPLLEL

SEQ ID NO: 1766 - protein, 387 aa, Arabidopsis thaliana
  misc_feature (1)..(387): Ceres CLONE ID no. 38625
  misc_feature (293)..(355): Pfam Name: CLP_protease Pfam Description: Clp protease
  misc_feature: Phenotype: WHOLE PLANT - Yellow-Green Viable 1 Useful for making lethal plants for genetic confinement systems
MATALVSPLTSQLNHEAVCSKFVLPKSPFISGSKLFSSNMPCSTVPRRTRRSHCFASAKDMSFDHIPKQFRGDNLKDGVMQNFKNVPQYFYGLNSAQMDMFMTEDSPVRRQAEKVTEESISSRNNYLNNGGIWSISGMNAADARRYSMSVQMYRGGGGGGGSERPRTAPPDLPSLLLDARICYLGMPIVPAVTELLVAQFMWLDYDNPTKPIYLYINSPGTQNEKMETVGSETEAYAIADTISYCKSDVYTINCGMAFGQAAMLLSLGKKGYRAVQPHSSTKLYLPKVNRSSGAAIDMWIKAKELDANTEYYIELLAKGTGKSKEQINEDIKRPKYLQAQAAIDYGIADKIADSQDSSFEKRDYDGTLAQRAMRPGGGSPAAPAGLR

SEQ ID NO: 1767 - DNA, 1170 bp, Populus balsamifera subsp. trichocarpa
  misc_feature (1)..(1170): Ceres ANNOT ID no. 1461141
  misc_feature 198060:<222: Transcription Factor
  misc_feature: Phenotype: WHOLE PLANT - Yellow-Green Viable 1 Useful for making lethal plants for genetic confinement systems
atggcaacttctctgctatctccactcgcagctccaaacccagaactggtatatccagctaccgggttgcaacagaagtcttcctttctcccaagcgccagcctctttttattaagcaatccgagaaatcaaagggtgcttcaacagcaaagatgctgctattacaagtccccttctgcatctgggaacccactgaatcatattcccactcagtttagagaagaaaatctcaaagatggattgatggaaaattataaaaatgtacctcaatctctttatggtcttactccttcacaaatggacatgttcatgactgaagataatcccattcgtcgtcagtcagggagtgtcacagagcaaagcatctcatctagaaagaactatctggatcacggagggatgtatagtgtatcaggcatgatggatcaaggtccttcaaaatatagtatgagcgtaagcatgtaccgtggagggggcagaggatatggaagacctgaatctgctcctccggatttgccttctttgctcttagatgctcggatatgctaccttggaatgccaattgtaccagctgtcacagagcttcttgttgctcaattcatgtatttggattatgaagacccttcaaagcctatatatctatatataaactcatctgggacacagaatgagaagatggagactgttggatctgaaactgaagcatatgccattgcagacatcatgtcttactgcaaatcaactatctataccgtgaattgtggcatggcatatggtcaagcagcaatgcttctatctcttggagccaagggttatcgcgctttacagccaaactcatccacaaaattatacttgcctaaagtcaaccgatcaagtggagctgcagtagatatgtggatcaaggccaaggaattggatgcgaatactgagtattatatcgagcttttagcaaaaggaactgggaaaccgaaggaagaacttgttaaagacatccagcgaccaaaatatctcaaagctcaagaagccatagattatgggattgcagacaagttacttagctcaaatgatgatgcatttgagaaacgggattatgatgcgttgcttgctcaaacaaaagccatgaaggcacaagctgctggtccaagagcagctccatcaggatctaggtga

SEQ ID NO: 1768 - protein, 389 aa, Populus balsamifera subsp. trichocarpa
  misc_feature (1)..(389): Ceres ANNOT ID no. 1461141
  misc_feature (167)..(355): Pfam Name: CLP_protease Pfam Description: Clp protease
  misc_feature: SWISSPROT Homolog: CLPR_SYNP7 Putative ATP-dependent Clp protease proteolytic subunit-like (Endopeptidase Clp-like) with e-value of 8.3e-40 and BLAST sequence identity of 45.0
  misc_feature: SWISSPROT Homolog: CLPR_SYNY3 Putative ATP-dependent Clp protease proteolytic subunit-like (Endopeptidase Clp-like) with e-value of 1.2e-38 and BLAST sequence identity of 44.2
  misc_feature: SWISSPROT Homolog: CLPP_AQUAE ATP-dependent Clp protease proteolytic subunit (EC 3.4.21.92) (Endopeptidase Clp) with e-value of 2.9e-28 and BLAST sequence identity of 40.9
  misc_feature: SWISSPROT Homolog: CLPP2_PROMA ATP-dependent Clp protease proteolytic subunit 2 (EC 3.4.21.92) (Endopeptidase Clp 2) with e-value of 1.1e-26 and BLAST sequence identity of 40.9
  misc_feature: SWISSPROT Homolog: CLPP_FUSNN ATP-dependent Clp protease proteolytic subunit (EC 3.4.21.92) (Endopeptidase Clp) with e-value of 1.5e-26 and BLAST sequence identity of 39.0
  misc_feature 198171:<222: Transcription Factor
  misc_feature: Phenotype: WHOLE PLANT - Yellow-Green Viable 1 Useful for making lethal plants for genetic confinement systems
  misc_feature (1)..(389): Functional Homolog of  Ceres CLONE ID no. 38625 at SEQ ID NO. 1810 with e-value of 2.40E-135 and BLAST sequence identity of 69.7
MATSLLSPLAAPNPELVYPATGLQQKSSFLPSASLFLLSNPRNQRVLQQQRCCYYKSPSASGNPLNHIPTQFREENLKDGLMENYKNVPQSLYGLTPSQMDMFMTEDNPIRRQSGSVTEQSISSRKNYLDHGGMYSVSGMMDQGPSKYSMSVSMYRGGGRGYGRPESAPPDLPSLLLDARICYLGMPIVPAVTELLVAQFMYLDYEDPSKPIYLYINSSGTQNEKMETVGSETEAYAIADIMSYCKSTIYTVNCGMAYGQAAMLLSLGAKGYRALQPNSSTKLYLPKVNRSSGAAVDMWIKAKELDANTEYYIELLAKGTGKPKEELVKDIQRPKYLKAQEAIDYGIADKLLSSNDDAFEKRDYDALLAQTKAMKAQAAGPRAAPSGSR

SEQ ID NO: 1769 - protein, 256 aa, Arabidopsis thaliana
  misc_feature (1)..(256): Ceres CLONE ID no. 38635
  misc_feature (202)..(252): Pfam Name: PHD Pfam Description: PHD-finger
  misc_feature: Phenotype: ROSETTE LEAVES - Curled 4 Useful for making ornamental plants with altered leaf shape
  misc_feature: Phenotype: ROSETTE LEAVES - Other Useful for making ornamental plants with modified leaves
MEGITHPIPRTVEEVFSDFRGRRAGLIKALTNDMVKFYQTCDPEKENLCLYGLPNETWEVNLPVEEVPPELPEPALGINFARDGMQEKDWVSLVAVHSDSWLLSVAFYFGARFGFGKNERKRLFQMINELPTIFEVVSGNAKQSKDLSVNNNNSKSKPSGVKSRQSESLTKVAKMSSPPPKEEEEEEDESEDESEDDEQGAVCGACGDNYGTDEFWICCDACEKWFHGKCVKITPAKAEHIKHYKCPTCSNKRARP

SEQ ID NO: 1770 - DNA, 834 bp, Populus balsamifera subsp. trichocarpa
  misc_feature (1)..(834): Ceres ANNOT ID no. 1489751
  misc_feature 198365:<222: Transcription Factor
  misc_feature: Phenotype: ROSETTE LEAVES - Curled 4 Useful for making ornamental plants with altered leaf shape
  misc_feature: Phenotype: ROSETTE LEAVES - Other Useful for making ornamental plants with modified leaves
atggagggaacaccgcatcctataccgcgtaccgttgaagaagtttttagtgatttcaaaggcagacgctctggtttaatcaaggctcttacttctgatgttgagaagttttaccagcagtgtgaccctggtggattgcagatctttgacattcagtttaaaatcacagcacatcatgatatcaaatttgagtttgcagataaggagaacttgtgtctctatggacttccaaatgagacatgggaagttaacctgcctgtggaggaggtgccccctgaacttcctgagcctgcactaggtataaattttgccagggatgggatgcaagagaaggactggttatcccttgttgcagttcacagtgattcatggttgcttgctgttgcattttattttggtgcacgttttgggtttggtaagaatgaaaggaagaggcttttccagatgataaatgagctccccacaatattcgaggccgtgtctggaaatgttaagcaacctaaggaccaaactgccactcacaacaacagtggcaaaagcaaatcaagtgggaagatgcaatcccggcaacctgagtcccagactaaggctataaaggtatctgcaccacccaaggaagactatgagagtggggaagaggaagaagaagacgatgaacagggtgctacttgtggagcatgtggtgaaagctatggaactgatgagttctggatttgctgtgatatgtgtgagaaatggttccatggaaaatgcgtcaagattacacctgccaaagctgagcacatcaagcagtacaagtgcccaagttgcagtggcaagagagctagggtttaa

SEQ ID NO: 1771 - protein, 277 aa, Populus balsamifera subsp. trichocarpa
  misc_feature (1)..(277): Ceres ANNOT ID no. 1489751
  misc_feature (223)..(273): Pfam Name: PHD Pfam Description: PHD-finger
  misc_feature: SWISSPROT Homolog: Y5621_ARATH PHD finger protein At5g26210 with e-value of 1.0e-98 and BLAST sequence identity of 71.5
  misc_feature 198438:<222: Transcription Factor
  misc_feature: Phenotype: ROSETTE LEAVES - Curled 4 Useful for making ornamental plants with altered leaf shape
  misc_feature: Phenotype: ROSETTE LEAVES - Other Useful for making ornamental plants with modified leaves
  misc_feature (1)..(277): Functional Homolog of  Ceres CLONE ID no. 38635 at SEQ ID NO. 1813 with e-value of 2.19E-109 and BLAST sequence identity of 82.8
MEGTPHPIPRTVEEVFSDFKGRRSGLIKALTSDVEKFYQQCDPGGLQIFDIQFKITAHHDIKFEFADKENLCLYGLPNETWEVNLPVEEVPPELPEPALGINFARDGMQEKDWLSLVAVHSDSWLLAVAFYFGARFGFGKNERKRLFQMINELPTIFEAVSGNVKQPKDQTATHNNSGKSKSSGKMQSRQPESQTKAIKVSAPPKEDYESGEEEEEDDEQGATCGACGESYGTDEFWICCDMCEKWFHGKCVKITPAKAEHIKQYKCPSCSGKRARV

SEQ ID NO: 1772 - DNA, 930 bp, Populus balsamifera subsp. trichocarpa
  misc_feature (1)..(930): Ceres ANNOT ID no. 1446209
  misc_feature 198532:<222: Transcription Factor
  misc_feature: Phenotype: ROSETTE LEAVES - Curled 4 Useful for making ornamental plants with altered leaf shape
  misc_feature: Phenotype: ROSETTE LEAVES - Other Useful for making ornamental plants with modified leaves
atggaggcaataccgcacccaataccgcgaactgttgaagaagtttttagtgattttaaaggaagacgctctggtttaatcaaggctctcactaccgatgttgagaagttttaccagcagtgtgaccctggtggtcagattggggaagatatctctaacctgaactttaaaagaaggttggagtttcaagatcatttctgcatttatagctgggtagggatttttggggatattgatactggttctcatgataaggagaacttgtgcctatatggactcccaaatgaaacatgggaagttaatctgcctgtggaggaggtgcctcctgagcttcctgagcctgcactaggtataaattttgctagggatgggatgcaagagaaagactggttatcccttgttgcagttcacagcgattcatggttgcttgctgttgcattttattttggtgcacgttttgggtttgggaagaatgaaagatggaatttgcttggtttgggcatgaactacacatggaaaacaaggaagaggcttttccagatgataaatgagctccccacaatattcgaggttgtgtccggaaatgttaagcaacctaaggaccaatctgccactcacaacaacagtggcaaaagcaaatcaagcgggaagatgcaatcccggcaacctgagtcccagactaaggcagtaaaggtatctgcaccacccaaggaagactatgagagtggggaagaggaagaagaagatgacgaacagggtgctacttgcggagcatgtggtgaaagctatggcactgatgaattctggatttgctgtgatatttgcgagaaatggttccatgggaaatgcgtcaagattacacctgccaaagctgagcatatcaagcagtacaagtgcccaagttgcagtggcaagagggctagagtttaa

SEQ ID NO: 1773 - protein, 309 aa, Populus balsamifera subsp. trichocarpa
  misc_feature (1)..(309): Ceres ANNOT ID no. 1446209
  misc_feature (255)..(305): Pfam Name: PHD Pfam Description: PHD-finger
  misc_feature: SWISSPROT Homolog: Y5621_ARATH PHD finger protein At5g26210 with e-value of 1.0e-98 and BLAST sequence identity of 71.5
  misc_feature 198609:<222: Transcription Factor
  misc_feature: Phenotype: ROSETTE LEAVES - Curled 4 Useful for making ornamental plants with altered leaf shape
  misc_feature: Phenotype: ROSETTE LEAVES - Other Useful for making ornamental plants with modified leaves
  misc_feature (1)..(309): Functional Homolog of  Ceres CLONE ID no. 38635 at SEQ ID NO. 1813 with e-value of 1.70E-102 and BLAST sequence identity of 83.6
MEAIPHPIPRTVEEVFSDFKGRRSGLIKALTTDVEKFYQQCDPGGQIGEDISNLNFKRRLEFQDHFCIYSWVGIFGDIDTGSHDKENLCLYGLPNETWEVNLPVEEVPPELPEPALGINFARDGMQEKDWLSLVAVHSDSWLLAVAFYFGARFGFGKNERWNLLGLGMNYTWKTRKRLFQMINELPTIFEVVSGNVKQPKDQSATHNNSGKSKSSGKMQSRQPESQTKAVKVSAPPKEDYESGEEEEEDDEQGATCGACGESYGTDEFWICCDICEKWFHGKCVKITPAKAEHIKQYKCPSCSGKRARV

SEQ ID NO: 1774 - protein, 438 aa, Arabidopsis thaliana
  misc_feature (1)..(438): Ceres CLONE ID no. 38690
  misc_feature (56)..(391): Pfam Name: Exo_endo_phos Pfam Description: Endonuclease/Exonuclease/phosphatase family
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Undulate Appearance Useful for making ornamental plants with modified flowers
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
MLNLIAFLRRRLRRPRKARISVNHHHLSVDSSPETHHHQNGFSSAAAIHPNPDKTITVATFNAAMFSMAPAVPSNKGLPFRSKSTVDRPKSILKPMNAAASPTHDSRKQQRFAKSRPRRVSINLPDNEISRQLSFREDPQHSPLRPGEIGLRSTRTALEVLSELDADVLALQDVKADEADQMRPLSDLAAALGMNYVFAESWAPEYGNAILSKWPIKSSNVLRIFDHTDFRNVLKASIEVPGSGEVEFHCTHLDHLDEKWRMKQVDAIIQSTNVPHILAGALNSLDESDYSPERWTDIVKYYEEMGKPIPKAQVMRFLKSKEYTDAKDFAGECESVVVVAKGQSVQGTCKYGTRVDYILASSDSPYRFVPGSYSVLSSKGTSDHHIVKVDVVKATSINVNEQEQRPIRSHKLQRITATTYNNNSSLTKASWRTHYYKA

SEQ ID NO: 1775 - DNA, 1575 bp, Populus balsamifera subsp. trichocarpa
  misc_feature (1)..(1575): Ceres ANNOT ID no. 1525183
  misc_feature 198891:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Undulate Appearance Useful for making ornamental plants with modified flowers
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atgctcaaactcctcaacaaaaggctcaggcgcctttattctcgtttccggaggcgtattggcagtggttccaggcgcaaggttgtcataaagaaatttggaaaatcaaacttcaaatcacaaaatgacatcaaagttgagcccaccattaatgggtctgctgctgtccatccaaatggtcaattgggtgaggagaagccaatcaagttagcaacttttaatgctgccctgttttcaatggcacctgctgtgcctaaaacagagaatccttcgagtgttgactatgagggtgaagagtttgcagacactagaaggcctataaatagtaataagctacgcgcaaagtctgcaaatgatcggccgaagagtattctgaagcagtctcccctgcatccaaactccatcgatggtaatgagaatctctctaagcaacaaaagtttgctaaatcaaagttaagggtatcgatcaatttgcctgataatgagatttcattattgagaaataggcaattgagcttcagagaagacgaaaaggagggtgcttcaagtgttaatataagtagaattttgaggggaaaggctcctatgaggccacaaagcgtgagtttggcaagaaatatgggaaatggtgagatcgatggagagagttataggagtacaaggacagtgcttcaagtgctgaaagagctggatgcagatattttggctttgcaagatgtgaaagcagaggaggagaaagcaatgaagcctctttctgatttggctgctgctttggggatgaattatgtttttgctgagagctgggctcctgagtatggaaatgctatcctctcaaagtggccgatcaagagatggaaagtgcaaaagatctttgatgatactgatttcaggaatgttcttaaggccacaattgatgtgccacaggcaggagaggtcaacttccactgcacccaccttgatcatctcgatgagaactggcggatgaagcaaatagatgccataatacaatcaagtgatgctcctcatatcttagctggaggtcttaattccctcgacgaaacagattactctgaagagaggtggaccgacattgtaaagtactatgaggagatgggaaagccaacaccaaaagttgaagtaatgagtttcatgaagagtaaacattacactgatgctaaggactatgcaggagaatgtgaagcagtagtcattttagctaaaggccaaaatgtgcaagggacttgtaagtatgggactcgagtagattacatactggcatctccaaattcaccctacaagtttgttccagggtcatactcggtgttttcttctaaagggacttctgatcatcatattgtgaaagttgatatcgtaaaagcaagatgcagcagtcaagaaaaagtcgctagaaagaaacggcaacctaaacagaaagttgtaaagataaccaacagttctcctacaaaagtcttggtttggtttcctggtgtaaaagaggagctggggatggcgatattagacccgcttccacccagctctctcatgcacttcgtaaatcttgtaacttgggattag

SEQ ID NO: 1776 - protein, 524 aa, Populus balsamifera subsp. trichocarpa
  misc_feature (1)..(524): Ceres ANNOT ID no. 1525183
  misc_feature (68)..(457): Pfam Name: Exo_endo_phos Pfam Description: Endonuclease/Exonuclease/phosphatase family
  misc_feature 199046:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Undulate Appearance Useful for making ornamental plants with modified flowers
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(524): Functional Homolog of  Ceres CLONE ID no. 38690 at SEQ ID NO. 1818 with e-value of 8.00E-128 and BLAST sequence identity of 67.7
MLKLLNKRLRRLYSRFRRRIGSGSRRKVVIKKFGKSNFKSQNDIKVEPTINGSAAVHPNGQLGEEKPIKLATFNAALFSMAPAVPKTENPSSVDYEGEEFADTRRPINSNKLRAKSANDRPKSILKQSPLHPNSIDGNENLSKQQKFAKSKLRVSINLPDNEISLLRNRQLSFREDEKEGASSVNISRILRGKAPMRPQSVSLARNMGNGEIDGESYRSTRTVLQVLKELDADILALQDVKAEEEKAMKPLSDLAAALGMNYVFAESWAPEYGNAILSKWPIKRWKVQKIFDDTDFRNVLKATIDVPQAGEVNFHCTHLDHLDENWRMKQIDAIIQSSDAPHILAGGLNSLDETDYSEERWTDIVKYYEEMGKPTPKVEVMSFMKSKHYTDAKDYAGECEAVVILAKGQNVQGTCKYGTRVDYILASPNSPYKFVPGSYSVFSSKGTSDHHIVKVDIVKARCSSQEKVARKKRQPKQKVVKITNSSPTKVLVWFPGVKEELGMAILDPLPPSSLMHFVNLVTWD

SEQ ID NO: 1777 - protein, 190 aa, Arabidopsis thaliana
  misc_feature (1)..(190): Ceres CLONE ID no. 38697
  misc_feature (110)..(167): Pfam Name: LIM Pfam Description: LIM domain
  misc_feature: Phenotype: INFLORESCENCE - Strong Useful for making stronger plants
  misc_feature: Phenotype: WHOLE PLANT - Other Useful for making bigger plants
MAFAGTTQKCMACDKTVYLVDKLTADNRVYHKACFRCHHCKGTLKLSNYNSFEGVLYCRPHFDQNFKRTGSLEKSFEGTPKIGKPDRPLEGERPAGTKVSNMFGGTREKCVGCDKTVYPIEKVSVNGTLYHKSCFKCTHGGCTISPSNYIAHEGKLYCKHHHIQLIKEKGNLSQLEGGGENAAKDKVVAA

SEQ ID NO: 1778 - DNA, 594 bp, Populus balsamifera subsp. trichocarpa
  misc_feature (1)..(594): Ceres ANNOT ID no. 1470862
  misc_feature 199319:<222: Transcription Factor
  misc_feature: Phenotype: INFLORESCENCE - Strong Useful for making stronger plants
  misc_feature: Phenotype: WHOLE PLANT - Other Useful for making bigger plants
atggcatttgcaggaacaacccagaagtgtatggcatgtgacaagactgtctatcttgtcgacaagttaacagccgataaccgtgcgtaccataaggcttgcttccgatgccatcattgcaaaggaaccctcaagcttggcaactacaattcctttgaaggggttctctactgcaggccacattttgatcaactgttcaaaagaactggcagtcttgacaaaagctttgaggggacaccaaaaattgtaaagccagagaaacctgttgatggtgagaaacctgtgtcaactaaagtctcgaccatgttcgctggaaccagagaaaagtgtttcggctgcaagaacactgtctatccaactgagaaggtttcggtgaatggaactccttaccacaaaagctgcttcaaatgcatccacggaggatgtacaattagcccatcaaactacattgcacatgaaggtcgcctctactgcaaacaccaccacaaccaacttatcaaggaaaagggaaacttgagccaacttgagggtgatattgagaaggactccatgaacaacaaaactaatggaagagaagttgctgccgagtcataa

SEQ ID NO: 1779 - protein, 197 aa, Populus balsamifera subsp. trichocarpa
  misc_feature (1)..(197): Ceres ANNOT ID no. 1470862
  misc_feature (10)..(67): Pfam Name: LIM Pfam Description: LIM domain
  misc_feature: SWISSPROT Homolog: SF3_HELAN Pollen-specific protein SF3 with e-value of 1.1e-71 and BLAST sequence identity of 72.0
  misc_feature: SWISSPROT Homolog: CSRP3_RAT Cysteine and glycine-rich protein 3(Cysteine-rich protein 3)(CRP3) (LIM domain protein, cardiac) (Muscle LIM protein) with e-value of 4.9e-19 and BLAST sequence identity of 33.3
  misc_feature: SWISSPROT Homolog: CSRP3_MOUSE Cysteine and glycine-rich protein 3(Cysteine-rich protein 3)(CRP3) (LIM domain protein, cardiac) (Muscle LIM protein) with e-value of 6.2e-19 and BLAST sequence identity of 32.7
  misc_feature: SWISSPROT Homolog: CSRP3_HUMAN Cysteine and glycine-rich protein 3(Cysteine-rich protein 3)(CRP3) (LIM domain protein, cardiac) (Muscle LIM protein) with e-value of 7.9e-19 and BLAST sequence identity of 32.2
  misc_feature: SWISSPROT Homolog: CSRP2_CHICK Cysteine and glycine-rich protein 2(Cysteine-rich protein 2)(CRP2) (Beta-cysteine-rich protein) (Beta-CRP) with e-value of 1.6e-18 and BLAST sequence identity of 29.9
  misc_feature 199416:<222: Transcription Factor
  misc_feature: Phenotype: INFLORESCENCE - Strong Useful for making stronger plants
  misc_feature: Phenotype: WHOLE PLANT - Other Useful for making bigger plants
  misc_feature (1)..(197): Functional Homolog of  Ceres CLONE ID no. 38697 at SEQ ID NO. 1821 with e-value of 5.59E-88 and BLAST sequence identity of 87.5
MAFAGTTQKCMACDKTVYLVDKLTADNRAYHKACFRCHHCKGTLKLGNYNSFEGVLYCRPHFDQLFKRTGSLDKSFEGTPKIVKPEKPVDGEKPVSTKVSTMFAGTREKCFGCKNTVYPTEKVSVNGTPYHKSCFKCIHGGCTISPSNYIAHEGRLYCKHHHNQLIKEKGNLSQLEGDIEKDSMNNKTNGREVAAES

SEQ ID NO: 1780 - DNA, 594 bp, Populus balsamifera subsp. trichocarpa
  misc_feature (1)..(594): Ceres ANNOT ID no. 1443740
  misc_feature 199495:<222: Transcription Factor
  misc_feature: Phenotype: INFLORESCENCE - Strong Useful for making stronger plants
  misc_feature: Phenotype: WHOLE PLANT - Other Useful for making bigger plants
atggcatttgcaggaacaacccagaaatgtatggcatgtgacaagactgtctatcttgtggacaggttagctgctgataaccgtgtgtaccacaaggcttgcttccgatgccatcattgcagaggaaccctcaagcttggcaactacaattcctttgaaggggtactctactgcaggccacattttgatcaactcttcaaaagaactggaagtcttgacaaaagctttgaggggacaccaaaaattttaaaaccagagaaacctgttgatggggagaaacctatatcaactaaagtctcgaccatgttcgctggaaccagagacaagtgtttcggctgcaagaacactgtctatccaactgagaaggtttcggtgaatggaacttcttaccacaaaagctgcttcaaatgcattcatggagggtgtacaattagcccatccaactacattgcacatgaaggtcgcctctactgcaaacaccaccacaaccaacttatcaaggaaaagggtaatctgagccaacttgagggtgatgttgagaaggattccatgaatgacaaaactaatggaagagaagtttctgctgaatcataa

SEQ ID NO: 1781 - protein, 197 aa, Populus balsamifera subsp. trichocarpa
  misc_feature (1)..(197): Ceres ANNOT ID no. 1443740
  misc_feature (110)..(167): Pfam Name: LIM Pfam Description: LIM domain
  misc_feature: SWISSPROT Homolog: SF3_HELAN Pollen-specific protein SF3 with e-value of 1.1e-71 and BLAST sequence identity of 72.0
  misc_feature: SWISSPROT Homolog: CSRP3_RAT Cysteine and glycine-rich protein 3(Cysteine-rich protein 3)(CRP3) (LIM domain protein, cardiac) (Muscle LIM protein) with e-value of 4.9e-19 and BLAST sequence identity of 33.3
  misc_feature: SWISSPROT Homolog: CSRP3_MOUSE Cysteine and glycine-rich protein 3(Cysteine-rich protein 3)(CRP3) (LIM domain protein, cardiac) (Muscle LIM protein) with e-value of 6.2e-19 and BLAST sequence identity of 32.7
  misc_feature: SWISSPROT Homolog: CSRP3_HUMAN Cysteine and glycine-rich protein 3(Cysteine-rich protein 3)(CRP3) (LIM domain protein, cardiac) (Muscle LIM protein) with e-value of 7.9e-19 and BLAST sequence identity of 32.2
  misc_feature: SWISSPROT Homolog: CSRP2_CHICK Cysteine and glycine-rich protein 2(Cysteine-rich protein 2)(CRP2) (Beta-cysteine-rich protein) (Beta-CRP) with e-value of 1.6e-18 and BLAST sequence identity of 29.9
  misc_feature 199592:<222: Transcription Factor
  misc_feature: Phenotype: INFLORESCENCE - Strong Useful for making stronger plants
  misc_feature: Phenotype: WHOLE PLANT - Other Useful for making bigger plants
  misc_feature (1)..(197): Functional Homolog of  Ceres CLONE ID no. 38697 at SEQ ID NO. 1821 with e-value of 3.09E-87 and BLAST sequence identity of 83.3
MAFAGTTQKCMACDKTVYLVDRLAADNRVYHKACFRCHHCRGTLKLGNYNSFEGVLYCRPHFDQLFKRTGSLDKSFEGTPKILKPEKPVDGEKPISTKVSTMFAGTRDKCFGCKNTVYPTEKVSVNGTSYHKSCFKCIHGGCTISPSNYIAHEGRLYCKHHHNQLIKEKGNLSQLEGDVEKDSMNDKTNGREVSAES

SEQ ID NO: 1782 - DNA, 612 bp, Populus balsamifera subsp. trichocarpa
  misc_feature (1)..(612): Ceres ANNOT ID no. 1461162
  misc_feature 199671:<222: Transcription Factor
  misc_feature: Phenotype: INFLORESCENCE - Strong Useful for making stronger plants
  misc_feature: Phenotype: WHOLE PLANT - Other Useful for making bigger plants
atggcagcctttgcaggaactcaacaaaaatgcatggcttgtgacaagactgtgtatcttgtcgataagttaactgctgataacagggtttttcacaaggcctgctttagatgccaccattgcaggggtaccctcaagttaagcaactactgttcttttgaaggggttctgtactgcagacctcactatgaccaactcttcaagagaactggcagtctagacaagagttttgaaggaacgccgaagattgtgaaaccagaaaaacctgttgataatgaggtaatctcaagattggaaatgaaaaacgccagcaaagtttcgaatttgtttgctggcaccagagaaaaatgtgtaggctgcgacaagactgtctatccgatcgagaaggttacggtaaatgggactccataccacaggagctgttttaagtgtacccatggaggttgtactataagcccatctaactacattgcacatgagggaaaactccactgcaagcatcaccatatccaacttttcaaggagaagggaaactacagtcagcttgagaatgaacgtgagaaaaatccagtcgtcagcatcactgctgtagaaattgctgctgaatcataa

SEQ ID NO: 1783 - protein, 203 aa, Populus balsamifera subsp. trichocarpa
  misc_feature (1)..(203): Ceres ANNOT ID no. 1461162
  misc_feature (11)..(68): Pfam Name: LIM Pfam Description: LIM domain
  misc_feature: SWISSPROT Homolog: SF3_HELAN Pollen-specific protein SF3 with e-value of 1.1e-71 and BLAST sequence identity of 72.0
  misc_feature: SWISSPROT Homolog: CSRP3_RAT Cysteine and glycine-rich protein 3(Cysteine-rich protein 3)(CRP3) (LIM domain protein, cardiac) (Muscle LIM protein) with e-value of 4.9e-19 and BLAST sequence identity of 33.3
  misc_feature: SWISSPROT Homolog: CSRP3_MOUSE Cysteine and glycine-rich protein 3(Cysteine-rich protein 3)(CRP3) (LIM domain protein, cardiac) (Muscle LIM protein) with e-value of 6.2e-19 and BLAST sequence identity of 32.7
  misc_feature: SWISSPROT Homolog: CSRP3_HUMAN Cysteine and glycine-rich protein 3(Cysteine-rich protein 3)(CRP3) (LIM domain protein, cardiac) (Muscle LIM protein) with e-value of 7.9e-19 and BLAST sequence identity of 32.2
  misc_feature: SWISSPROT Homolog: CSRP2_CHICK Cysteine and glycine-rich protein 2(Cysteine-rich protein 2)(CRP2) (Beta-cysteine-rich protein) (Beta-CRP) with e-value of 1.6e-18 and BLAST sequence identity of 29.9
  misc_feature 199770:<222: Transcription Factor
  misc_feature: Phenotype: INFLORESCENCE - Strong Useful for making stronger plants
  misc_feature: Phenotype: WHOLE PLANT - Other Useful for making bigger plants
  misc_feature (1)..(203): Functional Homolog of  Ceres CLONE ID no. 38697 at SEQ ID NO. 1821 with e-value of 5.29E-83 and BLAST sequence identity of 82.7
MAAFAGTQQKCMACDKTVYLVDKLTADNRVFHKACFRCHHCRGTLKLSNYCSFEGVLYCRPHYDQLFKRTGSLDKSFEGTPKIVKPEKPVDNEVISRLEMKNASKVSNLFAGTREKCVGCDKTVYPIEKVTVNGTPYHRSCFKCTHGGCTISPSNYIAHEGKLHCKHHHIQLFKEKGNYSQLENEREKNPVVSITAVEIAAES

SEQ ID NO: 1784 - DNA, 576 bp, Populus balsamifera subsp. trichocarpa
  misc_feature (1)..(576): Ceres ANNOT ID no. 1526959
  misc_feature 199849:<222: Transcription Factor
  misc_feature: Phenotype: INFLORESCENCE - Strong Useful for making stronger plants
  misc_feature: Phenotype: WHOLE PLANT - Other Useful for making bigger plants
atggcaacatttgcagggacaactcagaagtgtaaagcatgtgataagactgtgtacttggtggatcaactcaccgttgataacaaattctatcacaaggcttgttttagatgccaccactgcaagggtaccctcaagttgagcaactattcatcctttgaaggtgttttatattgccagcctcactttgatcaacttttcaagatgacaggcagcttggataaaagttttgaaggcactccgaaaactgttagaggtgaccggtctgccgatcaggtccttagcaacagcaaagtttcaagtatgtttgctggaactcaggaaaaatgtgttgcttgcaataaaactgtttacccactcgaaaaggtggcagttgatgggacatcttatcataaagcttgtttcagatgcgctcatggaggctgtgtcatcagcccctccaactatgtagcccatgagcatcgtctgtattgcaggcaccatcataatcagctcttcaaggagaagggaaacttcagccaattcggcaaacatgaacatcttacaccagtggatgagactgcaactgctgaatga

SEQ ID NO: 1785 - protein, 191 aa, Populus balsamifera subsp. trichocarpa
  misc_feature (1)..(191): Ceres ANNOT ID no. 1526959
  misc_feature (110)..(167): Pfam Name: LIM Pfam Description: LIM domain
  misc_feature: SWISSPROT Homolog: SF3_HELAN Pollen-specific protein SF3 with e-value of 1.1e-71 and BLAST sequence identity of 72.0
  misc_feature: SWISSPROT Homolog: CSRP3_RAT Cysteine and glycine-rich protein 3(Cysteine-rich protein 3)(CRP3) (LIM domain protein, cardiac) (Muscle LIM protein) with e-value of 4.9e-19 and BLAST sequence identity of 33.3
  misc_feature: SWISSPROT Homolog: CSRP3_MOUSE Cysteine and glycine-rich protein 3(Cysteine-rich protein 3)(CRP3) (LIM domain protein, cardiac) (Muscle LIM protein) with e-value of 6.2e-19 and BLAST sequence identity of 32.7
  misc_feature: SWISSPROT Homolog: CSRP3_HUMAN Cysteine and glycine-rich protein 3(Cysteine-rich protein 3)(CRP3) (LIM domain protein, cardiac) (Muscle LIM protein) with e-value of 7.9e-19 and BLAST sequence identity of 32.2
  misc_feature: SWISSPROT Homolog: CSRP2_CHICK Cysteine and glycine-rich protein 2(Cysteine-rich protein 2)(CRP2) (Beta-cysteine-rich protein) (Beta-CRP) with e-value of 1.6e-18 and BLAST sequence identity of 29.9
  misc_feature 199946:<222: Transcription Factor
  misc_feature: Phenotype: INFLORESCENCE - Strong Useful for making stronger plants
  misc_feature: Phenotype: WHOLE PLANT - Other Useful for making bigger plants
  misc_feature (1)..(191): Functional Homolog of  Ceres CLONE ID no. 38697 at SEQ ID NO. 1821 with e-value of 3.80E-73 and BLAST sequence identity of 74.8
MATFAGTTQKCKACDKTVYLVDQLTVDNKFYHKACFRCHHCKGTLKLSNYSSFEGVLYCQPHFDQLFKMTGSLDKSFEGTPKTVRGDRSADQVLSNSKVSSMFAGTQEKCVACNKTVYPLEKVAVDGTSYHKACFRCAHGGCVISPSNYVAHEHRLYCRHHHNQLFKEKGNFSQFGKHEHLTPVDETATAE

SEQ ID NO: 1786 - DNA, 576 bp, Populus balsamifera subsp. trichocarpa
  misc_feature (1)..(576): Ceres ANNOT ID no. 1468331
  misc_feature 200022:<222: Transcription Factor
  misc_feature: Phenotype: INFLORESCENCE - Strong Useful for making stronger plants
  misc_feature: Phenotype: WHOLE PLANT - Other Useful for making bigger plants
atggcaccatttgcagggacaacccagaagtgtaagtcatgtgagaagactgtatactttgtggatcaactcactgctgatgacaaagtctatcacaaggcttgttttagatgccaccactgcaagggtaccctaaagttgagcaactactcatcctttgaaggcgttttatattgcaagcctcacttcgatcaacttttaaagatgacaggcagcttggataaaagcttcaaagggacttcaaaaactgttagagttgaccggtctgccgatcaggtccagagcaacagcaaagtttcaagtatgtttgccggaactcaggagaaatgtgttgcttgcaagaaaactgtttacccaatcgaaagggtggcagttgatggaacatcgtatcataaggcttgtttcagatgcgctcatggaggctgtgtcatcagcccatcaaacttcgtagcccatgagcatcgtctgtattgcaggcaccatcataatcagctcttcaagcagaagggaaacttcagccaacttgacaagcacgaacatgttacaccagtgaaggagactgcagctgctgaatga

SEQ ID NO: 1787 - protein, 191 aa, Populus balsamifera subsp. trichocarpa
  misc_feature (1)..(191): Ceres ANNOT ID no. 1468331
  misc_feature (110)..(167): Pfam Name: LIM Pfam Description: LIM domain
  misc_feature: SWISSPROT Homolog: SF3_HELAN Pollen-specific protein SF3 with e-value of 1.1e-71 and BLAST sequence identity of 72.0
  misc_feature: SWISSPROT Homolog: CSRP3_RAT Cysteine and glycine-rich protein 3(Cysteine-rich protein 3)(CRP3) (LIM domain protein, cardiac) (Muscle LIM protein) with e-value of 4.9e-19 and BLAST sequence identity of 33.3
  misc_feature: SWISSPROT Homolog: CSRP3_MOUSE Cysteine and glycine-rich protein 3(Cysteine-rich protein 3)(CRP3) (LIM domain protein, cardiac) (Muscle LIM protein) with e-value of 6.2e-19 and BLAST sequence identity of 32.7
  misc_feature: SWISSPROT Homolog: CSRP3_HUMAN Cysteine and glycine-rich protein 3(Cysteine-rich protein 3)(CRP3) (LIM domain protein, cardiac) (Muscle LIM protein) with e-value of 7.9e-19 and BLAST sequence identity of 32.2
  misc_feature: SWISSPROT Homolog: CSRP2_CHICK Cysteine and glycine-rich protein 2(Cysteine-rich protein 2)(CRP2) (Beta-cysteine-rich protein) (Beta-CRP) with e-value of 1.6e-18 and BLAST sequence identity of 29.9
  misc_feature 200119:<222: Transcription Factor
  misc_feature: Phenotype: INFLORESCENCE - Strong Useful for making stronger plants
  misc_feature: Phenotype: WHOLE PLANT - Other Useful for making bigger plants
  misc_feature (1)..(191): Functional Homolog of  Ceres CLONE ID no. 38697 at SEQ ID NO. 1821 with e-value of 2.19E-70 and BLAST sequence identity of 70.5
MAPFAGTTQKCKSCEKTVYFVDQLTADDKVYHKACFRCHHCKGTLKLSNYSSFEGVLYCKPHFDQLLKMTGSLDKSFKGTSKTVRVDRSADQVQSNSKVSSMFAGTQEKCVACKKTVYPIERVAVDGTSYHKACFRCAHGGCVISPSNFVAHEHRLYCRHHHNQLFKQKGNFSQLDKHEHVTPVKETAAAE

SEQ ID NO: 1788 - protein, 303 aa, Arabidopsis thaliana
  misc_feature (1)..(303): Ceres CLONE ID no. 38743
  misc_feature (13)..(292): Pfam Name: DS Pfam Description: Deoxyhypusine synthase
  misc_feature: Phenotype: SILIQUES - Clubbed Useful for modifying fruit shape, composition and seed yield
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MLDWRLADETTVAEDCSEEEKNPSFRESVKCKIFLGFTSNLVSSGVRDTIRYLVQHHMVDVIVTTTGGVEEDLIKCLAPTFKGDFSLPGAYLRSKGLNRIGNLLVPNDNYCKFEDWIIPIFDEMLKEQKEENVLWTPSKLLARLGKEINNESSYLYWAYKMNIPVFCPGLTDGSLGDMLYFHSFRTSGLIIDVVQDIRAMNGEAVHANPKKTGMIILGGGLPKHHICNANMMRNGADYAVFINTGQEFDGSDSGARPDEAVSWGKIRGSAKTVKVYCDATIAFPLLVAETFATKRDQTCESKT

SEQ ID NO: 1789 - DNA, 1161 bp, Populus balsamifera subsp. trichocarpa
  misc_feature (1)..(1161): Ceres ANNOT ID no. 1448369
  misc_feature 200308:<222: Transcription Factor
  misc_feature: Phenotype: SILIQUES - Clubbed Useful for modifying fruit shape, composition and seed yield
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggaggagaatttgctatcatcagtacgtaccacagtgtttaaagaatcagaagctcttgatgggaaatgcattaaaattgaaggttatgattttaatcaaggagtgaactactctaagcttctcaaatccatggtctctaccgggtttcaagcttccaaccttggagatgccattcaagttgttaataacatgctagactggaggcttgctgatgaagagataacagaagattgtagtgatgaggagagggagttggcctatagagagtctgtgagatgcaaactgttcttgggttttacatcaaatcttgtttcttcaggtgtcagagatacaattcgatatcttgttcagcatcatatggttgatgtagtggttacaacggcaggtggcatagaagaagatcttataaaatgcctggcaccaacatacaaaggtgacttttctctacccggggctcaattacgatcaaaagggttgaatcgaattggtaacttgttggtacctaatgacaactactgcaaatttgaggattggatcattccaatctttgaccaaatgttgaaggaacaaattgaagagaatttcacctggacaccttctaaattaatagctcgcatggggaaagaaataaataatgagagttcatacctttattgggcatataagaacgacattccagtattctgtccaggcttaacagatggttctctaggggacatgctatactttcattccttccacaaccctggtctaattgttgacatagttcaagatattagagccatgaatggtgaagctgtccacgcaagtcctagaaaaactggtatcatcattcttggaggtgggcttcctaagcatcatatatgcaatgccaatatgatgcgtaacggtgcagattatgctgtattcatcaatacagcacaagaatttgatgggagtgattctggtgctcatcctgatgaggctgtatcttgggggaaaatacgaggttctgctaaaactgttaaggtccactgtgatgcaactattgcttttcctctcctagttgctgaaacatttgcccctaggaggaacagattctgcagcaaattaagggatccgccagaagacactgctctcagccccaaaccattgttgcctctaccgggagtagcataa

SEQ ID NO: 1790 - protein, 322 aa, Populus balsamifera subsp. trichocarpa
  misc_feature (1)..(322): Ceres ANNOT ID no. 1448369
  misc_feature (1)..(291): Pfam Name: DS Pfam Description: Deoxyhypusine synthase
  misc_feature: SWISSPROT Homolog: DHYS_ARATH Deoxyhypusine synthase (EC 2.5.1.46) with e-value of 1.7e-165 and BLAST sequence identity of 100.0
  misc_feature: SWISSPROT Homolog: DHYS_BRANA Deoxyhypusine synthase (EC 2.5.1.46) with e-value of 6.7e-157 and BLAST sequence identity of 93.7
  misc_feature: SWISSPROT Homolog: DHYS_SENVE Deoxyhypusine synthase (EC 2.5.1.46) (DHS) with e-value of 1.1e-145 and BLAST sequence identity of 87.7
  misc_feature: SWISSPROT Homolog: DHYS_DIACA Deoxyhypusine synthase (EC 2.5.1.46) with e-value of 2.0e-141 and BLAST sequence identity of 84.3
  misc_feature: SWISSPROT Homolog: DHYS_LYCES Deoxyhypusine synthase (EC 2.5.1.46) with e-value of 1.4e-133 and BLAST sequence identity of 80.9
  misc_feature 200447:<222: Transcription Factor
  misc_feature: Phenotype: SILIQUES - Clubbed Useful for modifying fruit shape, composition and seed yield
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(322): Functional Homolog of  Ceres CLONE ID no. 38743 at SEQ ID NO. 1832 with e-value of 3.80E-144 and BLAST sequence identity of 86.5
MLDWRLADEEITEDCSDEERELAYRESVRCKLFLGFTSNLVSSGVRDTIRYLVQHHMVDVVVTTAGGIEEDLIKCLAPTYKGDFSLPGAQLRSKGLNRIGNLLVPNDNYCKFEDWIIPIFDQMLKEQIEENFTWTPSKLIARMGKEINNESSYLYWAYKNDIPVFCPGLTDGSLGDMLYFHSFHNPGLIVDIVQDIRAMNGEAVHASPRKTGIIILGGGLPKHHICNANMMRNGADYAVFINTAQEFDGSDSGAHPDEAVSWGKIRGSAKTVKVHCDATIAFPLLVAETFAPRRNRFCSKLRDPPEDTALSPKPLLPLPGVA

SEQ ID NO: 1791 - protein, 388 aa, Arabidopsis thaliana
  misc_feature (1)..(388): Ceres CLONE ID no. 38757
  misc_feature (319)..(357): Pfam Name: zf-C3HC4 Pfam Description: Zinc finger, C3HC4 type (RING finger)
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
MGNISSSGGEGRRRRRRNHTAAPPPPPPPPSSSLPPPPLPTEIQANPIVFAAVTPYPNPNPNPVYQYPASYYHHPPPGAMPLPPYDHHLQHHPPHPYHNHSWAPVAMARYPYAGHMMAQPTPYVEHQKAVTIRNDVNLKKESLRLEPDPDNPGRFLVSFTFDATVSGRISVIFFAKESEDCKLTATKEDILPPITLDFEKGLGQKFKQSSGSGIDFSVFEDVELFKAAADTEIYPLAVKAEAAPSGGENEEEERSGSKNAQITQAVYEKDKGEIKIRVVKQILWVNGTRYELQEIYGIGNTVEGDDDSADDANDPGKECVICLSEPRDTTVLPCRHMCMCSGCAKVLRFQTNRCPICRQPVERLLEIKVHGNNGSGNNTGQGETVEQE

SEQ ID NO: 1792 - DNA, 1098 bp, Populus balsamifera subsp. trichocarpa
  misc_feature (1)..(1098): Ceres ANNOT ID no. 1528846
  misc_feature 200688:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atgggaaacatcagcagcaacaacgttaacggccgaaggagacacggaagccggcagagccaccctccaccgcccccaccagcacccccgcagccggaaatcacgcccagccgttacgttttcacggcggcaacgccttacccttcgcaataccctaaccctaaccccccaccatattatcagtaccctgggtactatccacccgcgatgcccgtgcagtcgccagctccgtacgatcaccgcaaccgggtggaccacccggcggctcattgggtaggagggaggtacccagtgatgccccaaccggctccttatgtagagcaccagaagacggtcactataaggagcgatgttaatttgaagaaggagagtttgaggcttgaaccggatgaggagaatccagggagctatcttgttactttcacatttgatgctactgttgctggaagtgcttttgttattgaatgtgaagaaagctttttcaagagcatcactattattttctttgcgaaagaaggtgaggattgtgtcctgacaccaacgaaggcagaccttccaccagtgacagtaaatttcccacaaggtctgggccagaagttcagacagccttctggaacagggattgatttcaccttgtttgaggggaaagagttgttaaaagagggtgagatggatgcctatcctctagcagtaaaggcagaggcatcccctgcaaatcataatggaacagaaggaaaccaaatgtctgaacctatgaactctcaggtaacgcaagcaatatttgagaaggagaaaggagagtaccaagtgagggtaatgaagcagatcctctgggttaatgggaggagatatgagcttcaggagatatatgggattggaaattcagttgagggtgatgttgatgcaaatgacccaggtaaagaatgtgtcatttgcctgtcagaaccacgggacactactgttcttccttgccgacacatgtgtatgtgcagtggctgtgcaaaggttttgaggttccaaacaaataggtgccccatttgcaggcatccagttgacaggcttctagaaataaaggtcaacaacgctcctgatgaatga

SEQ ID NO: 1793 - protein, 365 aa, Populus balsamifera subsp. trichocarpa
  misc_feature (1)..(365): Ceres ANNOT ID no. 1528846
  misc_feature (309)..(347): Pfam Name: zf-C3HC4 Pfam Description: Zinc finger, C3HC4 type (RING finger)
  misc_feature: SWISSPROT Homolog: EXTN_DAUCA Extensin precursor with e-value of 4.4e-07 and BLAST sequence identity of 39.5
  misc_feature: SWISSPROT Homolog: BRD4_MOUSE Bromodomain-containing protein 4 (Mitotic chromosome-associated protein) (MCAP) with e-value of 7.3e-07 and BLAST sequence identity of 34.9
  misc_feature: SWISSPROT Homolog: EXTN_TOBAC Extensin precursor (Cell wall hydroxyproline-rich glycoprotein) with e-value of 1.2e-06 and BLAST sequence identity of 33.9
  misc_feature: SWISSPROT Homolog: YPRO_OWEFU Hypothetical proline-rich protein (Fragment) with e-value of 1.5e-06 and BLAST sequence identity of 38.2
  misc_feature: SWISSPROT Homolog: IAP1_NPVAC Apoptosis inhibitor 1 (IAP-1) with e-value of 2.3e-06 and BLAST sequence identity of 34.8
  misc_feature 200810:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(365): Functional Homolog of  Ceres CLONE ID no. 38757 at SEQ ID NO. 1835 with e-value of 4.29E-113 and BLAST sequence identity of 71.5
MGNISSNNVNGRRRHGSRQSHPPPPPPAPPQPEITPSRYVFTAATPYPSQYPNPNPPPYYQYPGYYPPAMPVQSPAPYDHRNRVDHPAAHWVGGRYPVMPQPAPYVEHQKTVTIRSDVNLKKESLRLEPDEENPGSYLVTFTFDATVAGSAFVIECEESFFKSITIIFFAKEGEDCVLTPTKADLPPVTVNFPQGLGQKFRQPSGTGIDFTLFEGKELLKEGEMDAYPLAVKAEASPANHNGTEGNQMSEPMNSQVTQAIFEKEKGEYQVRVMKQILWVNGRRYELQEIYGIGNSVEGDVDANDPGKECVICLSEPRDTTVLPCRHMCMCSGCAKVLRFQTNRCPICRHPVDRLLEIKVNNAPDE

SEQ ID NO: 1794 - DNA, 1296 bp, Populus balsamifera subsp. trichocarpa
  misc_feature (1)..(1296): Ceres ANNOT ID no. 1538329
  misc_feature 200926:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atgggcaacatcagcagcagaaacaacgttaacagcaggcggagcctcggcagccggcggagccaccctccacctccaccgccagcacccccacagcctgaaatcacggccaaccgttacgttttcgccgcggcaacaccttacccttcgcaatacccaaaccctaaccctccacaatactaccagcaccctggctactatccagcccagccaacagcgatgcctgtgcctttgccagctccgtatgatcatcaccaccgggtggaccatccggcggctcattgggtgagtgggaggtgcccaatgatgccccaaccggcgccttatgtggagcaccagaaggcggttactataaggaatgatgttaatttgaagaaggagagtttgaggattgaaccggacgaggagaatccagggagctatcttgttacattcacgtttgatgctactgttgctggaagttatggattcatgggtatttcagaggattttcctaatcagagatccttgggcctgcttaagacatctaatcttgtcttagaaattgggattgttcacaaaattgacgagatgatgaatctggggttatttctgaatgactcttcagtgaagagaccatcaacgggtgttgagtctggggtttctcagcttgtgctatgttttaaagactgtatggcattctgcatcactattattttctttgcaaaagaaggtgaggattgtatcctgacaccaacgaaggcatacctccttccaccagtaacagttaatttccaacaaggtctgggccagaagttcagacagccttctgggacagggattgatttcaccttgtttgaggagaaagagttggtaaaagagggtgagatggatgcctatcctctagcagtaaaagcagaggcatcccctgctaatcgaaagggaacagaaggaaaccaaatgtctggagctacgaactctcagataacacatgcagtgtttgagaaggagaaaggtgagtaccaagtaagggtgatgaagcagatcctctgggtgaatgggataagatatgagcttcaggagatatacgggattggagattctgttgatggtgatgttgatgcaaatgacccaggtaaagaatgtgtcatttgcctgtcagaaccacgggacactaccgttcttccttgccgacacatgtgtatgtgcagtggatgtgcaaaggttttgaggttccaaacgaacagatgccccatctgcaggcaaccagttgacaggcttctagagataaaggtcaacaatgggcctgatgaatga

SEQ ID NO: 1795 - protein, 431 aa, Populus balsamifera subsp. trichocarpa
  misc_feature (1)..(431): Ceres ANNOT ID no. 1538329
  misc_feature (375)..(413): Pfam Name: zf-C3HC4 Pfam Description: Zinc finger, C3HC4 type (RING finger)
  misc_feature: SWISSPROT Homolog: EXTN_DAUCA Extensin precursor with e-value of 4.4e-07 and BLAST sequence identity of 39.5
  misc_feature: SWISSPROT Homolog: BRD4_MOUSE Bromodomain-containing protein 4 (Mitotic chromosome-associated protein) (MCAP) with e-value of 7.3e-07 and BLAST sequence identity of 34.9
  misc_feature: SWISSPROT Homolog: EXTN_TOBAC Extensin precursor (Cell wall hydroxyproline-rich glycoprotein) with e-value of 1.2e-06 and BLAST sequence identity of 33.9
  misc_feature: SWISSPROT Homolog: YPRO_OWEFU Hypothetical proline-rich protein (Fragment) with e-value of 1.5e-06 and BLAST sequence identity of 38.2
  misc_feature: SWISSPROT Homolog: IAP1_NPVAC Apoptosis inhibitor 1 (IAP-1) with e-value of 2.3e-06 and BLAST sequence identity of 34.8
  misc_feature 201054:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(431): Functional Homolog of  Ceres CLONE ID no. 38757 at SEQ ID NO. 1835 with e-value of 4.30E-104 and BLAST sequence identity of 69.5
MGNISSRNNVNSRRSLGSRRSHPPPPPPAPPQPEITANRYVFAAATPYPSQYPNPNPPQYYQHPGYYPAQPTAMPVPLPAPYDHHHRVDHPAAHWVSGRCPMMPQPAPYVEHQKAVTIRNDVNLKKESLRIEPDEENPGSYLVTFTFDATVAGSYGFMGISEDFPNQRSLGLLKTSNLVLEIGIVHKIDEMMNLGLFLNDSSVKRPSTGVESGVSQLVLCFKDCMAFCITIIFFAKEGEDCILTPTKAYLLPPVTVNFQQGLGQKFRQPSGTGIDFTLFEEKELVKEGEMDAYPLAVKAEASPANRKGTEGNQMSGATNSQITHAVFEKEKGEYQVRVMKQILWVNGIRYELQEIYGIGDSVDGDVDANDPGKECVICLSEPRDTTVLPCRHMCMCSGCAKVLRFQTNRCPICRQPVDRLLEIKVNNGPDE

SEQ ID NO: 1796 - protein, 485 aa, Arabidopsis thaliana
  misc_feature (1)..(485): Ceres CLONE ID no. 38785
  misc_feature (37)..(472): Pfam Name: Aa_trans Pfam Description: Transmembrane amino acid transporter protein
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
MKSFNTEERNHSTAESGDAYTVSDPTKNVDEDGREKRTGTWLTASAHIITAVIGSGVLSLAWAIAQLGWIAGTSILLIFSFITYFTSTMLADCYRAPDPVTGKRNYTYMDVVRSYLGGRKVQLCGVAQYGNLIGVTVGYTITASISLVAVGKSNCFHDKGHTADCTISNYPYMAVFGIIQVILSQIPNFHKLSFLSIMAAVMSFTYATIGIGLAIATVAGGKVGKTSMTGTAVGVDVTAAQKIWRSFQAVGDIAFAYAYATVLIEIQDTLRSSPAENKAMKRASLVGVSTTTFFYILCGCIGYAAFGNNAPGDFLTDFGFFEPFWLIDFANACIAVHLIGAYQVFAQPIFQFVEKKCNRNYPDNKFITSEYSVNVPFLGKFNISLFRLVWRTAYVVITTVVAMIFPFFNAILGLIGAASFWPLTVYFPVEMHIAQTKIKKYSARWIALKTMCYVCLIVSLLAAARSIAGLISSVKTYKPFRTMHE

SEQ ID NO: 1797 - DNA, 1422 bp, Populus balsamifera subsp. trichocarpa
  misc_feature (1)..(1422): Ceres ANNOT ID no. 1461193
  misc_feature 201317:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
atggctacaatgccagtaaacgggcaaagcttcgctctagacattgtaaaaactgatgacgatggtcgcttaaagagagacggaaatttgatgtctgcgagtgcacacatcattacagctgttattgggtctggagttctatctcttgcatgggccatggctcagttgggttggattgcaggacctatttctcttctaatcttctctttcatcacttggtttaattcctgcctactagctgactgttataggttcccaggtccccttggagggacaagaacctacacttacatgggtgctgtaaaagctcatttaggaggaatcaagtacacactctgtgggatatctcaatatacaaatcttgtaggaacatcaataggatacacaatcaccgcatctataagcatggcggccattaaaagatcaaactgctttcacagggaaggccatgacgcagagtgccatgcatcaacgaatatgttcatgatcatatttgggattgtacaagtcatgatgagccaactacctaattttcatgagcttgtcgggctttccaccctcgctgctatcatgtcttttgcatactcactgatcggtatcggtctctccatagctgcaattgcaggagggaacgatgttaaaacaagcctaacaggaacagtggtaggggtggacgtgacaagcacagaaaaggcttggaattgctttcaagccattggaaacattgcatttgcctatacttattcctcaatccttgttgagatacaggacacactaaaatcaagcccaccagagaaccaggtgatgaagaaggcttccctagttggagtcgcaacaaccactgtattctacatgctgtgtggaacgctgggttatgcagcattcggcaacgtggcaccaggcaacttcttaacaggattcggtttttatgagccctactggctcgttgactttgctaacttatgcattgttattcaccttgttggtgcttaccaggtatatggccaaccgatattcaagctcgtggaagattcatgccgcaagaaatggccagagagtggattcataacaaacgaacaccctgttgacattccattttgtggtgtttttcatgtgaattccttcaggttattgtggagaacagcctatgtgatagcatcatctgtgattgcaatgacatttccgttcttcaacagtgttctgggtttcattggtgcgatatcattttggccattgactttgtatttcccagtacagatgtacatatcacaagcgagaattagacgatttaccttcacctggacatggctaacgattttgactgtggcctgcctgattgtatcacttgctgctgctgccgcatgcgttcaaggccttatcatgcaactccgcaacttcgagcctttcaaatctgtttcttag

SEQ ID NO: 1798 - protein, 470 aa, Populus balsamifera subsp. trichocarpa
  misc_feature (1)..(470): Ceres ANNOT ID no. 1461193
  misc_feature (23)..(458): Pfam Name: Aa_trans Pfam Description: Transmembrane amino acid transporter protein
  misc_feature: SWISSPROT Homolog: AVT4_YEAST Vacuolar amino acid transporter 4 with e-value of 1.1e-07 and BLAST sequence identity of 26.1
  misc_feature: SWISSPROT Homolog: S36A1_HUMAN Proton-coupled amino acid transporter 1 with e-value of 4.0e-07 and BLAST sequence identity of 24.5
  misc_feature: SWISSPROT Homolog: S36A1_HUMAN Proton/amino acid transporter 1 Solute carrier family 36 member 1
  misc_feature: SWISSPROT Homolog: S36A1_MOUSE Proton-coupled amino acid transporter 1 with e-value of 1.7e-06 and BLAST sequence identity of 27.1
  misc_feature: SWISSPROT Homolog: S36A1_MOUSE Proton/amino acid transporter 1 Solute carrier family 36 member 1
  misc_feature: SWISSPROT Homolog: S36A1_RAT Proton-coupled amino acid transporter 1 with e-value of 2.1e-06 and BLAST sequence identity of 27.1
  misc_feature: SWISSPROT Homolog: S36A1_RAT Proton/amino acid transporter 1 Solute carrier family 36 member 1 Lysosomal amino acid transporter 1 (LYAAT-1) Neutral amino acid/proton symporter
  misc_feature 201463:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(470): Functional Homolog of  Ceres CLONE ID no. 38785 at SEQ ID NO. 1840 with e-value of 2.00E-161 and BLAST sequence identity of 60.0
MPVNGQSFALDIVKTDDDGRLKRDGNLMSASAHIITAVIGSGVLSLAWAMAQLGWIAGPISLLIFSFITWFNSCLLADCYRFPGPLGGTRTYTYMGAVKAHLGGIKYTLCGISQYTNLVGTSIGYTITASISMAAIKRSNCFHREGHDAECHASTNMFMIIFGIVQVMMSQLPNFHELVGLSTLAAIMSFAYSLIGIGLSIAAIAGGNDVKTSLTGTVVGVDVTSTEKAWNCFQAIGNIAFAYTYSSILVEIQDTLKSSPPENQVMKKASLVGVATTTVFYMLCGTLGYAAFGNVAPGNFLTGFGFYEPYWLVDFANLCIVIHLVGAYQVYGQPIFKLVEDSCRKKWPESGFITNEHPVDIPFCGVFHVNSFRLLWRTAYVIASSVIAMTFPFFNSVLGFIGAISFWPLTLYFPVQMYISQARIRRFTFTWTWLTILTVACLIVSLAAAAACVQGLIMQLRNFEPFKSVS

SEQ ID NO: 1799 - DNA, 1392 bp, Populus balsamifera subsp. trichocarpa
  misc_feature (1)..(1392): Ceres ANNOT ID no. 1514466
  misc_feature 201600:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
atggctacaatgccagtaaacgggcaaagcttcgctctagacattgtaaaaactgatgacgatggtcgcttaaagagagacggaaatttgatgtctgcgagtgcacacatcattacagctgttattgggtctggagttctatctcttgcatgggccatggctcagttgggttggattgcaggacctatttctcttctaatcttctctttcatcacttggtttaattcctgcctactagctgactgttataggttcccaggtccccttggagggacaagaacctacacttacatgggtgctgtaaaagctcatttaggaggaatcaagtacacactctgtgggatatctcaatatacaaatcttgtaggaacatcaataggatacacaatcaccgcatctataagcatggcggaaggccatgacgcagagtgccatgcatcaacgaatatgttcatgatcatatttgggattgtacaagtcatgatgagccaactacctaattttcatgagcttgtcgggctttccaccctcgctgctatcatgtcttttgcatactcactgatcggtatcggtctctccatagctgcaattgcaggagggaacgatgttaaaacaagcctaacaggaacagtggtaggggtggacgtgacaagcacagaaaaggcttggaattgctttcaagccattggaaacattgcatttgcctatacttattcctcaatccttgttgagatacaggacacactaaaatcaagcccaccagagaaccaggtgatgaagaaggcttccctagttggagtcgcaacaaccactgtattctacatgctgtgtggaacgctgggttatgcagcattcggcaacgtggcaccaggcaacttcttaacaggattcggtttttatgagccctactggctcgttgactttgctaacttatgcattgttattcaccttgttggtgcttaccaggtatatggccaaccgatattcaagctcgtggaagattcatgccgcaagaaatggccagagagtggattcataacaaacgaacaccctgttgacattccattttgtggtgtttttcatgtgaattccttcaggttattgtggagaacagcctatgtgatagcatcatctgtgattgcaatgacatttccgttcttcaacagtgttctgggtttcattggtgcgatatcattttggccattgactttgtatttcccagtacagatgtacatatcacaagcgagaattagacgatttaccttcacctggacatggctaacgattttgactgtggcctgcctgattgtatcacttgctgctgctgccgcatgcgttcaaggccttatcatgcaactccgcaacttcgagcctttcaaatctgtttcttag

SEQ ID NO: 1800 - protein, 460 aa, Populus balsamifera subsp. trichocarpa
  misc_feature (1)..(460): Ceres ANNOT ID no. 1514466
  misc_feature (23)..(448): Pfam Name: Aa_trans Pfam Description: Transmembrane amino acid transporter protein
  misc_feature: SWISSPROT Homolog: AVT4_YEAST Vacuolar amino acid transporter 4 with e-value of 1.1e-07 and BLAST sequence identity of 26.1
  misc_feature: SWISSPROT Homolog: S36A1_HUMAN Proton-coupled amino acid transporter 1 with e-value of 4.0e-07 and BLAST sequence identity of 24.5
  misc_feature: SWISSPROT Homolog: S36A1_HUMAN Proton/amino acid transporter 1 Solute carrier family 36 member 1
  misc_feature: SWISSPROT Homolog: S36A1_MOUSE Proton-coupled amino acid transporter 1 with e-value of 1.7e-06 and BLAST sequence identity of 27.1
  misc_feature: SWISSPROT Homolog: S36A1_MOUSE Proton/amino acid transporter 1 Solute carrier family 36 member 1
  misc_feature: SWISSPROT Homolog: S36A1_RAT Proton-coupled amino acid transporter 1 with e-value of 2.1e-06 and BLAST sequence identity of 27.1
  misc_feature: SWISSPROT Homolog: S36A1_RAT Proton/amino acid transporter 1 Solute carrier family 36 member 1 Lysosomal amino acid transporter 1 (LYAAT-1) Neutral amino acid/proton symporter
  misc_feature 201746:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(460): Functional Homolog of  Ceres CLONE ID no. 38785 at SEQ ID NO. 1840 with e-value of 1.60E-154 and BLAST sequence identity of 60.0
MPVNGQSFALDIVKTDDDGRLKRDGNLMSASAHIITAVIGSGVLSLAWAMAQLGWIAGPISLLIFSFITWFNSCLLADCYRFPGPLGGTRTYTYMGAVKAHLGGIKYTLCGISQYTNLVGTSIGYTITASISMAEGHDAECHASTNMFMIIFGIVQVMMSQLPNFHELVGLSTLAAIMSFAYSLIGIGLSIAAIAGGNDVKTSLTGTVVGVDVTSTEKAWNCFQAIGNIAFAYTYSSILVEIQDTLKSSPPENQVMKKASLVGVATTTVFYMLCGTLGYAAFGNVAPGNFLTGFGFYEPYWLVDFANLCIVIHLVGAYQVYGQPIFKLVEDSCRKKWPESGFITNEHPVDIPFCGVFHVNSFRLLWRTAYVIASSVIAMTFPFFNSVLGFIGAISFWPLTLYFPVQMYISQARIRRFTFTWTWLTILTVACLIVSLAAAAACVQGLIMQLRNFEPFKSVS

SEQ ID NO: 1801 - protein, 292 aa, Arabidopsis thaliana
  misc_feature (1)..(292): Ceres CLONE ID no. 38843
  misc_feature (134)..(220): Pfam Name: MtN3_slv Pfam Description: MtN3/saliva family
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
MGVIINHHFLAFIFGILGNVISFLVFLAPVPTFYRIYKRKSTESFQSLPYQVSLFSCMLWLYYALIKKDAFLLITINSFGCVVETLYIAMFFAYATREKRISAMKLFIAMNVAFFSLILMVTHFVVKTPPLQVSVLGWICVAISVSVFAAPLMIVARVIKTKSVEYMPFTLSFFLTISAVMWFAYGLFLNDICIAIPNVVGFVLGLLQMVLYLVYRNSNEKPEKINSSEEQLKSIVVMSPLGVSEVHPVVTESVDPLSEAVHHEDLSKVTKVEEPSIENGKCYVEATRPETV

SEQ ID NO: 1802 - DNA, 864 bp, Populus balsamifera subsp. trichocarpa
  misc_feature (1)..(864): Ceres ANNOT ID no. 1447896
  misc_feature 201993:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atggcagtgacgagcattctccatttggcattcacattcggcattctaggaaacattatttcaaccatggtgtacttggctccagtgccaacatttatccgaattttcaaaaaaaaatcaacagaagatttccaatcgttgccttatctcatggcattgttcagttctatgctttggctctactatgcaatgctcaaaaaagatacaattcttcttgtcaccatcaactcatttggatgtgtcatagagactacttacattgccatctatattgtttatgcaacaagagagagcagggtctcaacaatcaaactacttatttctatgaacttggggttgttctctttgatccttctccttgcacattttctagtgagtggttcagtacgtgttaaggttcttggttggctttgtgttgccttgtccgtgtgcgtctttgcagcacctttaaacatcctgaaacaagtaattcgaacaaagagcgtagagttcatgccgttcaccctgtcatttttccttactttgagcgcggtcatgtggtttgcctatggccttttactcaaggacttgtgtatcgctcttccgaacatcttgggcttcatcttggggttacttcagatgctgctatatgggatctacaggaatgcacagaaggttgaagagaaaaagaagctgccagctgaaaacttaaagagtattgtcatattaagcgcagtaggggggcctgaagtttatccggtcgatgcaaaacctgacgtgaatggaggtgctgaggagcatgaccagacagaggagtctaaggaggatgagaaaagcatggaagcttcacaggataagctccaatcaaatgaatgtgcagtttga

SEQ ID NO: 1803 - protein, 287 aa, Populus balsamifera subsp. trichocarpa
  misc_feature (1)..(287): Ceres ANNOT ID no. 1447896
  misc_feature (11)..(98): Pfam Name: MtN3_slv Pfam Description: MtN3/saliva family
  misc_feature 202082:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(287): Functional Homolog of  Ceres CLONE ID no. 38843 at SEQ ID NO. 1845 with e-value of 4.49E-86 and BLAST sequence identity of 62.4
MAVTSILHLAFTFGILGNIISTMVYLAPVPTFIRIFKKKSTEDFQSLPYLMALFSSMLWLYYAMLKKDTILLVTINSFGCVIETTYIAIYIVYATRESRVSTIKLLISMNLGLFSLILLLAHFLVSGSVRVKVLGWLCVALSVCVFAAPLNILKQVIRTKSVEFMPFTLSFFLTLSAVMWFAYGLLLKDLCIALPNILGFILGLLQMLLYGIYRNAQKVEEKKKLPAENLKSIVILSAVGGPEVYPVDAKPDVNGGAEEHDQTEESKEDEKSMEASQDKLQSNECAV

SEQ ID NO: 1804 - DNA, 849 bp, Populus balsamifera subsp. trichocarpa
  misc_feature (1)..(849): Ceres ANNOT ID no. 1438197
  misc_feature 202197:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atggcagtgatgaacatgcagcatcctttggcatttacgttcggcatcctcggtaacatcatctcattcatggtgtacctggctccagtgccaacatttatcaggattttaaggaaaaaatcaacagaagatttccaatccttgccttatctcgtggcattgtttagttctatgctttggctctactatgcaatgctcaaaaacgatgaaattcttcttgtcaccatcaactcatttggatgtgtcatagagactatatacattgccatttatatcgcttatgcaacaagagagagcaaggtctcaacaatcaaattgcttctttctatgaacatggggttgttctcgttgatcattctccttacacattttcttgcaagtggttcaactcgtgtcaaggctcttggttggctttgtgttgccttctctgtatgcgtttttgcagcacccttaaacattgtgaaacaaatcattcgaacaaagagcgttgagttcatgccgttcaccttgtcatttttccttacgttgagcgctgtcatatggtttgcctatggccttttcatcaaggacatgtgtgttgctcttccgaacatcttgggcttcgtcttggggttacttcagatgctgctgtatggaatctacagaaatgcagagaaaaagaagataccagctgaaaacttgaagagcattgtcatactaggcacattaggggcttctgaagtatatccagttgatcctcaacctgatgtgagtgcagcggagcatgaccaaacagaggagtctaaggagaatgagaaaagcatggaagcttcccacgatgacctccaatcaaatgaatgtgcagtttga

SEQ ID NO: 1805 - protein, 282 aa, Populus balsamifera subsp. trichocarpa
  misc_feature (1)..(282): Ceres ANNOT ID no. 1438197
  misc_feature (12)..(99): Pfam Name: MtN3_slv Pfam Description: MtN3/saliva family
  misc_feature 202286:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(282): Functional Homolog of  Ceres CLONE ID no. 38843 at SEQ ID NO. 1845 with e-value of 7.29E-86 and BLAST sequence identity of 62.0
MAVMNMQHPLAFTFGILGNIISFMVYLAPVPTFIRILRKKSTEDFQSLPYLVALFSSMLWLYYAMLKNDEILLVTINSFGCVIETIYIAIYIAYATRESKVSTIKLLLSMNMGLFSLIILLTHFLASGSTRVKALGWLCVAFSVCVFAAPLNIVKQIIRTKSVEFMPFTLSFFLTLSAVIWFAYGLFIKDMCVALPNILGFVLGLLQMLLYGIYRNAEKKKIPAENLKSIVILGTLGASEVYPVDPQPDVSAAEHDQTEESKENEKSMEASHDDLQSNECAV

SEQ ID NO: 1806 - protein, 277 aa, Arabidopsis thaliana
  misc_feature (1)..(277): Ceres CLONE ID no. 38891
  misc_feature (101)..(275): Pfam Name: DUF231 Pfam Description: Arabidopsis proteins of unknown function
  misc_feature: Utility: MSX Useful for making plants tolerant to low nitrogen
  misc_feature: Phenotype: WHOLE PLANT - MSX Useful for making plants tolerant to low nitrogen
MRDKTIMFVGDSLGRNQWESLICMISSSAPSINTHIIHEDPLSTFKILDYNVKVSFYRAPYLVDIDKINGKTTLKLDEISVDASNAWRTADVLLFNTGHWWSHTGSLRGWEQMETGGRYYGDMDRLVALRKGLGTWSSWVLRYNNSPLTRVFFLSVSPTHYNPNEWTSRSKTSTITQGGKSCYGQTTPFSGTTYPTSSYVNQKKVIDDVVKEMKSHVSLMDITMLSALRVDGHPSIYSGDLNPSLKRNPDRSSDCSHWCLPGLPDTWNQLFYAALLY

SEQ ID NO: 1807 - DNA, 1185 bp, Populus balsamifera subsp. trichocarpa
  misc_feature (1)..(1185): Ceres ANNOT ID no. 1440360
  misc_feature: Utility: MSX Useful for making plants tolerant to low nitrogen
  misc_feature 202495:<222: Transcription Factor
  misc_feature: Phenotype: WHOLE PLANT - MSX Useful for making plants tolerant to low nitrogen
atgtcccttgcttgtttccagtcctcttgcaatctattagcatcatgttttgcagtttttttcttggttttgcttcaaaccaagattgcaacttcagctttgataatgagcatgagaaaccaccataacaactaccaccatagaaggccaatgctgcacactaatcaaagtacctgtgcattgtttgctggctcttgggttcgtgatgaatcatacccattgtaccaatcttctaattgcccaaccattattgacgctgaattcaattgccaaatgtatggtaggcctgactctgaatatctcaagtatagatggcaaccgctcaattgtgagctcccaagattcaatgggcttgaattcttgctaaaaatgagagggaaaagtataatgtttgtgggggactcgctaggacggaatcaatgggagtccttgatttgcttggtttcatcgtcggtgcctcgaacttctacacaaatgagcagaggagatcccttttccatcttcaagttctcggagtacgatgtgactatttcattttacaaagctccatatttggtagacatagatgtggtgcaagggaagagagtactgaggctagaggagatttcgggaaatgccaacgcctggagaaacgccgatgtgctgatgtttaacaccggtcactggtggagtcacaaaggttctctccaaggatgggattacatggagtcaggaggcacatattaccaagatatggatcgtttggttgctttggaaagagggctgggaacatggtctaagtgggtggacgccaatattgacacaactcgaaccagagtctttttccagtccatctctccgacgcattacaatccaagtgaatggagcgcgggcacgactacagcaacaacgaaaaattgctatggagagactgcacctgtgagtggatcaacataccccggagaataccctgatcaaatgagggttgtggatactgtgatcaggggcatgcaaaatcctgcatatttgttggacatcacaatgctctcagagttaagaaaagatgggcatccttcaatttacagtggcaacttgagcccccagcagagggccaatcctgatcgatctgcagattgtagtcattggtgccttcctggactgcctgatacctggaatcaattgctctacactgccctgttcttttaa

SEQ ID NO: 1808 - protein, 357 aa, Populus balsamifera subsp. trichocarpa
  misc_feature (1)..(357): Ceres ANNOT ID no. 1440360
  misc_feature (186)..(355): Pfam Name: DUF231 Pfam Description: Arabidopsis proteins of unknown function
  misc_feature: Utility: MSX Useful for making plants tolerant to low nitrogen
  misc_feature 202572:<222: Transcription Factor
  misc_feature: Phenotype: WHOLE PLANT - MSX Useful for making plants tolerant to low nitrogen
  misc_feature (1)..(357): Functional Homolog of  Ceres CLONE ID no. 38891 at SEQ ID NO. 1850 with e-value of 3.70E-98 and BLAST sequence identity of 64.5
MRNHHNNYHHRRPMLHTNQSTCALFAGSWVRDESYPLYQSSNCPTIIDAEFNCQMYGRPDSEYLKYRWQPLNCELPRFNGLEFLLKMRGKSIMFVGDSLGRNQWESLICLVSSSVPRTSTQMSRGDPFSIFKFSEYDVTISFYKAPYLVDIDVVQGKRVLRLEEISGNANAWRNADVLMFNTGHWWSHKGSLQGWDYMESGGTYYQDMDRLVALERGLGTWSKWVDANIDTTRTRVFFQSISPTHYNPSEWSAGTTTATTKNCYGETAPVSGSTYPGEYPDQMRVVDTVIRGMQNPAYLLDITMLSELRKDGHPSIYSGNLSPQQRANPDRSADCSHWCLPGLPDTWNQLLYTALFF

SEQ ID NO: 1809 - DNA, 1185 bp, Populus balsamifera subsp. trichocarpa
  misc_feature (1)..(1185): Ceres ANNOT ID no. 1514613
  misc_feature: Utility: MSX Useful for making plants tolerant to low nitrogen
  misc_feature 202680:<222: Transcription Factor
  misc_feature: Phenotype: WHOLE PLANT - MSX Useful for making plants tolerant to low nitrogen
atgtctcttgcttgtatccggtcctcttgcaatctattagcatcatgttttgcgattgttttcttggttttgcttcaaaccaaggttgcaacttcagctttgataatgagcatgagaaaccaccacaaccaccaccagcatagattgccaaggctgcaagctaatcaaagtacttgtgcattgtttgtcggcacttgggttcgtgatgaatcatacccattgtatcaatcttctaattgcccaaccattattgacgctgaattcaactgccaaatgtatggcaggcctgactctgattatctcaagtacagatggcagcctctcaattgcgagctcccaagattcaatgggcttgaatttttgctaaatatgagagggaaaagtatgatgtttgtgggggactcccttggacggaatcaatgggagtctttgatttgcttgatttcatcgtcggtgcctcgaacttcaacacaaatgagtagaggagatcccttttccatcttcaagttctcggattatgatgtgtccatttccttttataaagctccatatttggtagacatagatgtggtacaagggaagagggttctgaggctagaggaaatttcggggaatgccaacgcctggagaaatgttgatgtgctgattttcaacactggtcactggtggagtcaccaaggttctctccaaggatgggattacatggaatcaggaggtacattctaccaagatatggatcgtctggttgcattggaaagagggctaagaacatgggctaaatgggtggactccaacatcgacaccactagaaccagagtctttttccagtccatctctcctacacattacaatccaagtgaatggagcgcggggacgacagtagcaacaacgagaaattgctatggcgagacaacaccaatgaatggaatgacataccctggagcataccctgatcaaatgagggtagtggatactgtgatcagagacatgcataatcctgcatatttgttggacatcacaatgctctcagagttgagaaaagatgggcacccatcaatttatagtggcgatctgagccctcagcagagggcggatccatcgggatccgcggattgtagccattggtgccttcctggactgcctgatacttggaaccaattgttctacgctgccttgttcttttaa

SEQ ID NO: 1810 - protein, 394 aa, Populus balsamifera subsp. trichocarpa
  misc_feature (1)..(394): Ceres ANNOT ID no. 1514613
  misc_feature (223)..(392): Pfam Name: DUF231 Pfam Description: Arabidopsis proteins of unknown function
  misc_feature: Utility: MSX Useful for making plants tolerant to low nitrogen
  misc_feature 202757:<222: Transcription Factor
  misc_feature: Phenotype: WHOLE PLANT - MSX Useful for making plants tolerant to low nitrogen
  misc_feature (1)..(394): Functional Homolog of  Ceres CLONE ID no. 38891 at SEQ ID NO. 1850 with e-value of 1.00E-95 and BLAST sequence identity of 62.7
MSLACIRSSCNLLASCFAIVFLVLLQTKVATSALIMSMRNHHNHHQHRLPRLQANQSTCALFVGTWVRDESYPLYQSSNCPTIIDAEFNCQMYGRPDSDYLKYRWQPLNCELPRFNGLEFLLNMRGKSMMFVGDSLGRNQWESLICLISSSVPRTSTQMSRGDPFSIFKFSDYDVSISFYKAPYLVDIDVVQGKRVLRLEEISGNANAWRNVDVLIFNTGHWWSHQGSLQGWDYMESGGTFYQDMDRLVALERGLRTWAKWVDSNIDTTRTRVFFQSISPTHYNPSEWSAGTTVATTRNCYGETTPMNGMTYPGAYPDQMRVVDTVIRDMHNPAYLLDITMLSELRKDGHPSIYSGDLSPQQRADPSGSADCSHWCLPGLPDTWNQLFYAALFF

SEQ ID NO: 1811 - protein, 312 aa, Arabidopsis thaliana
  misc_feature (1)..(312): Ceres CLONE ID no. 38950
  misc_feature (1)..(312): Also Known As Ceres CDNA ID no. 23377175
  misc_feature (1)..(312): Also Known As Ceres GEMINI ID 554E4
  misc_feature (112)..(183): Pfam Name: TFIIB Pfam Description: Transcription factor TFIIB repeat
  misc_feature 202885:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
MSDAFCSDCKRHTEVVFDHSAGDTVCSECGLVLESHSIDETSEWRTFANESGDNDPVRVGGPTNPLLADGGLTTVISKPNGSSGDFLSSSLGRWQNRGSNPDRGLIVAFKTIATMADRLGLVATIKDRANEIYKRVEDQKSSRGRNQDALLAACLYIACRQEDKPRTVKEICSVANGATKKEIGRAKEYIVKQLGLETGQLVEMGTIHAGDFMRRFCSNLGMTNQTVKAAQESVQKSEEFDIRRSPISIAAAVIYIITQLSDEKKPLRDISVATGVAEGTIRNSYKDLYPHLSKIIPAWYAKEEDLKNLQSP

SEQ ID NO: 1812 - DNA, 1002 bp, Populus balsamifera subsp. trichocarpa
  misc_feature (1)..(1002): Ceres ANNOT ID no. 1528409
  misc_feature 202977:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
atgggggacgctttctgttcagattgtaagagacacacggaggtagttttcgaccattcagcaggagacacagtatgttcagagtgtggtcttgtcttagaatctcactcgatcgatgaaacatcagagtggagaacttttgcgaatgaatcaggagacaatgatccagttcgtgttggtggaccaactaatcctttattaacagatggtggtctttctactgttattgctaaacctaatggtgcttcaggagagttcttgtccagttctcttggtaggtggcagaatcgtggatccaatcctgatcgtgggttgattacggcttttaaaactattgctacgatgtctgataggttgggccttgttgcaactatcaaggatcgggccaatgagatctacaagaaggtggaagatcaaaagtccagtagaggaaggaatcaagatgctttattggctgcttgcctctacattgcttgtcgacaagaagacaagccccgaactgtaaaggaaatttgctctgtcgccaatggagccacaaagaaggaaattggccgagcaaaagaatacatagtgaaacaactgggtttggagactggtcagtccgtggagatgggaactatacatgctggggattttatgggagtgttccttattgttcagatgcgaatatggcctcaacttgatctgcagaggcgtttctgctccaatcttggaatgtctaatcatacagttaaagctgccacagaagctgttaaaacgtcagaacagtttgatataaggaggagccctatatcaatcgcagcagcagtcatctatataattactcagctctcagatgacaagaagcctcttcgaggcttggatgcagatatttcactagcaactggagttgctgaaggaacaatcagaaattcctacaaggatctttatccccacgtgtcaaagattataccatcatggtatgccagcgaggaagatttgaagaacctttgcagtccttga

SEQ ID NO: 1813 - protein, 333 aa, Populus balsamifera subsp. trichocarpa
  misc_feature (1)..(333): Ceres ANNOT ID no. 1528409
  misc_feature (231)..(302): Pfam Name: TFIIB Pfam Description: Transcription factor TFIIB repeat
  misc_feature: SWISSPROT Homolog: TF2B2_ARATH Transcription initiation factor IIB-2 (General transcription factor TFIIB-2) (AtTFIIB2) with e-value of 1.4e-165 and BLAST sequence identity of 100.0
  misc_feature: SWISSPROT Homolog: TF2B_SOYBN Transcription initiation factor IIB (General transcription factor TFIIB) with e-value of 6.4e-152 and BLAST sequence identity of 91.7
  misc_feature: SWISSPROT Homolog: TF2B1_ARATH Transcription initiation factor IIB-1 (General transcription factor TFIIB-1) (AtTFIIB1) with e-value of 2.7e-144 and BLAST sequence identity of 85.9
  misc_feature: SWISSPROT Homolog: TF2B_ORYSA Transcription initiation factor IIB (General transcription factor TFIIB) with e-value of 1.2e-143 and BLAST sequence identity of 84.6
  misc_feature: SWISSPROT Homolog: TF2B_DROME Transcription initiation factor IIB (General transcription factor TFIIB) with e-value of 1.5e-65 and BLAST sequence identity of 49.5
  misc_feature 203089:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
  misc_feature (1)..(333): Functional Homolog of  Ceres CLONE ID no. 38950 at SEQ ID NO. 1855 with e-value of 9.19E-150 and BLAST sequence identity of 92.6
MGDAFCSDCKRHTEVVFDHSAGDTVCSECGLVLESHSIDETSEWRTFANESGDNDPVRVGGPTNPLLTDGGLSTVIAKPNGASGEFLSSSLGRWQNRGSNPDRGLITAFKTIATMSDRLGLVATIKDRANEIYKKVEDQKSSRGRNQDALLAACLYIACRQEDKPRTVKEICSVANGATKKEIGRAKEYIVKQLGLETGQSVEMGTIHAGDFMGVFLIVQMRIWPQLDLQRRFCSNLGMSNHTVKAATEAVKTSEQFDIRRSPISIAAAVIYIITQLSDDKKPLRGLDADISLATGVAEGTIRNSYKDLYPHVSKIIPSWYASEEDLKNLCSP

SEQ ID NO: 1814 - DNA, 936 bp, Populus balsamifera subsp. trichocarpa
  misc_feature (1)..(936): Ceres ANNOT ID no. 1526895
  misc_feature 203192:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
atggaagactcatactgcccggactgcaagcgattgacagagatagtgttcgaccactcggcaggagacaccatctgctctgaatgtggtttaattttggaagcccactctgtggacgagacatcagagtggcgaactttctctaacgagtcctctgatcatgaccctaaccgtgttggtggcccacttaaccctcttcttgccgacggtggtctttccactaccatttctaaaacaaatggtgggtccaacgagcttttgtcctgctctcttgggaaatggcagagccgtggcgccaatcctgatagaaaccgtattcaggctttcaagtctattgctgccatggccgacaggttggggctggttacaaccataaaggatcgagctaatgaaatatataagaaggtagaggatcaaaaacctcttaaaggacgaaatcaagatgccattttagctgcttgtctctatattgcatgtcgacaagagaacaaggcccggactgtaaaagagatttgttctgttgtcaatggaaccacgaagaaagaaattggacgagcaaaagagtttattgtgaagcatctggaggtagagatgggtcattcaatggaaatgggaaccatacatgctgcagactatctgagacgcttttgttccaatctgggaatgacgaatcaagcagttaaagctgcccatgaagctgtccagaaatctgaggagcttgacataaggaggagcccaatatcaattgcagcagctgttatttatatcataattcaactatcagatgataagaagcctcttaaagatatttcagttgtaactcaagtggctgaaggtaccatcaagaactcgtacaaggatctttctcctcatttgtctcagataatacccagctggtttgccaaggaagaggatatcaagaatctgcactcgtaa

SEQ ID NO: 1815 - protein, 311 aa, Populus balsamifera subsp. trichocarpa
  misc_feature (1)..(311): Ceres ANNOT ID no. 1526895
  misc_feature (112)..(183): Pfam Name: TFIIB Pfam Description: Transcription factor TFIIB repeat
  misc_feature: SWISSPROT Homolog: TF2B2_ARATH Transcription initiation factor IIB-2 (General transcription factor TFIIB-2) (AtTFIIB2) with e-value of 1.4e-165 and BLAST sequence identity of 100.0
  misc_feature: SWISSPROT Homolog: TF2B_SOYBN Transcription initiation factor IIB (General transcription factor TFIIB) with e-value of 6.4e-152 and BLAST sequence identity of 91.7
  misc_feature: SWISSPROT Homolog: TF2B1_ARATH Transcription initiation factor IIB-1 (General transcription factor TFIIB-1) (AtTFIIB1) with e-value of 2.7e-144 and BLAST sequence identity of 85.9
  misc_feature: SWISSPROT Homolog: TF2B_ORYSA Transcription initiation factor IIB (General transcription factor TFIIB) with e-value of 1.2e-143 and BLAST sequence identity of 84.6
  misc_feature: SWISSPROT Homolog: TF2B_DROME Transcription initiation factor IIB (General transcription factor TFIIB) with e-value of 1.5e-65 and BLAST sequence identity of 49.5
  misc_feature 203302:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
  misc_feature (1)..(311): Functional Homolog of  Ceres CLONE ID no. 38950 at SEQ ID NO. 1855 with e-value of 2.79E-132 and BLAST sequence identity of 78.1
MEDSYCPDCKRLTEIVFDHSAGDTICSECGLILEAHSVDETSEWRTFSNESSDHDPNRVGGPLNPLLADGGLSTTISKTNGGSNELLSCSLGKWQSRGANPDRNRIQAFKSIAAMADRLGLVTTIKDRANEIYKKVEDQKPLKGRNQDAILAACLYIACRQENKARTVKEICSVVNGTTKKEIGRAKEFIVKHLEVEMGHSMEMGTIHAADYLRRFCSNLGMTNQAVKAAHEAVQKSEELDIRRSPISIAAAVIYIIIQLSDDKKPLKDISVVTQVAEGTIKNSYKDLSPHLSQIIPSWFAKEEDIKNLHS

SEQ ID NO: 1816 - DNA, 1215 bp, Populus balsamifera subsp. trichocarpa
  misc_feature (1)..(1215): Ceres ANNOT ID no. 1453647
  misc_feature 203402:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
atgggggacgctttctgttcagattgtaagaaacacacagaggtagtatgcgaccattcagcaggagacacagtgtgttcagagtgtggtcttgtcttagaatctcactcgatcgatgaaacatcagagtggagaatctttgcgaatgaatcaggagataatgatccagttcgtgtcggtggacctactaatcctttgttaacagacggtggcctttctactgttattgctaaacctaatggtgcttccggagatttcttgtcgacttctcttggtcggtggcagaaccgtgggtccaatcctgatcgtgggttgattctggcttttaaaaccattgcaaccatgtctgacagatttggggttttgttggatgtttatgtttgtgtttgtgttctggatttgattttacatgagagggatttgaattgggatcctcctgcatttggtctggttgggccttgttgcaacaatcaagagtactaccaggcatctaaaattacaatgaatagaacaatcacaaatattaaaagcgcttccccatctctttctcttacgaggaagggtttggatgcttttcttgtatggttgttcatgagaatttcccctaatgtttctttttccttctccggcgatgcatttttcataatattgaaggatcgggctaatgagatctataagaaggtggaggatcaaaagtccagtagaggaaggaatcaggatgctttattggctgcttgcctctatattgcttgtcgacaagaagacaagccccgaaccgtaaaggaaatttgctctgtcgccaatggagccacaaagaaggaaattggccgagcaaaagaatacatagtgaaacaactgggtttggaggcaggtcagtctgtggagatgggaactatacatgctggggattttatgagacgtttctgttccaatcttggaatgtctaatcatacagttaaagctgccacagaagctgttaagacgtcagaacagtttgatataaggaggagtcctatatcaatcgcagcagctgttatttatataataactcagctttcagacgacaagaagcctctccgagatatttcactagcaactggagttgctgaaggaacaatcaggaattcgtacaaggatctttatccccacgtatcaaagataataccagcatggtatgcgaatgaggaagatctgaagaaccttagcagtccttga

SEQ ID NO: 1817 - protein, 404 aa, Populus balsamifera subsp. trichocarpa
  misc_feature (1)..(404): Ceres ANNOT ID no. 1453647
  misc_feature (305)..(373): Pfam Name: TFIIB Pfam Description: Transcription factor TFIIB repeat
  misc_feature: SWISSPROT Homolog: TF2B2_ARATH Transcription initiation factor IIB-2 (General transcription factor TFIIB-2) (AtTFIIB2) with e-value of 1.4e-165 and BLAST sequence identity of 100.0
  misc_feature: SWISSPROT Homolog: TF2B_SOYBN Transcription initiation factor IIB (General transcription factor TFIIB) with e-value of 6.4e-152 and BLAST sequence identity of 91.7
  misc_feature: SWISSPROT Homolog: TF2B1_ARATH Transcription initiation factor IIB-1 (General transcription factor TFIIB-1) (AtTFIIB1) with e-value of 2.7e-144 and BLAST sequence identity of 85.9
  misc_feature: SWISSPROT Homolog: TF2B_ORYSA Transcription initiation factor IIB (General transcription factor TFIIB) with e-value of 1.2e-143 and BLAST sequence identity of 84.6
  misc_feature: SWISSPROT Homolog: TF2B_DROME Transcription initiation factor IIB (General transcription factor TFIIB) with e-value of 1.5e-65 and BLAST sequence identity of 49.5
  misc_feature 203522:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
  misc_feature (1)..(404): Functional Homolog of  Ceres CLONE ID no. 38950 at SEQ ID NO. 1855 with e-value of 1.20E-131 and BLAST sequence identity of 89.7
MGDAFCSDCKKHTEVVCDHSAGDTVCSECGLVLESHSIDETSEWRIFANESGDNDPVRVGGPTNPLLTDGGLSTVIAKPNGASGDFLSTSLGRWQNRGSNPDRGLILAFKTIATMSDRFGVLLDVYVCVCVLDLILHERDLNWDPPAFGLVGPCCNNQEYYQASKITMNRTITNIKSASPSLSLTRKGLDAFLVWLFMRISPNVSFSFSGDAFFIILKDRANEIYKKVEDQKSSRGRNQDALLAACLYIACRQEDKPRTVKEICSVANGATKKEIGRAKEYIVKQLGLEAGQSVEMGTIHAGDFMRRFCSNLGMSNHTVKAATEAVKTSEQFDIRRSPISIAAAVIYIITQLSDDKKPLRDISLATGVAEGTIRNSYKDLYPHVSKIIPAWYANEEDLKNLSSP

SEQ ID NO: 1818 - protein, 212 aa, Arabidopsis thaliana
  misc_feature (1)..(212): Ceres CLONE ID no. 38973
  misc_feature: Phenotype: FLOWER - Aborted fertility Useful for sterility, genetic confinement systems
  misc_feature: Phenotype: INFLORESCENCE - Asecondary Branching Useful for making ornamental plants with modified flowers
  misc_feature: Phenotype: INFLORESCENCE - Two Leaf Branching Useful for modifying plant architecture, ie increasing foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (51)..(51): Xaa is any aa, unknown, or other
MKEITGSGIFSVYEENDDSELASANSATNGKSRTFQQPPAAIVSHISFGEXEIVTPKKPATVPEVAKQRELSGTLEYQSDAKLNKQFSDAKCKELSGHNIFAPPPEIKLRPTVRALAYKDNFDLGESDTKPDGELKTAKKIADRKFTDLSGNNVFKSDVSSPSSATAERLLSTAKLKEISGNDIFADAKAQSRDYFGGVRKPPGGESSIALV

SEQ ID NO: 1819 - DNA, 885 bp, Populus balsamifera subsp. trichocarpa
  misc_feature (1)..(885): Ceres ANNOT ID no. 1451899
  misc_feature 203737:<222: Transcription Factor
  misc_feature: Phenotype: FLOWER - Aborted fertility Useful for sterility, genetic confinement systems
  misc_feature: Phenotype: INFLORESCENCE - Asecondary Branching Useful for making ornamental plants with modified flowers
  misc_feature: Phenotype: INFLORESCENCE - Two Leaf Branching Useful for modifying plant architecture, ie increasing foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggagaggagcactccggttaggaaaccacacacttccactgcagatctgctcacgtggtccgagactccgccacctgattctccctccgttggctccgctcctcgccctactcggtcccaccagccttcagatgggatcagtaaggtggtgtttggaggccaagttaccgaggaggagttcgagagcttaaataaacggaaaccttgttctgggtataaaatgaaggagatgactggcagtggcatttttgcagccaatggagaagatgatactgccgaatctggcagtgccaaccccattcctaacagcaaaacaggattgcgaatgtaccagcaagcaattgctggaatcagtcacatttcatttgcagaggatgatagtgtttctcccaaaaagcctactactctgcccgaggtagcaaaacaacgggagttaagtggaaccttagaaagtgaatccgatgccaagttgaagaagcagatctccggtgccaagtccaaagagctcagtggacatgacatctttgcaccccctcctgaaattttaccacggccgacaactgtgcgtgctttggctttgcaagaaagcatccaattgggtgaaccgtctccgcatgatcctgttggaggtcagcagcctagcgaggaatcagtagtgaagacagcaaagaaaattaataatcagaaattcaatgaactttctggaaatgacatattcaaaggtgatgctcctccatcatctgcggagaaacctctgagtgtggcaaaattgcgagagatgagcggcaatgatatatttgctgatgggaaggtagagtctcgagacttcctaggtggcgtacgcaagccccctggcggcgagagcagcattgccctggtttaa

SEQ ID NO: 1820 - protein, 220 aa, Populus balsamifera subsp. trichocarpa
  misc_feature (1)..(220): Ceres ANNOT ID no. 1451899
  misc_feature 203820:<222: Transcription Factor
  misc_feature: Phenotype: FLOWER - Aborted fertility Useful for sterility, genetic confinement systems
  misc_feature: Phenotype: INFLORESCENCE - Asecondary Branching Useful for making ornamental plants with modified flowers
  misc_feature: Phenotype: INFLORESCENCE - Two Leaf Branching Useful for modifying plant architecture, ie increasing foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(220): Functional Homolog of  Ceres CLONE ID no. 38973 at SEQ ID NO. 1862 with e-value of 9.50E-61 and BLAST sequence identity of 66.8
MKEMTGSGIFAANGEDDTAESGSANPIPNSKTGLRMYQQAIAGISHISFAEDDSVSPKKPTTLPEVAKQRELSGTLESESDAKLKKQISGAKSKELSGHDIFAPPPEILPRPTTVRALALQESIQLGEPSPHDPVGGQQPSEESVVKTAKKINNQKFNELSGNDIFKGDAPPSSAEKPLSVAKLREMSGNDIFADGKVESRDFLGGVRKPPGGESSIALV

SEQ ID NO: 1821 - DNA, 840 bp, Populus balsamifera subsp. trichocarpa
  misc_feature (1)..(840): Ceres ANNOT ID no. 1496367
  misc_feature 203923:<222: Transcription Factor
  misc_feature: Phenotype: FLOWER - Aborted fertility Useful for sterility, genetic confinement systems
  misc_feature: Phenotype: INFLORESCENCE - Asecondary Branching Useful for making ornamental plants with modified flowers
  misc_feature: Phenotype: INFLORESCENCE - Two Leaf Branching Useful for modifying plant architecture, ie increasing foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggagaggagcactccggttaggaaaccacacacttccactgcagatctgctcacgtggtccgagactccgcctcctgattctcccgccgttggctctgcttctcgctccactcggccccaccagccgtcagacgggatcagtaaggtggtgtttggaggtcaagttaccgaggaggagttcgagagcttaaataaacggaaaccttgttctgggtataaaatgaaggagatgactggcagtggcatttttgcagccaatggagagaatgatttggctgaatctggcagtcaagcaattgctggaatcagtcacatttcatttgcagaggaagagagtgtttctcccaaaaagcctactaccctgcctgaggtggcaaagcagcgcgagctaagtggaaccttagaaagtgagtctgatgccatgttgaagaagcagatctccactgccaagtccaaggagctcagtggacatgacatctttgcaccccctcctgaaattttaccacggccaacaactgtgcgtgctttagctttgcaagaaagcatccaattgggtgaaccttctccacgaaatcctgctggagatcaaatgtctagtgaagaatcagtggtgaagacagcaaagaaaatttataaccagaaattcaatgaactttcaggaaataacgtattcaaaggtgatgctcctccatctactgcagagaaaccgctgagtgtggcaaaattgcgagagatgagcggcagtgatatattttctgatgggaaggtagagtctcgagactacctaggtggcgtacgcaagcctcctggcggtgagagcagcattgctttggtttaa

SEQ ID NO: 1822 - protein, 205 aa, Populus balsamifera subsp. trichocarpa
  misc_feature (1)..(205): Ceres ANNOT ID no. 1496367
  misc_feature 204006:<222: Transcription Factor
  misc_feature: Phenotype: FLOWER - Aborted fertility Useful for sterility, genetic confinement systems
  misc_feature: Phenotype: INFLORESCENCE - Asecondary Branching Useful for making ornamental plants with modified flowers
  misc_feature: Phenotype: INFLORESCENCE - Two Leaf Branching Useful for modifying plant architecture, ie increasing foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(205): Functional Homolog of  Ceres CLONE ID no. 38973 at SEQ ID NO. 1862 with e-value of 2.10E-56 and BLAST sequence identity of 69.2
MKEMTGSGIFAANGENDLAESGSQAIAGISHISFAEEESVSPKKPTTLPEVAKQRELSGTLESESDAMLKKQISTAKSKELSGHDIFAPPPEILPRPTTVRALALQESIQLGEPSPRNPAGDQMSSEESVVKTAKKIYNQKFNELSGNNVFKGDAPPSTAEKPLSVAKLREMSGSDIFSDGKVESRDYLGGVRKPPGGESSIALV

SEQ ID NO: 1823 - protein, 152 aa, Arabidopsis thaliana
  misc_feature (1)..(152): Ceres CLONE ID no. 39127
  misc_feature (31)..(91): Pfam Name: HMA Pfam Description: Heavy-metal-associated domain
  misc_feature: Phenotype: FLOWER - Reduced fertility Useful for sterility, genetic confinement systems
MGALDSLSEYISDYFRVTRKRRKRKVMQTVNIKVKMDCDGCERRVKNAVSSMKGVKSVEVNRKIHKVTVSGYVEPKKVLKRIERTGKKAEIWPYVPYNMVAYPYAVGTYDKKAPAGYVRKSEQSQLQLLPGAPENHYISLFSDENPNACTVM

SEQ ID NO: 1824 - DNA, 453 bp, Populus balsamifera subsp. trichocarpa
  misc_feature (1)..(453): Ceres ANNOT ID no. 1463852
  misc_feature 204164:<222: Transcription Factor
  misc_feature: Phenotype: FLOWER - Reduced fertility Useful for sterility, genetic confinement systems
atgggtgctcttgacgatctctcagattacctctcagacttgtttacagttgccaggaagaagaggaaaagaaaaccaatgcagacagttgatatcaaagtgaagatggattgtgatggctgtgaaaggagggttaaaaattctgtttcctccatgaagggcgttaaatcagtagaagtgaacagaaagcaaagccgggtgacagtcagcgggaatgttgagccaaacaaggtcttgaagaaagtgaagagcacaggaaagagggctgagttttggccatatgtcccatacaacttggtggcttatccttatgctgctcaagcctatgataagaaagcacctgcaggctatgtgaagaatgtggttcaggcacttccgagccccaacgcaacagatgaaagatttacatctatgtttagcgatgaaaacccgaatgcatgttccatcatgtag

SEQ ID NO: 1825 - protein, 150 aa, Populus balsamifera subsp. trichocarpa
  misc_feature (1)..(150): Ceres ANNOT ID no. 1463852
  misc_feature (31)..(91): Pfam Name: HMA Pfam Description: Heavy-metal-associated domain
  misc_feature 204211:<222: Transcription Factor
  misc_feature: Phenotype: FLOWER - Reduced fertility Useful for sterility, genetic confinement systems
  misc_feature (1)..(150): Functional Homolog of  Ceres CLONE ID no. 39127 at SEQ ID NO. 1867 with e-value of 6.39E-55 and BLAST sequence identity of 71.3
MGALDDLSDYLSDLFTVARKKRKRKPMQTVDIKVKMDCDGCERRVKNSVSSMKGVKSVEVNRKQSRVTVSGNVEPNKVLKKVKSTGKRAEFWPYVPYNLVAYPYAAQAYDKKAPAGYVKNVVQALPSPNATDERFTSMFSDENPNACSIM

SEQ ID NO: 1826 - protein, 294 aa, Arabidopsis thaliana
  misc_feature (1)..(294): Ceres CLONE ID no. 39231
  misc_feature (1)..(294): Also Known As Ceres CDNA ID no. 23649144
  misc_feature (1)..(294): Also Known As Ceres GEMINI ID 534C3
  misc_feature (215)..(286): Pfam Name: RRM_1 Pfam Description: RNA recognition motif. (a.k.a. RRM RBD, or RNP domain)
  misc_feature 204295:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MTIDSQQKTSKFRWGEMDEDDDFDFLLPPKQVIGPDENGLKTTIEYKFNDEGNKVKITTRTRVRKLASARLNKRAMERRNWPKFGDAANEEAGSHLTMVSTEEILLERPRAPGTKADESKATGDGLSQLGKGGAVLMVCRICHKKGDHWTSKCPYKDLAAPTDVFIDKPPTGESSTMSAAPGTGKAAYVPPSMRAGADRSAVGSDMRRRNDENSVRVTNLSEDTREPDLMELFHPFGAVTRVYVAIDQKTGVSRGFGFVNFVSREDAQRAINKLNGYGYDNLILRVEWATPRPT

SEQ ID NO: 1827 - DNA, 882 bp, Populus balsamifera subsp. trichocarpa
  misc_feature (1)..(882): Ceres ANNOT ID no. 1511404
  misc_feature 204378:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgtctgtagacatatcagcgaaaccaagcaagctgcgttggggtgagctagacgaggacgatggtgaagatctagactttctgttacctcccaaacaggtgattgggcccgatgataacgggatcaaaaaagtgatcgagtacaaatttaacgatgatggtaacaagattaagattacgactacgacccgagtccgcaaactcgctaaggctcggttgagcaagcgggccgtggagaggcgaaactggccgaagtttggagatgcagttcacgaggatgttgggagcaggcttactatggtttctactgaagagatcttgcttgaaagacctagagcccctggtacgaaagcagacgaagccaagatggctggagataacttggctcaattaggtaaaggtggggctgttctcatggtttgcagaacttgtggtaagaagggtgatcactggacatcacggtgcccatacaaggatcttgctcaaccgcctgaaaccttcatcgataaacctgctgcaacagagacagctatggctgcctctggagccaccaagggtgcttatgtcccaccaagcatgagggctggtgcagagagaactacaggatcggacatgaggcgcaggaatgaagaaaactcagtcagggttaccaatttatcagaggacaccagagaacctgacttgcttgaacttttccgcacatttggtcatgtgagtcgtgtttatgttgctattgatcagaagactggtgtcagcaggggctttggttttgtgaactttgtaagcaaggaagatgctgagagggcaataaacaagctcaatggatatggttatgacaatctaatccttcgagtcgaatgggccacaccaagatcaaactag

SEQ ID NO: 1828 - protein, 293 aa, Populus balsamifera subsp. trichocarpa
  misc_feature (1)..(293): Ceres ANNOT ID no. 1511404
  misc_feature (214)..(285): Pfam Name: RRM_1 Pfam Description: RNA recognition motif. (a.k.a. RRM RBD, or RNP domain)
  misc_feature: SWISSPROT Homolog: IF34_MOUSE Eukaryotic translation initiation factor 3 subunit 4 (eIF-3 delta) with e-value of 2.2e-48 and BLAST sequence identity of 43.0
  misc_feature: SWISSPROT Homolog: IF34_MOUSE eIF3 p44 (eIF-3 RNA-binding subunit) (eIF3 p42) (Eif3p42) (eIF3g)
  misc_feature: SWISSPROT Homolog: IF34_HUMAN Eukaryotic translation initiation factor 3 subunit 4 (eIF-3 delta) (eIF3 p44) (eIF-3 RNA-binding subunit) (eIF3 p42) (eIF3g) with e-value of 7.3e-48 and BLAST sequence identity of 42.6
  misc_feature: SWISSPROT Homolog: IF34_SCHPO Probable eukaryotic translation initiation factor 3 RNA-binding subunit with e-value of 8.7e-45 and BLAST sequence identity of 38.4
  misc_feature: SWISSPROT Homolog: IF34_SCHPO eIF-3 RNA-binding subunit (eIF3 p33) Translation initiation factor eIF3, p33 subunit
  misc_feature: SWISSPROT Homolog: IF34_YEAST Probable eukaryotic translation initiation factor 3 RNA-binding subunit with e-value of 1.7e-32 and BLAST sequence identity of 36.1
  misc_feature: SWISSPROT Homolog: IF34_YEAST eIF-3 RNA-binding subunit (eIF3 p33) Translation initiation factor eIF3, p33 subunit
  misc_feature: SWISSPROT Homolog: IF34_CAEEL Eukaryotic translation initiation factor 3 subunit 4 (eIF-3 delta) with e-value of 6.3e-28 and BLAST sequence identity of 47.1
  misc_feature: SWISSPROT Homolog: IF34_CAEEL eIF3 p44 (eIF-3 RNA-binding subunit) (eIF3 p42) (Eif3p42) (eIF3g)
  misc_feature: SWISSPROT Homolog: IF34_SCHPO eIF-3 RNA-binding subunit (eIF3 p33) Translation initiation factor eIF3, p33 subunit
  misc_feature 204516:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(293): Functional Homolog of  Ceres CLONE ID no. 39231 at SEQ ID NO. 1870 with e-value of 1.99E-124 and BLAST sequence identity of 80.6
MSVDISAKPSKLRWGELDEDDGEDLDFLLPPKQVIGPDDNGIKKVIEYKFNDDGNKIKITTTTRVRKLAKARLSKRAVERRNWPKFGDAVHEDVGSRLTMVSTEEILLERPRAPGTKADEAKMAGDNLAQLGKGGAVLMVCRTCGKKGDHWTSRCPYKDLAQPPETFIDKPAATETAMAASGATKGAYVPPSMRAGAERTTGSDMRRRNEENSVRVTNLSEDTREPDLLELFRTFGHVSRVYVAIDQKTGVSRGFGFVNFVSKEDAERAINKLNGYGYDNLILRVEWATPRSN

SEQ ID NO: 1829 - DNA, 885 bp, Populus balsamifera subsp. trichocarpa
  misc_feature (1)..(885): Ceres ANNOT ID no. 1464821
  misc_feature 204607:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgtctgtagtagacaaatcagcgaagccagccaagatgcgttggggagaactagacgaggaagacggggaagatctagactttttattacctcccaaacaagtgattgggcctgatgagaacgggataaaaaaagtgatcgagtataaattcaacgacgatggtaacaaggttaaaattactaccaccacgcgagttcgcaagctcgccaaggctcggttgagcaagcgggccctggagaggcgaaactggtccaagttcggagatgccattcatgaggatgttggtagcaggcttactatggtttctactgaagagatcttgcttgaaaggcctagagctcatggtgccaaagcagatgaaaccaagatagctggagataacttggctcagctaggtaaaggaggggctgttctcatggtttgcagaacttgtggtaagaaaggagatcactggacatcacgatgcccatacaaggatcttgctcaaccacctgaaacctttatcgacaaaccccctgcaacggagacagctatggctgccaccggagcaaccaagggtgcttatgtcccgccaagcatgagggcaggtgcagagagaactgttggatcagatatgaggcgcaggaatgaagaaaattcagttcgggttactaatttatcagaggacaccagggagcctgatttgcttgaactattccgcacatttggtcaagtgagtcgtgtctatgttgctattgatcagaagaccggtgtcagcaggggctttggttttgtcaactttgtaagcaaggaagatgctgagagggcaataaacaagctcaacggatatggttatgacaatctaattcttcgagtcgaatgggcaacacccagaacaaactag

SEQ ID NO: 1830 - protein, 294 aa, Populus balsamifera subsp. trichocarpa
  misc_feature (1)..(294): Ceres ANNOT ID no. 1464821
  misc_feature (215)..(286): Pfam Name: RRM_1 Pfam Description: RNA recognition motif. (a.k.a. RRM RBD, or RNP domain)
  misc_feature: SWISSPROT Homolog: IF34_MOUSE Eukaryotic translation initiation factor 3 subunit 4 (eIF-3 delta) with e-value of 2.2e-48 and BLAST sequence identity of 43.0
  misc_feature: SWISSPROT Homolog: IF34_MOUSE eIF3 p44 (eIF-3 RNA-binding subunit) (eIF3 p42) (Eif3p42) (eIF3g)
  misc_feature: SWISSPROT Homolog: IF34_HUMAN Eukaryotic translation initiation factor 3 subunit 4 (eIF-3 delta) (eIF3 p44) (eIF-3 RNA-binding subunit) (eIF3 p42) (eIF3g) with e-value of 7.3e-48 and BLAST sequence identity of 42.6
  misc_feature: SWISSPROT Homolog: IF34_SCHPO Probable eukaryotic translation initiation factor 3 RNA-binding subunit with e-value of 8.7e-45 and BLAST sequence identity of 38.4
  misc_feature: SWISSPROT Homolog: IF34_SCHPO eIF-3 RNA-binding subunit (eIF3 p33) Translation initiation factor eIF3, p33 subunit
  misc_feature: SWISSPROT Homolog: IF34_YEAST Probable eukaryotic translation initiation factor 3 RNA-binding subunit with e-value of 1.7e-32 and BLAST sequence identity of 36.1
  misc_feature: SWISSPROT Homolog: IF34_YEAST eIF-3 RNA-binding subunit (eIF3 p33) Translation initiation factor eIF3, p33 subunit
  misc_feature: SWISSPROT Homolog: IF34_CAEEL Eukaryotic translation initiation factor 3 subunit 4 (eIF-3 delta) with e-value of 6.3e-28 and BLAST sequence identity of 47.1
  misc_feature: SWISSPROT Homolog: IF34_CAEEL eIF3 p44 (eIF-3 RNA-binding subunit) (eIF3 p42) (Eif3p42) (eIF3g)
  misc_feature: SWISSPROT Homolog: IF34_SCHPO eIF-3 RNA-binding subunit (eIF3 p33) Translation initiation factor eIF3, p33 subunit
  misc_feature 204745:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(294): Functional Homolog of  Ceres CLONE ID no. 39231 at SEQ ID NO. 1870 with e-value of 9.70E-123 and BLAST sequence identity of 80.4
MSVVDKSAKPAKMRWGELDEEDGEDLDFLLPPKQVIGPDENGIKKVIEYKFNDDGNKVKITTTTRVRKLAKARLSKRALERRNWSKFGDAIHEDVGSRLTMVSTEEILLERPRAHGAKADETKIAGDNLAQLGKGGAVLMVCRTCGKKGDHWTSRCPYKDLAQPPETFIDKPPATETAMAATGATKGAYVPPSMRAGAERTVGSDMRRRNEENSVRVTNLSEDTREPDLLELFRTFGQVSRVYVAIDQKTGVSRGFGFVNFVSKEDAERAINKLNGYGYDNLILRVEWATPRTN

SEQ ID NO: 1831 - protein, 214 aa, Arabidopsis thaliana
  misc_feature (1)..(214): Ceres CLONE ID no. 39279
  misc_feature (1)..(214): Also Known As Ceres CDNA ID no. 23362522
  misc_feature (1)..(214): Also Known As Ceres GEMINI ID 535C7
  misc_feature (4)..(173): Pfam Name: Arf Pfam Description: ADP-ribosylation factor family
  misc_feature 204856:<222: Transcription Factor
  misc_feature: Phenotype: Activates expression of the gene endogenous to the AtHMGS (SEQ ID NO 4144) regalutory region Useful for modulating Terpenoid Biosynthesis
MSDDDERGEEYLFKIVIIGDSAVGKSNLLTRYACNEFNPNSKATIGVEFQTQSMLIDGKEVKAQIWDTAGQERFRAVTSAYYRGAVGALVVYDITRSSTFENVGRWLDELNTHSDTTVAKMLIGNKCDLESIRAVSVEEGKSLAESEGLFFMETSALDSTNVKTAFEMVIREIYSNISRKQLNSDSYKEELTLNRVSLVKNENEGTKTFSCCSR

SEQ ID NO: 1832 - DNA, 654 bp, Populus balsamifera subsp. trichocarpa
  misc_feature (1)..(654): Ceres ANNOT ID no. 1525349
  misc_feature 204923:<222: Transcription Factor
  misc_feature: Phenotype: Activates expression of the gene endogenous to the AtHMGS (SEQ ID NO 4144) regalutory region Useful for modulating Terpenoid Biosynthesis
atgtcatcagacgaggaaggaggagaggagtacttgttcaagatcgtgataattggggattctgcagtgggaaaatcaaatctactttctcgatatgcaagaaatgagttcaatttgcattcaaaagccacaataggagtggagtttcagacccagagcatggaaattgatggaaaagaagttaaggctcagatttgggacactgccggtcaagagaggtttagggctgttacttccgcttactatagaggtgctgtcggtgctctcattgtttatgatatcagtcgccgtactacttttgatagtgtcggtcgatggcttgatgagcttaaaacccattcagatacaactgtagcaatgatgctggttggaaacaaatgtgatttggagaatatcagggatgttagtgtggaggaagccaaatgcctcgcagaagcagaaggcttattcttcatggaaacatctgcccttgactcaacaaatgttaagaaggcttttgagattgttattcgagagatatacaacaatgtgagcaggaaggtcttgaattctgatacatacaaagctgaattgtctctgaatagggtaacccttgttaataatgggaatgattccaagcaagctcagagctacttttcctgctgctccaggtga

SEQ ID NO: 1833 - protein, 217 aa, Populus balsamifera subsp. trichocarpa
  misc_feature (1)..(217): Ceres ANNOT ID no. 1525349
  misc_feature (14)..(175): Pfam Name: Ras Pfam Description: Ras family
  misc_feature: SWISSPROT Homolog: ARA4_ARATH Ras-related protein ARA-4 with e-value of 2.3e-108 and BLAST sequence identity of 99.1
  misc_feature: SWISSPROT Homolog: ARA1_ARATH Ras-related protein ARA-1 with e-value of 2.0e-91 and BLAST sequence identity of 82.9
  misc_feature: SWISSPROT Homolog: YPTC6_CHLRE Ras-related protein YPTC6 with e-value of 7.8e-60 and BLAST sequence identity of 56.5
  misc_feature: SWISSPROT Homolog: RB11B_ARATH Ras-related protein Rab11 with e-value of 1.6e-59 and BLAST sequence identity of 58.0
  misc_feature: SWISSPROT Homolog: RB11E_LOTJA Ras-related protein Rab11E with e-value of 2.6e-59 and BLAST sequence identity of 56.3
  misc_feature 205011:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(217): Functional Homolog of  Ceres CLONE ID no. 39279 at SEQ ID NO. 1875 with e-value of 4.80E-89 and BLAST sequence identity of 82.2
MSSDEEGGEEYLFKIVIIGDSAVGKSNLLSRYARNEFNLHSKATIGVEFQTQSMEIDGKEVKAQIWDTAGQERFRAVTSAYYRGAVGALIVYDISRRTTFDSVGRWLDELKTHSDTTVAMMLVGNKCDLENIRDVSVEEAKCLAEAEGLFFMETSALDSTNVKKAFEIVIREIYNNVSRKVLNSDTYKAELSLNRVTLVNNGNDSKQAQSYFSCCSR

SEQ ID NO: 1834 - DNA, 711 bp, Populus balsamifera subsp. trichocarpa
  misc_feature (1)..(711): Ceres ANNOT ID no. 1445751
  misc_feature 205086:<222: Transcription Factor
  misc_feature: Phenotype: Activates expression of the gene endogenous to the AtHMGS (SEQ ID NO 4144) regalutory region Useful for modulating Terpenoid Biosynthesis
atgggtcgagaacaagaagaaggggaagggggtgaagagtacttgttcaagatagtggtcataggagactctgctgttgggaaatccaacttgttgtcaagatttgctagaaatgagtttgatagcaattcaaaggctacaattggggtagagttccagacccaagtggtggatattgatggcaaagaaatcaaggcacagatctgggacactgctggtcaagagaggtttagagctgtcacctctgcttactatagaggtgccgttggtgctctcattgtttatgatatcaccaggaggacaagctttgatagtgttaagaggtggcttgatgaacttggcagatggttggctcataaccaatccaagcatgaagtggaaaagtgggggaaagcagctcattgcgacactgcgatcgctagaatgcttgtagggaacaagtgtgatcttgacagtatcagagaagtgagtagagacgagggcaagagccttgcggaggaagaaagtctattcttcatggagacatctgcccttgattctactaatgttgaagctgctttcgaggttgttatccgtgaaatctacaataatatgagcaggaaaatcttaaactctgattcatacaaggctgagctgacagccaatcgagtgagcctggtgaatggggacacctcgtccaaaaagtatggcttctcttgctgcaatacatag

SEQ ID NO: 1835 - protein, 236 aa, Populus balsamifera subsp. trichocarpa
  misc_feature (1)..(236): Ceres ANNOT ID no. 1445751
  misc_feature (16)..(149): Pfam Name: MMR_HSR1 Pfam Description: GTPase of unknown function
  misc_feature: SWISSPROT Homolog: ARA4_ARATH Ras-related protein ARA-4 with e-value of 2.3e-108 and BLAST sequence identity of 99.1
  misc_feature: SWISSPROT Homolog: ARA1_ARATH Ras-related protein ARA-1 with e-value of 2.0e-91 and BLAST sequence identity of 82.9
  misc_feature: SWISSPROT Homolog: YPTC6_CHLRE Ras-related protein YPTC6 with e-value of 7.8e-60 and BLAST sequence identity of 56.5
  misc_feature: SWISSPROT Homolog: RB11B_ARATH Ras-related protein Rab11 with e-value of 1.6e-59 and BLAST sequence identity of 58.0
  misc_feature: SWISSPROT Homolog: RB11E_LOTJA Ras-related protein Rab11E with e-value of 2.6e-59 and BLAST sequence identity of 56.3
  misc_feature 205176:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(236): Functional Homolog of  Ceres CLONE ID no. 39279 at SEQ ID NO. 1875 with e-value of 2.80E-77 and BLAST sequence identity of 75.8
MGREQEEGEGGEEYLFKIVVIGDSAVGKSNLLSRFARNEFDSNSKATIGVEFQTQVVDIDGKEIKAQIWDTAGQERFRAVTSAYYRGAVGALIVYDITRRTSFDSVKRWLDELGRWLAHNQSKHEVEKWGKAAHCDTAIARMLVGNKCDLDSIREVSRDEGKSLAEEESLFFMETSALDSTNVEAAFEVVIREIYNNMSRKILNSDSYKAELTANRVSLVNGDTSSKKYGFSCCNT

SEQ ID NO: 1836 - DNA, 621 bp, Populus balsamifera subsp. trichocarpa
  misc_feature (1)..(621): Ceres ANNOT ID no. 1498733
  misc_feature 205254:<222: Transcription Factor
  misc_feature: Phenotype: Activates expression of the gene endogenous to the AtHMGS (SEQ ID NO 4144) regalutory region Useful for modulating Terpenoid Biosynthesis
atgggtcgagaacaagaagaaggggaagggggtgaagagtacttgttcaagatagtggtcataggagactctgctgttgggaaatccaacttgttgtcaagatttgctagaaatgagtttgatagcaattcaaaggctacaattggggtagagttccagacccaagtggtggatattgatggcaaagaaatcaaggcacagatctgggacactgctggtcaagagaggtttagagctgtcacctctgcttactatagaggtgccgttggtgctctcattgtttatgatatcaccaggaggacaagctttgatagtgttaagaggtggcttgatgaacttggcaggaacaagtgtgatcttgacagtatcagagaagtgagtagagacgagggcaagagccttgcggaggaagaaagtctattcttcatggagacatctgcccttgattctactaatgttgaagctgctttcgaggttgttatccgtgaaatctacaataatatgagcaggaaaatcttaaactctgattcatacaaggctgagctgacagccaatcgagtgagcctggtgaatggggacacctcgtccaaaaagtatggcttctcttgctgcaatacatag

SEQ ID NO: 1837 - protein, 206 aa, Populus balsamifera subsp. trichocarpa
  misc_feature (1)..(206): Ceres ANNOT ID no. 1498733
  misc_feature (11)..(164): Pfam Name: Arf Pfam Description: ADP-ribosylation factor family
  misc_feature: SWISSPROT Homolog: ARA4_ARATH Ras-related protein ARA-4 with e-value of 2.3e-108 and BLAST sequence identity of 99.1
  misc_feature: SWISSPROT Homolog: ARA1_ARATH Ras-related protein ARA-1 with e-value of 2.0e-91 and BLAST sequence identity of 82.9
  misc_feature: SWISSPROT Homolog: YPTC6_CHLRE Ras-related protein YPTC6 with e-value of 7.8e-60 and BLAST sequence identity of 56.5
  misc_feature: SWISSPROT Homolog: RB11B_ARATH Ras-related protein Rab11 with e-value of 1.6e-59 and BLAST sequence identity of 58.0
  misc_feature: SWISSPROT Homolog: RB11E_LOTJA Ras-related protein Rab11E with e-value of 2.6e-59 and BLAST sequence identity of 56.3
  misc_feature 205342:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(206): Functional Homolog of  Ceres CLONE ID no. 39279 at SEQ ID NO. 1875 with e-value of 1.10E-73 and BLAST sequence identity of 76.8
MGREQEEGEGGEEYLFKIVVIGDSAVGKSNLLSRFARNEFDSNSKATIGVEFQTQVVDIDGKEIKAQIWDTAGQERFRAVTSAYYRGAVGALIVYDITRRTSFDSVKRWLDELGRNKCDLDSIREVSRDEGKSLAEEESLFFMETSALDSTNVEAAFEVVIREIYNNMSRKILNSDSYKAELTANRVSLVNGDTSSKKYGFSCCNT

SEQ ID NO: 1838 - protein, 202 aa, Arabidopsis thaliana
  misc_feature (1)..(202): Ceres CLONE ID no. 39286
  misc_feature (111)..(202): Pfam Name: DUF493 Pfam Description: Protein of unknown function (DUF493)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MACKTILRSVFVSESRRTSGARRCFFLPPSPASVPVHGLFPAPKSLCFNGFASVPERATRLNCSHNDQSDQGPPQEAVLKAISEVSKTDGRVGKTTNMIIGGTVADDSAKDWLELDQKVNTYPTERGFTAIGTGGNDFVHAMVVAVESVIDRQIPEDCVKQTLSSKGKYVSVNIGPIQVVSSEQVQAVYNAMRRDERMKYFL

SEQ ID NO: 1839 - DNA, 1881 bp, Populus balsamifera subsp. trichocarpa
  misc_feature (1)..(1881): Ceres ANNOT ID no. 1447961
  misc_feature 205516:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggtgtgcaggagtgtgttgcgttccgttttgacaacagaagcatggatgatgatgatgatgataccacctctccatccaaaccgagccatcatctattctttctcatcagcaagaaccgttggattttcaagcagtaaaacaacaagcattagggctccagagtctcatcactttggaagaacaaaaccagctcttgttaattgtttctgctcttataacaatgaaggcgacgaggatcaagaaccccctcaagaagctgtgcttaaagctatttctgaggtgtcaaagacacaagcgagggttggacaaaccacaaatgttgttattggcggtacggtagtagatgattccactgatgaatggcttgctttggataagaaggtaaactcgtatccaacagttagaggatttactgcaattggtacaggaggtgatgattttgtgcaagctatggttattgctgttgaatctgtaattcaacaaccaatccctgagggtcaagtgaggcagaaagtatcttcgaggggcaaatatgtgtcagtcaacattggtcctgttcaagttgtatctagcgagcaggttcaagctgtatacaacaccatgagaaaagatgatcgcatgaattttttgaagtctagagaatgtggccttatattacttctgcctcctaataccagtggtagtggaacaactctgttagtaagaagtgttcttacagtcaagctaacgacagtttctaccatttatcaggccttacaggtgactgcttccactacagtggtcaagtcaaggaaggcagtaggaatcatgttgactaatgtagaacagctggtgctaaatgtagattccaaggatgtgctagaaagaaaacttgaagattcaccctcagcttctgtttccaattcaccaacacagaatagcagaccaaccagcatggttaaggcacacaccataattccagctcatttgatagccgaagccatatcaacgatccgtggccttgacctgagatggtccggaccaataacactcagtgaaatgcaatatgtgaggcagtatgttcttgcaaagtatcctcaatattgcaatggtattgtggcagatggagatagcacatttaatcttaccaatctctgcatcgatgaggaatcgtctaaaagcacaccagacagcaagcgcggtctcccccagagttttggcgctagagagtccactcctaaattcactcgcagcctatctgatcttgacaaaacacaattggaggcttcaagactagtagatattcttaacaaaaaaacttctttccaaggcaacttcatctcaatcccagaaattcaagtgcaaaatagagccctgaaacattgtggcctaagcgaagctgattacttggtcattttcatgcccaactacagggatgctatggtgataattggagagagctaccctttcttcagaggtaattactacatgacaataatcgaggaagaaaatgacatgatacgtgaatttgctactagtaaagaatcaaaggttattccaatgccagaaacttggttggacctaaggattaaaggatcacaacttagccaatactttaggaggaaatgcaagcacatcccaaagggccttttctcttatcctgctattgtcaatgagaccaggtattctatgcattggatatccgaggcccacagaaattcatggcatgttctccttgacgccacaggcttggtttccggtgaggagagattggcccttgcactccaccggcccgacttcgtgttatgtacacttgataatacacatgcccagccatcaaaaatcacctgcctcttggttagaaaattatcatttgatacttctgcatccttggactag

SEQ ID NO: 1840 - protein, 626 aa, Populus balsamifera subsp. trichocarpa
  misc_feature (1)..(626): Ceres ANNOT ID no. 1447961
  misc_feature (121)..(211): Pfam Name: DUF493 Pfam Description: Protein of unknown function (DUF493)
  misc_feature 205646:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(626): Functional Homolog of  Ceres CLONE ID no. 39286 at SEQ ID NO. 1882 with e-value of 7.60E-52 and BLAST sequence identity of 60.0
MVCRSVLRSVLTTEAWMMMMMIPPLHPNRAIIYSFSSARTVGFSSSKTTSIRAPESHHFGRTKPALVNCFCSYNNEGDEDQEPPQEAVLKAISEVSKTQARVGQTTNVVIGGTVVDDSTDEWLALDKKVNSYPTVRGFTAIGTGGDDFVQAMVIAVESVIQQPIPEGQVRQKVSSRGKYVSVNIGPVQVVSSEQVQAVYNTMRKDDRMNFLKSRECGLILLLPPNTSGSGTTLLVRSVLTVKLTTVSTIYQALQVTASTTVVKSRKAVGIMLTNVEQLVLNVDSKDVLERKLEDSPSASVSNSPTQNSRPTSMVKAHTIIPAHLIAEAISTIRGLDLRWSGPITLSEMQYVRQYVLAKYPQYCNGIVADGDSTFNLTNLCIDEESSKSTPDSKRGLPQSFGARESTPKFTRSLSDLDKTQLEASRLVDILNKKTSFQGNFISIPEIQVQNRALKHCGLSEADYLVIFMPNYRDAMVIIGESYPFFRGNYYMTIIEEENDMIREFATSKESKVIPMPETWLDLRIKGSQLSQYFRRKCKHIPKGLFSYPAIVNETRYSMHWISEAHRNSWHVLLDATGLVSGEERLALALHRPDFVLCTLDNTHAQPSKITCLLVRKLSFDTSASLD

SEQ ID NO: 1841 - DNA, 636 bp, Populus balsamifera subsp. trichocarpa
  misc_feature (1)..(636): Ceres ANNOT ID no. 1490936
  misc_feature 205834:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggcgtgcacgagtgtgctgcgttctgttttgacaacagatccatggatgattcctctccatcaaaaccgagccatcatctattattctctctcatcgagaaaaaccgttggagtttcaaccagtaagacaccaagcattagggctcctgaatttcatcactttggaagaccaagacccactcatgttaattgtttcagctcttataataataacaacaacaatgaagatgaccaggatcaagacccccctcaagaagctgttctcaaagctatttctgcatacggtcacgtattgatagaaacttctgttgatgatccagaggtatcaaggacagaagggagggttggacaaaccacaaatgtggttattggtggtacggtagcagatgattctactaatgaatggcttgctttggataagaaggtaaactcatatccaacagttagaggatttactgcaataggtacaggaggtgatgattttgtgcaagctatggttattgctgttgaatctgtaattcaacaaccaatccctgaggtggtgcattaccaaaccatttctcatcaaatagtgttggttcaagctgtatacaatgccatgaggagagatgatcggatgaagtactttttgtag

SEQ ID NO: 1842 - protein, 211 aa, Populus balsamifera subsp. trichocarpa
  misc_feature (1)..(211): Ceres ANNOT ID no. 1490936
  misc_feature (194)..(211): Pfam Name: DUF493 Pfam Description: Protein of unknown function (DUF493)
  misc_feature 205922:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(211): Functional Homolog of  Ceres CLONE ID no. 39286 at SEQ ID NO. 1882 with e-value of 2.19E-38 and BLAST sequence identity of 60.5
MACTSVLRSVLTTDPWMIPLHQNRAIIYYSLSSRKTVGVSTSKTPSIRAPEFHHFGRPRPTHVNCFSSYNNNNNNEDDQDQDPPQEAVLKAISAYGHVLIETSVDDPEVSRTEGRVGQTTNVVIGGTVADDSTNEWLALDKKVNSYPTVRGFTAIGTGGDDFVQAMVIAVESVIQQPIPEVVHYQTISHQIVLVQAVYNAMRRDDRMKYFL

SEQ ID NO: 1843 - protein, 113 aa, Arabidopsis thaliana
  misc_feature (1)..(113): Ceres CLONE ID no. 39319
  misc_feature (25)..(106): Pfam Name: SUI1 Pfam Description: Translation initiation factor SUI1
  misc_feature: Phenotype: INFLORESCENCE - Early Flowering Useful for modulating flowering time
  misc_feature: Phenotype: WHOLE PLANT - Small Useful for modulating plant size
MSELDSQVPTAFDPFADANVEDSGAGTKEYVHIRVQQRNGRKSLTTVQGLKKEYSYTKILKDLKKEFCCNGTVVQDSELGQVIQLQGDQRKNVSTFLVQAGLVKKDNIKIHGF

SEQ ID NO: 1844 - DNA, 342 bp, Populus balsamifera subsp. trichocarpa
  misc_feature (1)..(342): Ceres ANNOT ID no. 1456036
  misc_feature 206091:<222: Transcription Factor
  misc_feature: Phenotype: INFLORESCENCE - Early Flowering Useful for modulating flowering time
  misc_feature: Phenotype: WHOLE PLANT - Small Useful for modulating plant size
atgtctgaattcgacaacgctattccaactgcttttgatccctttgctgaggcaaatgctgaggactccggtgctgggacaaaagattatgttcatgtgcgtgtacagcagcgaaatgggaggaaaagcctaactactgtgcaagggttgaagaaggaatatagctacaacaagatacttaaggacctcaagaaagagttctgctgcaatggaactgttgtccaggaccctgagttaggccaggtcattcaacttcagggtgatcaaaggaagaacgtttccacctttctcgtgcaggctggcattgtgaagaaggaaaatatcaagattcatggtttctaa

SEQ ID NO: 1845 - protein, 113 aa, Populus balsamifera subsp. trichocarpa
  misc_feature (1)..(113): Ceres ANNOT ID no. 1456036
  misc_feature (25)..(106): Pfam Name: SUI1 Pfam Description: Translation initiation factor SUI1
  misc_feature: SWISSPROT Homolog: SUI11_ARATH Protein translation factor SUI1 homolog 1 with e-value of 5.1e-56 and BLAST sequence identity of 99.1
  misc_feature: SWISSPROT Homolog: SUI1_BRAOL Protein translation factor SUI1 homolog (Translation initiation factor nps45) with e-value of 4.6e-55 and BLAST sequence identity of 97.3
  misc_feature: SWISSPROT Homolog: SUI12_ARATH Protein translation factor SUI1 homolog 2 with e-value of 3.2e-54 and BLAST sequence identity of 95.6
  misc_feature: SWISSPROT Homolog: SUI1_SALBA Protein translation factor SUI1 homolog with e-value of 3.0e-51 and BLAST sequence identity of 87.6
  misc_feature: SWISSPROT Homolog: SUI1_MAIZE Protein translation factor SUI1 homolog (GOS2 protein) with e-value of 1.3e-48 and BLAST sequence identity of 83.5
  misc_feature 206178:<222: Transcription Factor
  misc_feature: Phenotype: INFLORESCENCE - Early Flowering Useful for modulating flowering time
  misc_feature: Phenotype: WHOLE PLANT - Small Useful for modulating plant size
  misc_feature (1)..(113): Functional Homolog of  Ceres CLONE ID no. 39319 at SEQ ID NO. 1887 with e-value of 4.70E-52 and BLAST sequence identity of 89.3
MSEFDNAIPTAFDPFAEANAEDSGAGTKDYVHVRVQQRNGRKSLTTVQGLKKEYSYNKILKDLKKEFCCNGTVVQDPELGQVIQLQGDQRKNVSTFLVQAGIVKKENIKIHGF

SEQ ID NO: 1846 - DNA, 342 bp, Populus balsamifera subsp. trichocarpa
  misc_feature (1)..(342): Ceres ANNOT ID no. 1470131
  misc_feature 206242:<222: Transcription Factor
  misc_feature: Phenotype: INFLORESCENCE - Early Flowering Useful for modulating flowering time
  misc_feature: Phenotype: WHOLE PLANT - Small Useful for modulating plant size
atgtctgatctcgacgtccaaactcccactgcttttgatccttttgctgatgcaaatgctgaggactccggtgctggggcaaaagagtacgtgcacattcgtacacagcaacgcaatggtagaaaaagcttgacaactgtgcaaggtttgaaaaaagaattcagctataacaagatactcaaggacctcaagaaagaattctgctgtaatggtacagtggtgcaggaccttgaattaggccaggttattcaacttcaaggtgaccagcgcaagaatgtctctacctttcttgttcaggctggcattgtgaagaaggagaatattaaaattcatggtttctaa

SEQ ID NO: 1847 - protein, 113 aa, Populus balsamifera subsp. trichocarpa
  misc_feature (1)..(113): Ceres ANNOT ID no. 1470131
  misc_feature (25)..(106): Pfam Name: SUI1 Pfam Description: Translation initiation factor SUI1
  misc_feature: SWISSPROT Homolog: SUI11_ARATH Protein translation factor SUI1 homolog 1 with e-value of 5.1e-56 and BLAST sequence identity of 99.1
  misc_feature: SWISSPROT Homolog: SUI1_BRAOL Protein translation factor SUI1 homolog (Translation initiation factor nps45) with e-value of 4.6e-55 and BLAST sequence identity of 97.3
  misc_feature: SWISSPROT Homolog: SUI12_ARATH Protein translation factor SUI1 homolog 2 with e-value of 3.2e-54 and BLAST sequence identity of 95.6
  misc_feature: SWISSPROT Homolog: SUI1_SALBA Protein translation factor SUI1 homolog with e-value of 3.0e-51 and BLAST sequence identity of 87.6
  misc_feature: SWISSPROT Homolog: SUI1_MAIZE Protein translation factor SUI1 homolog (GOS2 protein) with e-value of 1.3e-48 and BLAST sequence identity of 83.5
  misc_feature 206329:<222: Transcription Factor
  misc_feature: Phenotype: INFLORESCENCE - Early Flowering Useful for modulating flowering time
  misc_feature: Phenotype: WHOLE PLANT - Small Useful for modulating plant size
  misc_feature (1)..(113): Functional Homolog of  Ceres CLONE ID no. 39319 at SEQ ID NO. 1887 with e-value of 1.59E-51 and BLAST sequence identity of 90.2
MSDLDVQTPTAFDPFADANAEDSGAGAKEYVHIRTQQRNGRKSLTTVQGLKKEFSYNKILKDLKKEFCCNGTVVQDLELGQVIQLQGDQRKNVSTFLVQAGIVKKENIKIHGF

SEQ ID NO: 1848 - DNA, 342 bp, Populus balsamifera subsp. trichocarpa
  misc_feature (1)..(342): Ceres ANNOT ID no. 1466936
  misc_feature 206393:<222: Transcription Factor
  misc_feature: Phenotype: INFLORESCENCE - Early Flowering Useful for modulating flowering time
  misc_feature: Phenotype: WHOLE PLANT - Small Useful for modulating plant size
atgtctgatttcgacgcccaaactccttcagcttatgatccttttgctgatgcaaatgccgaggactctggtgctgggacaaaagattatgtgcacattcgtatacagcaacgcaatggtaggaaaagcttgacaactgtgcaaggtttgaaaaaagaattcagctataacaagatactaaaggacctcaagaaagagttctgctgtaatggtacagtggtgcaggaccctgaattaggccaggttattcaacttcaaggtgaccagcgcaagaatgtatcgaccttccttgttcaggctggcattgtgaagaaggaaagcattaaaattcatggtttctaa

SEQ ID NO: 1849 - protein, 113 aa, Populus balsamifera subsp. trichocarpa
  misc_feature (1)..(113): Ceres ANNOT ID no. 1466936
  misc_feature (25)..(106): Pfam Name: SUI1 Pfam Description: Translation initiation factor SUI1
  misc_feature: SWISSPROT Homolog: SUI11_ARATH Protein translation factor SUI1 homolog 1 with e-value of 5.1e-56 and BLAST sequence identity of 99.1
  misc_feature: SWISSPROT Homolog: SUI1_BRAOL Protein translation factor SUI1 homolog (Translation initiation factor nps45) with e-value of 4.6e-55 and BLAST sequence identity of 97.3
  misc_feature: SWISSPROT Homolog: SUI12_ARATH Protein translation factor SUI1 homolog 2 with e-value of 3.2e-54 and BLAST sequence identity of 95.6
  misc_feature: SWISSPROT Homolog: SUI1_SALBA Protein translation factor SUI1 homolog with e-value of 3.0e-51 and BLAST sequence identity of 87.6
  misc_feature: SWISSPROT Homolog: SUI1_MAIZE Protein translation factor SUI1 homolog (GOS2 protein) with e-value of 1.3e-48 and BLAST sequence identity of 83.5
  misc_feature 206480:<222: Transcription Factor
  misc_feature: Phenotype: INFLORESCENCE - Early Flowering Useful for modulating flowering time
  misc_feature: Phenotype: WHOLE PLANT - Small Useful for modulating plant size
  misc_feature (1)..(113): Functional Homolog of  Ceres CLONE ID no. 39319 at SEQ ID NO. 1887 with e-value of 8.69E-51 and BLAST sequence identity of 86.7
MSDFDAQTPSAYDPFADANAEDSGAGTKDYVHIRIQQRNGRKSLTTVQGLKKEFSYNKILKDLKKEFCCNGTVVQDPELGQVIQLQGDQRKNVSTFLVQAGIVKKESIKIHGF

SEQ ID NO: 1850 - DNA, 357 bp, Populus balsamifera subsp. trichocarpa
  misc_feature (1)..(357): Ceres ANNOT ID no. 1541455
  misc_feature 206544:<222: Transcription Factor
  misc_feature: Phenotype: INFLORESCENCE - Early Flowering Useful for modulating flowering time
  misc_feature: Phenotype: WHOLE PLANT - Small Useful for modulating plant size
atgtttaaattaccagttcatgctaacagcgcttcttcattggatgacatagatcccttcgctgaggcaaatgctgatgactctggtgctggggcaaaggattatgttcatgtgcgtgtacaacagcgaaatggcaggaaaagcctgactactgttcaagggttgaagaaggaatatagctacagcaagatacaaaaggacctcaagaaagagttctgctgcaatggaactgttgtccaggaccctgagttaggccaggtcattcaacttcagggtgatcaaaggaagaacgtttccaccttcctcattcagtctggcattgcgaagaaggaaaacatcaagattcatggtttctaa

SEQ ID NO: 1851 - protein, 118 aa, Populus balsamifera subsp. trichocarpa
  misc_feature (1)..(118): Ceres ANNOT ID no. 1541455
  misc_feature (30)..(111): Pfam Name: SUI1 Pfam Description: Translation initiation factor SUI1
  misc_feature: SWISSPROT Homolog: SUI11_ARATH Protein translation factor SUI1 homolog 1 with e-value of 5.1e-56 and BLAST sequence identity of 99.1
  misc_feature: SWISSPROT Homolog: SUI1_BRAOL Protein translation factor SUI1 homolog (Translation initiation factor nps45) with e-value of 4.6e-55 and BLAST sequence identity of 97.3
  misc_feature: SWISSPROT Homolog: SUI12_ARATH Protein translation factor SUI1 homolog 2 with e-value of 3.2e-54 and BLAST sequence identity of 95.6
  misc_feature: SWISSPROT Homolog: SUI1_SALBA Protein translation factor SUI1 homolog with e-value of 3.0e-51 and BLAST sequence identity of 87.6
  misc_feature: SWISSPROT Homolog: SUI1_MAIZE Protein translation factor SUI1 homolog (GOS2 protein) with e-value of 1.3e-48 and BLAST sequence identity of 83.5
  misc_feature 206631:<222: Transcription Factor
  misc_feature: Phenotype: INFLORESCENCE - Early Flowering Useful for modulating flowering time
  misc_feature: Phenotype: WHOLE PLANT - Small Useful for modulating plant size
  misc_feature (1)..(118): Functional Homolog of  Ceres CLONE ID no. 39319 at SEQ ID NO. 1887 with e-value of 4.60E-45 and BLAST sequence identity of 86.1
MFKLPVHANSASSLDDIDPFAEANADDSGAGAKDYVHVRVQQRNGRKSLTTVQGLKKEYSYSKIQKDLKKEFCCNGTVVQDPELGQVIQLQGDQRKNVSTFLIQSGIAKKENIKIHGF

SEQ ID NO: 1852 - DNA, 435 bp, Populus balsamifera subsp. trichocarpa
  misc_feature (1)..(435): Ceres ANNOT ID no. 1456037
  misc_feature 206695:<222: Transcription Factor
  misc_feature: Phenotype: INFLORESCENCE - Early Flowering Useful for modulating flowering time
  misc_feature: Phenotype: WHOLE PLANT - Small Useful for modulating plant size
atggatgaaatagatcccttcgctgaggcaaatgctgaggactctggtgctgggacaaaagattatgttcatgtgcgcgtgcagcagcgaaatgggaggaaaagcctgactactgttcaagggttgaagaaggaatatagctacaacaagatacttaaggacctcaagaaagagttctgctgcaatggaactgttgtccaggaccctgagttaggccagattctccattacccacgcatcccttgtggaacgatccattgcatgttgggagctatctctgacattcctttattccctttcttgcttagaaatttccatcattatctcttacagttggtcattcaacttcagggtgatcaaaggaagaacgtatccaccttcctcgtgcaggctggcattgtgaagaaggaaagtatcaagattcatggtttctaa

SEQ ID NO: 1853 - protein, 144 aa, Populus balsamifera subsp. trichocarpa
  misc_feature (1)..(144): Ceres ANNOT ID no. 1456037
  misc_feature (17)..(74): Pfam Name: SUI1 Pfam Description: Translation initiation factor SUI1
  misc_feature: SWISSPROT Homolog: SUI11_ARATH Protein translation factor SUI1 homolog 1 with e-value of 5.1e-56 and BLAST sequence identity of 99.1
  misc_feature: SWISSPROT Homolog: SUI1_BRAOL Protein translation factor SUI1 homolog (Translation initiation factor nps45) with e-value of 4.6e-55 and BLAST sequence identity of 97.3
  misc_feature: SWISSPROT Homolog: SUI12_ARATH Protein translation factor SUI1 homolog 2 with e-value of 3.2e-54 and BLAST sequence identity of 95.6
  misc_feature: SWISSPROT Homolog: SUI1_SALBA Protein translation factor SUI1 homolog with e-value of 3.0e-51 and BLAST sequence identity of 87.6
  misc_feature: SWISSPROT Homolog: SUI1_MAIZE Protein translation factor SUI1 homolog (GOS2 protein) with e-value of 1.3e-48 and BLAST sequence identity of 83.5
  misc_feature 206786:<222: Transcription Factor
  misc_feature: Phenotype: INFLORESCENCE - Early Flowering Useful for modulating flowering time
  misc_feature: Phenotype: WHOLE PLANT - Small Useful for modulating plant size
  misc_feature (1)..(144): Functional Homolog of  Ceres CLONE ID no. 39319 at SEQ ID NO. 1887 with e-value of 9.39E-38 and BLAST sequence identity of 91.0
MDEIDPFAEANAEDSGAGTKDYVHVRVQQRNGRKSLTTVQGLKKEYSYNKILKDLKKEFCCNGTVVQDPELGQILHYPRIPCGTIHCMLGAISDIPLFPFLLRNFHHYLLQLVIQLQGDQRKNVSTFLVQAGIVKKESIKIHGF

SEQ ID NO: 1854 - protein, 315 aa, Arabidopsis thaliana
  misc_feature (1)..(315): Ceres CLONE ID no. 39351
  misc_feature (66)..(305): Pfam Name: TIM Pfam Description: Triosephosphate isomerase
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 1855 - DNA, 942 bp, Populus balsamifera subsp. trichocarpa
  misc_feature (1)..(942): Ceres ANNOT ID no. 1503551
  misc_feature 206958:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
atggctatgctctcaacttcactctccggtccaaaatctgcaacttcgtattgcgcgcctgagttctccggtcttcgccgtttatgtccaaacaacaataccaacaactctcattcccagtcttttcttcgcttctcttctccccggaaacctcttagaggagtctttgccatggctggcactggacagttctttgttggaggaaattggaaatgtaatggaacaaaagaatccattaccacgctcatttcagacctgaacagcgcaaagttggagtctgatgtcgacgttgttgtagcacctccctttatttacatcgatcaggtcaagtcttccttaacagacaggattgagatatcagctcagaactcttgggtcagtaagggtggggctttcacaggagaaatcagtgtggaacaactgaaagacattggctgcaagtgggttatccttgggcattctgagcgtagacatgtaattggcgaagacgatcagtttataggaaagaaggcagcttatgccttgagccagggtgttggagtaattgcttgtattggtgaactgttagaagaaagagaagcagggaaaacttttgatgtttgttatcagcaactgaaggcgtatgcagatgctgtgcccagctgggataatatagtcattgcatatgagcctgtttgggctattggtactggtgtagtggccacacctgcgcaggctcaggaagtacatgtagctgttcgtgattggcttaaaaacaatgtctcggcagaagtcgcatcaaaaacacgcattatatatggaggatccgtgaatggaggaaactgtgctgaacttgcaaagcaagaagatattgacggtttccttgttggtggtgcatccttgaagggccccgagtttgctaccattgtcaattctgtaacatccaagaaagttgctgcttaa

SEQ ID NO: 1856 - protein, 311 aa, Populus balsamifera subsp. trichocarpa
  misc_feature (1)..(311): Ceres ANNOT ID no. 1503551
  misc_feature (62)..(301): Pfam Name: TIM Pfam Description: Triosephosphate isomerase
  misc_feature: SWISSPROT Homolog: TPIC_ARATH Triosephosphate isomerase, (EC 5.3.1.1) (TIM) (Triose-phosphate isomerase) with e-value of 7.5e-165 and BLAST sequence identity of 100.0
  misc_feature: SWISSPROT Homolog: TPIC_SPIOL Triosephosphate isomerase, (EC 5.3.1.1) (TIM) (Triose-phosphate isomerase) with e-value of 5.7e-135 and BLAST sequence identity of 82.4
  misc_feature: SWISSPROT Homolog: TPIC_FRAAN Triosephosphate isomerase, (EC 5.3.1.1) (TIM) (Triose-phosphate isomerase) with e-value of 3.3e-132 and BLAST sequence identity of 82.0
  misc_feature: SWISSPROT Homolog: TPIC_SECCE Triosephosphate isomerase, (EC 5.3.1.1) (TIM) (Triose-phosphate isomerase) with e-value of 6.6e-118 and BLAST sequence identity of 77.9
  misc_feature: SWISSPROT Homolog: TPIS_STELP Triosephosphate isomerase, cytosolic (EC 5.3.1.1) (TIM) (Triose-phosphate isomerase) with e-value of 3.4e-98 and BLAST sequence identity of 73.3
  misc_feature 207075:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
  misc_feature (1)..(311): Functional Homolog of  Ceres CLONE ID no. 39351 at SEQ ID NO. 1898 with e-value of 1.19E-126 and BLAST sequence identity of 83.3
MLSTSLSGPKSATSYCAPEFSGLRRLCPNNNTNNSHSQSFLRFSSPRKPLRGVFAMAGTGQFFVGGNWKCNGTKESITTLISDLNSAKLESDVDVVVAPPFIYIDQVKSSLTDRIEISAQNSWVSKGGAFTGEISVEQLKDIGCKWVILGHSERRHVIGEDDQFIGKKAAYALSQGVGVIACIGELLEEREAGKTFDVCYQQLKAYADAVPSWDNIVIAYEPVWAIGTGVVATPAQAQEVHVAVRDWLKNNVSAEVASKTRIIYGGSVNGGNCAELAKQEDIDGFLVGGASLKGPEFATIVNSVTSKKVAA

SEQ ID NO: 1857 - DNA, 948 bp, Populus balsamifera subsp. trichocarpa
  misc_feature (1)..(948): Ceres ANNOT ID no. 1460689
  misc_feature 207182:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
atggcaatgctctccacctcactttccggtccaaaatctgccacttcgtattgcgcgcctgagttctccggtcttcgccgtttatgtccaaacagcaacaacaacaacagcaactctcattcccagtcttttcttcgcttctgttctccccgaaaacctcttaaaagcgttgttgccatggctggcactggaacgttctttgttggaggaaattggaaatgtaatggaacaaaagaatccattaccaagcttgtttcagacttgaacagcacgaagctggagtctgatgttgatgttgttgtagcacctccctttgtttacatcgatcaggtgaagtcttccttaactgacagaattgagatagcagctcaaaactcttgggtcagtaaaggtggggctttcacaggagaaatcagtgtggaacaattgaaagatattggctgcaagtgggttattcttgggcattctgagcgtaggcatgtaattggcgaagacaatcagtttataggaaagaaggcagcttatgccttaagccagggtcttgaggtaattgcttgtattggtgaactgctagaagaaagagaagcagggaaaacttttgatgtttgttatcagcaactgaaggcatttgcagatgctgtgcccagctgggataatattgttattgcatacgaacctgtgtgggctattggtactggtgtagtggccacacctgtgcaggctcaggaagtgcatgtagctatccgtgattggcttaaaaacaatgtctcggcagaagttgcatcaaaaacacgtattatctatggaggatctgtaaatggaggcaattgtgctgaacttgcgaagcaagaagatattgatggtttccttgttggtggtgcatccttgaagggccccgagtttgctaccattgtcaattctgtaacattcaagaaagttgctgcttaa

SEQ ID NO: 1858 - protein, 313 aa, Populus balsamifera subsp. trichocarpa
  misc_feature (1)..(313): Ceres ANNOT ID no. 1460689
  misc_feature (64)..(303): Pfam Name: TIM Pfam Description: Triosephosphate isomerase
  misc_feature: SWISSPROT Homolog: TPIC_ARATH Triosephosphate isomerase, (EC 5.3.1.1) (TIM) (Triose-phosphate isomerase) with e-value of 7.5e-165 and BLAST sequence identity of 100.0
  misc_feature: SWISSPROT Homolog: TPIC_SPIOL Triosephosphate isomerase, (EC 5.3.1.1) (TIM) (Triose-phosphate isomerase) with e-value of 5.7e-135 and BLAST sequence identity of 82.4
  misc_feature: SWISSPROT Homolog: TPIC_FRAAN Triosephosphate isomerase, (EC 5.3.1.1) (TIM) (Triose-phosphate isomerase) with e-value of 3.3e-132 and BLAST sequence identity of 82.0
  misc_feature: SWISSPROT Homolog: TPIC_SECCE Triosephosphate isomerase, (EC 5.3.1.1) (TIM) (Triose-phosphate isomerase) with e-value of 6.6e-118 and BLAST sequence identity of 77.9
  misc_feature: SWISSPROT Homolog: TPIS_STELP Triosephosphate isomerase, cytosolic (EC 5.3.1.1) (TIM) (Triose-phosphate isomerase) with e-value of 3.4e-98 and BLAST sequence identity of 73.3
  misc_feature 207299:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
  misc_feature (1)..(313): Functional Homolog of  Ceres CLONE ID no. 39351 at SEQ ID NO. 1898 with e-value of 1.99E-124 and BLAST sequence identity of 81.1
MLSTSLSGPKSATSYCAPEFSGLRRLCPNSNNNNSNSHSQSFLRFCSPRKPLKSVVAMAGTGTFFVGGNWKCNGTKESITKLVSDLNSTKLESDVDVVVAPPFVYIDQVKSSLTDRIEIAAQNSWVSKGGAFTGEISVEQLKDIGCKWVILGHSERRHVIGEDNQFIGKKAAYALSQGLEVIACIGELLEEREAGKTFDVCYQQLKAFADAVPSWDNIVIAYEPVWAIGTGVVATPVQAQEVHVAIRDWLKNNVSAEVASKTRIIYGGSVNGGNCAELAKQEDIDGFLVGGASLKGPEFATIVNSVTFKKVAA

SEQ ID NO: 1859 - DNA, 942 bp, Populus balsamifera subsp. trichocarpa
  misc_feature (1)..(942): Ceres ANNOT ID no. 1513952
  misc_feature 207406:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
atgctctccacctcactttccggtccaaaatctgccacttcgtattgcgcgcctgagttctccggtcttcgccgtttatgtccaaacagcaacaacaacaacagcaactctcattcccagtcttttcttcgcttctgttctccccgaaaacctcttaaaagcgttgttgccatggctggcactggaacgttctttgttggaggaaattggaaatgtaatggaacaaaagaatccattaccaagcttgtttcagacttgaacagcacgaagctggagtctgatgttgatgttgttgtagcacctccctttgtttacatcgatcaggtgaagtcttccttaactgacagaattgagatagcagctcaaaactcttgggtcagtaaaggtggggctttcacaggagaaatcagtgtggaacaattgaaagatattggctgcaagtgggttattcttgggcattctgagcgtaggcatgtaattggcgaagacaatcagtttataggaaagaaggcagcttatgccttaagccagggtcttgaggtaattgcttgtattggtgaactgctagaagaaagagaagcagggaaaacttttgatgtttgttatcagcaactgaaggcatttgcagatgctgtgcccagctgggataatattgttattgcatacgaacctgtgtgggctattggtactggtgtagtggccacacctgtgcaggctcaggaagtgcatgtagctatccgtgattggcttaaaaacaatgtctcggcagaagttgcatcaaaaacacgtattatctatggaggatctgtaaatggaggcaattgtgctgaacttgcgaagcaagaagatattgatggtttccttgttggtggtgcatccttgaagggccccgagtttgctaccattgtcaattctgtaacattcaagaaagttgctgcttaa

SEQ ID NO: 1860 - protein, 313 aa, Populus balsamifera subsp. trichocarpa; identical to SEQ ID NO: 1858
  misc_feature (1)..(313): Ceres ANNOT ID no. 1513952
  misc_feature (64)..(303): Pfam Name: TIM Pfam Description: Triosephosphate isomerase
  misc_feature: SWISSPROT Homolog: TPIC_ARATH Triosephosphate isomerase, (EC 5.3.1.1) (TIM) (Triose-phosphate isomerase) with e-value of 7.5e-165 and BLAST sequence identity of 100.0
  misc_feature: SWISSPROT Homolog: TPIC_SPIOL Triosephosphate isomerase, (EC 5.3.1.1) (TIM) (Triose-phosphate isomerase) with e-value of 5.7e-135 and BLAST sequence identity of 82.4
  misc_feature: SWISSPROT Homolog: TPIC_FRAAN Triosephosphate isomerase, (EC 5.3.1.1) (TIM) (Triose-phosphate isomerase) with e-value of 3.3e-132 and BLAST sequence identity of 82.0
  misc_feature: SWISSPROT Homolog: TPIC_SECCE Triosephosphate isomerase, (EC 5.3.1.1) (TIM) (Triose-phosphate isomerase) with e-value of 6.6e-118 and BLAST sequence identity of 77.9
  misc_feature: SWISSPROT Homolog: TPIS_STELP Triosephosphate isomerase, cytosolic (EC 5.3.1.1) (TIM) (Triose-phosphate isomerase) with e-value of 3.4e-98 and BLAST sequence identity of 73.3
  misc_feature 207523:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
  misc_feature (1)..(313): Functional Homolog of  Ceres CLONE ID no. 39351 at SEQ ID NO. 1898 with e-value of 1.99E-124 and BLAST sequence identity of 81.1

SEQ ID NO: 1861 - DNA, 975 bp, Populus balsamifera subsp. trichocarpa
  misc_feature (1)..(975): Ceres ANNOT ID no. 1450495
  misc_feature 207630:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
atggctatgctctcaacttcactctccggtccaaaatctgcaacttcgtattgcgcgcctgagttctccggtcttcgccgtttatgtccaaacaacaataccaacaactctcattcccagtcttttcttcgcttctcttctccccggaaacctcttagaggagtctttgccatggctggcactggacagttctttgttggaggaaattggaaatgtaatggaacaaaagaatccattaccacgctcatttcagacctgaacagcgcaaagttggagtctgatgtcgacgttgttgtagcacctccctttatttacatcgatcaggtcaagtcttccttaacagacaggattgagatatcagctcagaactcttgggtcagtaagggtggggctttcacaggagaaatcagtgtggaacaactgaaagacattggctgcaagtgggttatccttgggcattctgagcgtagacatgtaattggcgaagacgatcagtttataggaaagaaggcagcttatgccttgagccagggtgttggagtaattgcttgtattggtgaactgttagaagaaagagaagcagggaaaacttttgatgtttgttatcagcaactgaaggcgtatgcagaacctaacaccagtagtgccattacccccacagatgctgtgcccagctgggataatatagtcattgcatatgagcctgtttgggctattggtactggtgtagtggccacacctgcgcaggctcaggaagtacatgtagctgttcgtgattggcttaaaaacaatgtctcggcagaagtcgcatcaaaaacacgcattatatatggaggatccgtgaatggaggaaactgtgctgaacttgcaaagcaagaagatattgacggtttccttgttggtggtgcatccttgaagggccccgagtttgctaccattgtcaattctgtaacatccaagaaagttgctgcttaa

SEQ ID NO: 1862 - protein, 322 aa, Populus balsamifera subsp. trichocarpa
  misc_feature (1)..(322): Ceres ANNOT ID no. 1450495
  misc_feature (62)..(312): Pfam Name: TIM Pfam Description: Triosephosphate isomerase
  misc_feature: SWISSPROT Homolog: TPIC_ARATH Triosephosphate isomerase, (EC 5.3.1.1) (TIM) (Triose-phosphate isomerase) with e-value of 7.5e-165 and BLAST sequence identity of 100.0
  misc_feature: SWISSPROT Homolog: TPIC_SPIOL Triosephosphate isomerase, (EC 5.3.1.1) (TIM) (Triose-phosphate isomerase) with e-value of 5.7e-135 and BLAST sequence identity of 82.4
  misc_feature: SWISSPROT Homolog: TPIC_FRAAN Triosephosphate isomerase, (EC 5.3.1.1) (TIM) (Triose-phosphate isomerase) with e-value of 3.3e-132 and BLAST sequence identity of 82.0
  misc_feature: SWISSPROT Homolog: TPIC_SECCE Triosephosphate isomerase, (EC 5.3.1.1) (TIM) (Triose-phosphate isomerase) with e-value of 6.6e-118 and BLAST sequence identity of 77.9
  misc_feature: SWISSPROT Homolog: TPIS_STELP Triosephosphate isomerase, cytosolic (EC 5.3.1.1) (TIM) (Triose-phosphate isomerase) with e-value of 3.4e-98 and BLAST sequence identity of 73.3
  misc_feature 207749:<222: Transcription Factor
  misc_feature: Phenotype: FLOWER - Reduced fertility Useful for sterility, genetic confinement systems
  misc_feature: Phenotype: WHOLE PLANT - Yellow-Green Viable 1 Useful for making lethal plants for genetic confinement systems
  misc_feature: Phenotype: CAULINE LEAVES - Small Useful for making plants with increased biomass and foliage
  misc_feature (1)..(322): Functional Homolog of  Ceres CLONE ID no. 39351 at SEQ ID NO. 1898 with e-value of 1.40E-123 and BLAST sequence identity of 83.3
MLSTSLSGPKSATSYCAPEFSGLRRLCPNNNTNNSHSQSFLRFSSPRKPLRGVFAMAGTGQFFVGGNWKCNGTKESITTLISDLNSAKLESDVDVVVAPPFIYIDQVKSSLTDRIEISAQNSWVSKGGAFTGEISVEQLKDIGCKWVILGHSERRHVIGEDDQFIGKKAAYALSQGVGVIACIGELLEEREAGKTFDVCYQQLKAYAEPNTSSAITPTDAVPSWDNIVIAYEPVWAIGTGVVATPAQAQEVHVAVRDWLKNNVSAEVASKTRIIYGGSVNGGNCAELAKQEDIDGFLVGGASLKGPEFATIVNSVTSKKVAA

SEQ ID NO: 1863 - protein, 280 aa, Arabidopsis thaliana
  misc_feature (1)..(280): Ceres CLONE ID no. 39378
  misc_feature: Utility: Metabolic Profiling Useful for making plants with enhanced metabolite accumulation
  misc_feature: Phenotype: WHOLE PLANT - Metabolic Profiling Useful for making plants with enhanced metabolite accumulation
  misc_feature (278)..(278): Xaa is any aa, unknown, or other
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSTDEWDLSRVAVDALGAAMLVTIILDLWRLFLGPIVPLPEGQNCLQSGLPWXSN

SEQ ID NO: 1864 - DNA, 879 bp, Populus balsamifera subsp. trichocarpa
  misc_feature (1)..(879): Ceres ANNOT ID no. 1527229
  misc_feature: Utility: Metabolic Profiling Useful for making plants with enhanced metabolite accumulation
  misc_feature 207952:<222: Transcription Factor
  misc_feature: Phenotype: WHOLE PLANT - Metabolic Profiling Useful for making plants with enhanced metabolite accumulation
atgggcggtaaagaatcatcagatagttctagttctagtcccagtttatggttggctccagaccctagtaaaagatggggagagattttctttctttgttatactcctttttggctcactctttgtttgggaattgtgattccttgcaagctgtacgagagctttacagaattggaatacttgctcctgggtttgatctcagctgttccttctttcttgataccaatgatgtttgtcggtaaggctgatagcaaattgtgttggaaggactgttattgggtcaaggccagtctatggataatcatttttagctatgttggaaattacttctggacccactattttttcacagttttgggagcttcttatacatttccatcttggaagatgaataatgtaccacatacaaccttccttctgacacatgtttgcttcctgttttatcacgtcacctcaaacatgacaattcgcagactacggcatgcggttgctgacttgccagattatcttcgatgggctgctgagggtgcatggattttggctctttcatacttcatagcatacctggagactttagctgtttctaatttcccttactatgagtttgtggaccgggcttcaatgtacaaagtaggttccttgttttatgccatctacttctttgtaagcttcccaatgtttctgaggattgatgagaaacctggtgatctatgggagttaccaagagtggctgttgattccctgggtgctgcaatgttggttacaataatacttgacttgtggcgaatctttttggggcctattgttccacttccagtaacaaaacaatgccttcaacagggactaccctggtttcctggacatgccactcagacataa

SEQ ID NO: 1865 - protein, 292 aa, Populus balsamifera subsp. trichocarpa
  misc_feature (1)..(292): Ceres ANNOT ID no. 1527229
  misc_feature: SWISSPROT Homolog: CCI1_ARATH Cycloeucalenol cycloisomerase with e-value of 6.0e-156 and BLAST sequence identity of 99.6
  misc_feature: SWISSPROT Homolog: CCI1_ARATH EC 5.5.1.9 (Cycloeucalenol--obtusifoliol isomerase) ( Cyclopropyl sterol isomerase)
  misc_feature: Utility: Metabolic Profiling Useful for making plants with enhanced metabolite accumulation
  misc_feature 208028:<222: Transcription Factor
  misc_feature: Phenotype: WHOLE PLANT - Metabolic Profiling Useful for making plants with enhanced metabolite accumulation
  misc_feature (1)..(292): Functional Homolog of  Ceres CLONE ID no. 39378 at SEQ ID NO. 1907 with e-value of 1.99E-129 and BLAST sequence identity of 81.1
MGGKESSDSSSSSPSLWLAPDPSKRWGEIFFLCYTPFWLTLCLGIVIPCKLYESFTELEYLLLGLISAVPSFLIPMMFVGKADSKLCWKDCYWVKASLWIIIFSYVGNYFWTHYFFTVLGASYTFPSWKMNNVPHTTFLLTHVCFLFYHVTSNMTIRRLRHAVADLPDYLRWAAEGAWILALSYFIAYLETLAVSNFPYYEFVDRASMYKVGSLFYAIYFFVSFPMFLRIDEKPGDLWELPRVAVDSLGAAMLVTIILDLWRIFLGPIVPLPVTKQCLQQGLPWFPGHATQT

SEQ ID NO: 1866 - DNA, 903 bp, Populus balsamifera subsp. trichocarpa
  misc_feature (1)..(903): Ceres ANNOT ID no. 1473809
  misc_feature: Utility: Metabolic Profiling Useful for making plants with enhanced metabolite accumulation
  misc_feature 208124:<222: Transcription Factor
  misc_feature: Phenotype: WHOLE PLANT - Metabolic Profiling Useful for making plants with enhanced metabolite accumulation
atgggcggtaaagaatcatcagatagttctagttctagtcccagtttatggttggctccagaccctagtaaaagatggggagagattttctttctttgttatactcctttttggctcactctttgtttgggaattgtgattccttgcaagctgtacgagagctttacagaattggaatacttgctcctgggtttgatctcagctgttccttctttcttgataccaatgatgtttgtcggtaaggctgatagcaaattgtgttggaaggactgttattgggtcaaggccagtctatggataatcatttttagctatgttggaaattacttctggacccactattttttcacagttttgggagcttcttatacatttccatcttggaagatgaataatgtaccacatacaaccttccttctgacacatgtttgcttcctgttttatcacgtcacctcaaacatgacaattcgcagactacggcatgcggttgctgacttgccagattatcttcgatgggctgctgagggtgcatggattttggctctttcatacttcatagcatacctggagactttagctgtttctaatgtgggtggtaaaacgattccgtgtctattgttattttcattcccttactatgagtttgtggaccgggcttcaatgtacaaagtaggttccttgttttatgccatctacttctttgtaagcttcccaatgtttctgaggattgatgagaaacctggtgatctatgggagttaccaagagtggctgttgattccctgggtgctgcaatggactaccctggtttcctggacatgccactcagacataacaaactacatggaaacccggtgacggtagccacagaggcaactcctaaacatggaatttcttgtacttga

SEQ ID NO: 1867 - protein, 300 aa, Populus balsamifera subsp. trichocarpa
  misc_feature (1)..(300): Ceres ANNOT ID no. 1473809
  misc_feature: SWISSPROT Homolog: CCI1_ARATH Cycloeucalenol cycloisomerase with e-value of 6.0e-156 and BLAST sequence identity of 99.6
  misc_feature: SWISSPROT Homolog: CCI1_ARATH EC 5.5.1.9 (Cycloeucalenol--obtusifoliol isomerase) ( Cyclopropyl sterol isomerase)
  misc_feature: Utility: Metabolic Profiling Useful for making plants with enhanced metabolite accumulation
  misc_feature 208202:<222: Transcription Factor
  misc_feature: Phenotype: WHOLE PLANT - Metabolic Profiling Useful for making plants with enhanced metabolite accumulation
  misc_feature (1)..(300): Functional Homolog of  Ceres CLONE ID no. 39378 at SEQ ID NO. 1907 with e-value of 9.20E-111 and BLAST sequence identity of 79.3
MGGKESSDSSSSSPSLWLAPDPSKRWGEIFFLCYTPFWLTLCLGIVIPCKLYESFTELEYLLLGLISAVPSFLIPMMFVGKADSKLCWKDCYWVKASLWIIIFSYVGNYFWTHYFFTVLGASYTFPSWKMNNVPHTTFLLTHVCFLFYHVTSNMTIRRLRHAVADLPDYLRWAAEGAWILALSYFIAYLETLAVSNVGGKTIPCLLLFSFPYYEFVDRASMYKVGSLFYAIYFFVSFPMFLRIDEKPGDLWELPRVAVDSLGAAMDYPGFLDMPLRHNKLHGNPVTVATEATPKHGISCT

SEQ ID NO: 1868 - protein, 353 aa, Arabidopsis thaliana
  misc_feature (1)..(353): Ceres CLONE ID no. 39678
  misc_feature (48)..(299): Pfam Name: peroxidase Pfam Description: Peroxidase
  misc_feature: Phenotype: WHOLE PLANT - Misc. Dwarf Useful for modulating plant size
MHFSSSSTSSTWTILITLGCLMLHASLSAAQLTPTFYDRSCPNVTNIVRETIVNELRSDPRIAASILRLHFHDCFVNGCDASILLDNTTSFRTEKDAFGNANSARGFPVIDRMKAAVERACPRTVSCADMLTIAAQQSVTLAGGPSWRVPLGRRDSLQAFLELANANLPAPFFTLPQLKASFRNVGLDRPSDLVALSGGHTFGKNQCQFILDRLYNFSNTGLPDPTLNTTYLQTLRGLCPLNGNRSALVDFDLRTPTVFDNKYYVNLKERKGLIQSDQELFSSPNATDTIPLVRAYADGTQTFFNAFVEAMNRMGNITPTTGTQGQIRLNCRVVNSNSLLHDVVDIVDFVSSM

SEQ ID NO: 1869 - DNA, 1032 bp, Populus balsamifera subsp. trichocarpa
  misc_feature (1)..(1032): Ceres ANNOT ID no. 1490459
  misc_feature 208389:<222: Transcription Factor
  misc_feature: Phenotype: WHOLE PLANT - Misc. Dwarf Useful for modulating plant size
atgcatctttctaaggctatagttgcaacttttttctttgtagttttgcttggaggaacattggctcatggccagcttactccaacattttatgaccagacatgtccaaatgtgagcagcattatccgtaatgtcattacggagacattggtatccgatcctcggattgcagccagcctcatcaggctccacttccatgactgctttgttaatggctgtgatggttcgcttttgttggacaatactgatactatagagagcgaaaaggaagccgcagggaacaacaattctgcaagaggttttgaagttgttgatagaatgaaggctttgttggagagtgcctgtcctgctactgtttcctgtgctgatatactcactattgcagctgaagaatctgttgttttggcaggaggtccaaattggacagttccattaggaagaagagatagcacaacagcaagccgagctgcagcaaatgcttcccttccagccccttttttaacccttgatcaactcagagagagcttcactaatgttggccttaataataatactgatttggtagctctatctggtgctcacacatttggaagggcaaaatgttctacattcgacttccgattgtttgatttcaacagaaccggtgctcctgacccatcaatggacacaactcttctagcagctcttcaggaattatgtcccgaaaatggaaatgggagtgtgataacagatcttgatgtcacaacagctgatgcctttgacagtaagtactactccaatctgcaatgtaaccgaggcctgcttcagactgatcaagaactgttttcaactcccggggcagatgatgtcattgcacttgttaacgctttcagtgctaatcaaacagctttctttgaaagctttgtggagtccatgataagaatgggaaatatcagccctctgacaggaactgaaggggagatcagattgaactgcagggtagtcaatgcaaacctggctgggccagatagcatgcttgttagctcaatttga

SEQ ID NO: 1870 - protein, 343 aa, Populus balsamifera subsp. trichocarpa
  misc_feature (1)..(343): Ceres ANNOT ID no. 1490459
  misc_feature (42)..(293): Pfam Name: peroxidase Pfam Description: Peroxidase
  misc_feature: SWISSPROT Homolog: PER34_ARATH Peroxidase 34 precursor (EC 1.11.1.7) (Atperox P34) (ATPCb) with e-value of 4.1e-189 and BLAST sequence identity of 100.0
  misc_feature: SWISSPROT Homolog: PER33_ARATH Peroxidase 33 precursor (EC 1.11.1.7) (Atperox P33) (ATPCa) (Neutral peroxidase C) (PERC) with e-value of 1.2e-175 and BLAST sequence identity of 92.7
  misc_feature: SWISSPROT Homolog: PER1A_ARMRU Peroxidase C1A precursor (EC 1.11.1.7) with e-value of 7.6e-172 and BLAST sequence identity of 90.7
  misc_feature: SWISSPROT Homolog: PER32_ARATH Peroxidase 32 precursor (EC 1.11.1.7) (Atperox P32) (PRXR3) (ATP16a) with e-value of 2.4e-168 and BLAST sequence identity of 89.0
  misc_feature: SWISSPROT Homolog: PER1B_ARMRU Peroxidase C1B precursor (EC 1.11.1.7) with e-value of 8.1e-168 and BLAST sequence identity of 88.4
  misc_feature 208496:<222: Transcription Factor
  misc_feature: Phenotype: WHOLE PLANT - Misc. Dwarf Useful for modulating plant size
  misc_feature (1)..(343): Functional Homolog of  Ceres CLONE ID no. 39678 at SEQ ID NO. 1912 with e-value of 6.89E-106 and BLAST sequence identity of 60.4
MHLSKAIVATFFFVVLLGGTLAHGQLTPTFYDQTCPNVSSIIRNVITETLVSDPRIAASLIRLHFHDCFVNGCDGSLLLDNTDTIESEKEAAGNNNSARGFEVVDRMKALLESACPATVSCADILTIAAEESVVLAGGPNWTVPLGRRDSTTASRAAANASLPAPFLTLDQLRESFTNVGLNNNTDLVALSGAHTFGRAKCSTFDFRLFDFNRTGAPDPSMDTTLLAALQELCPENGNGSVITDLDVTTADAFDSKYYSNLQCNRGLLQTDQELFSTPGADDVIALVNAFSANQTAFFESFVESMIRMGNISPLTGTEGEIRLNCRVVNANLAGPDSMLVSSI

SEQ ID NO: 1871 - DNA, 993 bp, Populus balsamifera subsp. trichocarpa
  misc_feature (1)..(993): Ceres ANNOT ID no. 1437663
  misc_feature 208595:<222: Transcription Factor
  misc_feature: Phenotype: WHOLE PLANT - Misc. Dwarf Useful for modulating plant size
atggttttgcttggaggaacattggctcatggccagcttactccaacattttatgaccagacatgtccaaatgtgagcagcattatccgtaatgtcattacggagacattggtatccgatcctcggattgcagccagcctcatcaggctccacttccatgactgctttgttaatggctgtgatggttcgcttttgttggacaatactgatactatagagagcgaaaaggaagccgcagggaacaacaattctgcaagaggttttgaagttgttgatagaatgaaggctttgttggagagtgcctgtcctgctactgtttcctgtgctgatatactcactattgcagctgaagaatctgttgttttggcaggaggtccaaattggacagttccattaggaagaagagatagcacaacagcaagccgagctgcagcaaatgcttcccttccagccccttttttaacccttgatcaactcagagagagcttcactaatgttggccttaataataatactgatttggtagctctatctggtgctcacacatttggaagggcaaaatgttctacattcgacttccgattgtttgatttcaacagaaccggtgctcctgacccatcaatggacacaactcttctagcagctcttcaggaattatgtcccgaaaatggaaatgggagtgtgataacagatcttgatgtcacaacagctgatgcctttgacagtaagtactactccaatctgcaatgtaaccgaggcctgcttcagactgatcaagaactgttttcaactcccggggcagatgatgtcattgcacttgttaacgctttcagtgctaatcaaacagctttctttgaaagctttgtggagtccatgataagaatgggaaatatcagccctctgacaggaactgaaggggagatcagattgaactgcagggtagtcaatgcaaacctggctgggccagatagcatgcttgttagctcaatttga

SEQ ID NO: 1872 - protein, 330 aa, Populus balsamifera subsp. trichocarpa
  misc_feature (1)..(330): Ceres ANNOT ID no. 1437663
  misc_feature (29)..(280): Pfam Name: peroxidase Pfam Description: Peroxidase
  misc_feature: SWISSPROT Homolog: PER34_ARATH Peroxidase 34 precursor (EC 1.11.1.7) (Atperox P34) (ATPCb) with e-value of 4.1e-189 and BLAST sequence identity of 100.0
  misc_feature: SWISSPROT Homolog: PER33_ARATH Peroxidase 33 precursor (EC 1.11.1.7) (Atperox P33) (ATPCa) (Neutral peroxidase C) (PERC) with e-value of 1.2e-175 and BLAST sequence identity of 92.7
  misc_feature: SWISSPROT Homolog: PER1A_ARMRU Peroxidase C1A precursor (EC 1.11.1.7) with e-value of 7.6e-172 and BLAST sequence identity of 90.7
  misc_feature: SWISSPROT Homolog: PER32_ARATH Peroxidase 32 precursor (EC 1.11.1.7) (Atperox P32) (PRXR3) (ATP16a) with e-value of 2.4e-168 and BLAST sequence identity of 89.0
  misc_feature: SWISSPROT Homolog: PER1B_ARMRU Peroxidase C1B precursor (EC 1.11.1.7) with e-value of 8.1e-168 and BLAST sequence identity of 88.4
  misc_feature 208700:<222: Transcription Factor
  misc_feature: Phenotype: WHOLE PLANT - Misc. Dwarf Useful for modulating plant size
  misc_feature (1)..(330): Functional Homolog of  Ceres CLONE ID no. 39678 at SEQ ID NO. 1912 with e-value of 1.79E-105 and BLAST sequence identity of 61.5
MVLLGGTLAHGQLTPTFYDQTCPNVSSIIRNVITETLVSDPRIAASLIRLHFHDCFVNGCDGSLLLDNTDTIESEKEAAGNNNSARGFEVVDRMKALLESACPATVSCADILTIAAEESVVLAGGPNWTVPLGRRDSTTASRAAANASLPAPFLTLDQLRESFTNVGLNNNTDLVALSGAHTFGRAKCSTFDFRLFDFNRTGAPDPSMDTTLLAALQELCPENGNGSVITDLDVTTADAFDSKYYSNLQCNRGLLQTDQELFSTPGADDVIALVNAFSANQTAFFESFVESMIRMGNISPLTGTEGEIRLNCRVVNANLAGPDSMLVSSI

SEQ ID NO: 1873 - DNA, 1032 bp, Populus balsamifera subsp. trichocarpa
  misc_feature (1)..(1032): Ceres ANNOT ID no. 1437666
  misc_feature 208796:<222: Transcription Factor
  misc_feature: Phenotype: WHOLE PLANT - Misc. Dwarf Useful for modulating plant size
atgcatctttctaaggctatagttgcagcttttttctttgtagttttgcttggaggaacattggcttatggccagcttactccaacattttatgaccagacatgtccaaatgtgagcagcattatccgtaatgtcattacggagacattggtatccgatcctcggattgcagccagcctcatcaggctccacttccatgactgctttgttaatggctgtgatggttcgcttttgttggacaatactgatactatagagagcgaaaaggaagccgcagggaacaacaattctgcaagaggttttgaagttgttgatagaatgaaggctttgttggagagtacctgtcctgctactgtttcctgtgctgatatactcactattgcagctgaagaatctgttgtcttggcaggaggtccatgttggacagttccattaggaagaagagatagcacaacagcaagccgagctgcagcaaatgcttcccttccagccccttttttaccccttgatcaactcagagagagcttcactaatgtcggccttaataataatagtgatttggtagctctatctggtgctcacacatttgggagggcacgatgttctacgttcgacttccgattgtataatttcagcagcaccggtgctcctgacccatcattggacacaactcttctagcagctcttcaggaattatgtccccaaggtggaaatgagagtgtgataacagatcttgatcccacaacacctgatgtctttgacagtaactactactccaatctgcaaggtaaccgaggcctgcttcagactgatcaagaactgttttcaactcctggggcagatgatctcattgcacttgttaacgctttcagtgctaatcaaacagctttctttgaaagctttgtggagtccatgataagaatgggaaatctcagccctctgacaggaactgaaggggagatcagattgaactgcagcgtagtcaatgcaaacttggctgggccagatagcatgcttgttagctcaatttga

SEQ ID NO: 1874 - protein, 343 aa, Populus balsamifera subsp. trichocarpa
  misc_feature (1)..(343): Ceres ANNOT ID no. 1437666
  misc_feature (42)..(293): Pfam Name: peroxidase Pfam Description: Peroxidase
  misc_feature: SWISSPROT Homolog: PER34_ARATH Peroxidase 34 precursor (EC 1.11.1.7) (Atperox P34) (ATPCb) with e-value of 4.1e-189 and BLAST sequence identity of 100.0
  misc_feature: SWISSPROT Homolog: PER33_ARATH Peroxidase 33 precursor (EC 1.11.1.7) (Atperox P33) (ATPCa) (Neutral peroxidase C) (PERC) with e-value of 1.2e-175 and BLAST sequence identity of 92.7
  misc_feature: SWISSPROT Homolog: PER1A_ARMRU Peroxidase C1A precursor (EC 1.11.1.7) with e-value of 7.6e-172 and BLAST sequence identity of 90.7
  misc_feature: SWISSPROT Homolog: PER32_ARATH Peroxidase 32 precursor (EC 1.11.1.7) (Atperox P32) (PRXR3) (ATP16a) with e-value of 2.4e-168 and BLAST sequence identity of 89.0
  misc_feature: SWISSPROT Homolog: PER1B_ARMRU Peroxidase C1B precursor (EC 1.11.1.7) with e-value of 8.1e-168 and BLAST sequence identity of 88.4
  misc_feature 208903:<222: Transcription Factor
  misc_feature: Phenotype: WHOLE PLANT - Misc. Dwarf Useful for modulating plant size
  misc_feature (1)..(343): Functional Homolog of  Ceres CLONE ID no. 39678 at SEQ ID NO. 1912 with e-value of 2.29E-105 and BLAST sequence identity of 61.8
MHLSKAIVAAFFFVVLLGGTLAYGQLTPTFYDQTCPNVSSIIRNVITETLVSDPRIAASLIRLHFHDCFVNGCDGSLLLDNTDTIESEKEAAGNNNSARGFEVVDRMKALLESTCPATVSCADILTIAAEESVVLAGGPCWTVPLGRRDSTTASRAAANASLPAPFLPLDQLRESFTNVGLNNNSDLVALSGAHTFGRARCSTFDFRLYNFSSTGAPDPSLDTTLLAALQELCPQGGNESVITDLDPTTPDVFDSNYYSNLQGNRGLLQTDQELFSTPGADDLIALVNAFSANQTAFFESFVESMIRMGNLSPLTGTEGEIRLNCSVVNANLAGPDSMLVSSI

SEQ ID NO: 1875 - DNA, 1032 bp, Populus balsamifera subsp. trichocarpa
  misc_feature (1)..(1032): Ceres ANNOT ID no. 1437689
  misc_feature 209002:<222: Transcription Factor
  misc_feature: Phenotype: WHOLE PLANT - Misc. Dwarf Useful for modulating plant size
atgcatctttctaaggctatagttgcagcctttttctttgtagttttgcttggaggaacattggctcatggccagcttactccaacattttatgacgagacatgtccaaatgtgagcagcattatccgtaatgtcattacggagacagtggtatccgatcgtcggattggaggcagcctcatcaggctccacttccatgactgctttgttaatggctgtgatggttcgcttttgttggacaatactgatactatagagagcgaaaaggaagctaatgggaacaacaactctgcaagaggttttgaagttgttgatagaatgaaggctttgttggagagtgcctgtcctactactgtttcctgtgctgatatactcgctattgcagctgaagaatccgtttttttggcaggaggtccaaattggacagttccattaggaagaagagatagtacaacagcaagccgagatgcagcaaatgctttccttccagccccttttttcacccttgatcaactcagagagagcttcactaatgtcagccttaataataatagtgatttggtagctctatctggtgctcacacatttgggagggcacaatgttctacattcgtcttccgattgtatgatttcaatggcaccggtgctcctgactcaacaattgacccaccttttctagaagctcttcagaaattatgtcccgaaaatggaaatgggagtgtgataacagatcttgatgtcacaacagctgatgcctttgacagtaagtactactccaatctgcaatgtaaccgaggcctgcttcagactgatcaagaactgttttcaactcccggggcagatgatgtcattgcacttgttaacgctttcagtgctaatcaaacagctttctttgaaagctttgtggagtccatgataagaatgggaaatatcagccctctgacaggaactgaaggggagatcagattgaactgcagggtagtcaatgcaaacctggctgggccagatagcatgcttgttagctcaatttga

SEQ ID NO: 1876 - protein, 343 aa, Populus balsamifera subsp. trichocarpa
  misc_feature (1)..(343): Ceres ANNOT ID no. 1437689
  misc_feature (42)..(293): Pfam Name: peroxidase Pfam Description: Peroxidase
  misc_feature: SWISSPROT Homolog: PER34_ARATH Peroxidase 34 precursor (EC 1.11.1.7) (Atperox P34) (ATPCb) with e-value of 4.1e-189 and BLAST sequence identity of 100.0
  misc_feature: SWISSPROT Homolog: PER33_ARATH Peroxidase 33 precursor (EC 1.11.1.7) (Atperox P33) (ATPCa) (Neutral peroxidase C) (PERC) with e-value of 1.2e-175 and BLAST sequence identity of 92.7
  misc_feature: SWISSPROT Homolog: PER1A_ARMRU Peroxidase C1A precursor (EC 1.11.1.7) with e-value of 7.6e-172 and BLAST sequence identity of 90.7
  misc_feature: SWISSPROT Homolog: PER32_ARATH Peroxidase 32 precursor (EC 1.11.1.7) (Atperox P32) (PRXR3) (ATP16a) with e-value of 2.4e-168 and BLAST sequence identity of 89.0
  misc_feature: SWISSPROT Homolog: PER1B_ARMRU Peroxidase C1B precursor (EC 1.11.1.7) with e-value of 8.1e-168 and BLAST sequence identity of 88.4
  misc_feature 209109:<222: Transcription Factor
  misc_feature: Phenotype: WHOLE PLANT - Misc. Dwarf Useful for modulating plant size
  misc_feature (1)..(343): Functional Homolog of  Ceres CLONE ID no. 39678 at SEQ ID NO. 1912 with e-value of 3.90E-103 and BLAST sequence identity of 58.9
MHLSKAIVAAFFFVVLLGGTLAHGQLTPTFYDETCPNVSSIIRNVITETVVSDRRIGGSLIRLHFHDCFVNGCDGSLLLDNTDTIESEKEANGNNNSARGFEVVDRMKALLESACPTTVSCADILAIAAEESVFLAGGPNWTVPLGRRDSTTASRDAANAFLPAPFFTLDQLRESFTNVSLNNNSDLVALSGAHTFGRAQCSTFVFRLYDFNGTGAPDSTIDPPFLEALQKLCPENGNGSVITDLDVTTADAFDSKYYSNLQCNRGLLQTDQELFSTPGADDVIALVNAFSANQTAFFESFVESMIRMGNISPLTGTEGEIRLNCRVVNANLAGPDSMLVSSI

SEQ ID NO: 1877 - protein, 227 aa, Arabidopsis thaliana
  misc_feature (1)..(227): Ceres CLONE ID no. 39740
  misc_feature (3)..(181): Pfam Name: ChaC Pfam Description: ChaC-like protein
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
MVMWVFGYGSLVWNPGFHYDEKVLGFIKGYKRVFDLACIDHRGTPEHPARTCTLEKAEEAICWGTAFCVRGGPEKERLAMEYLERRECEYDLKTSVDFYKEDYPLKPAVTGVIVFTSTPDKVSNKYYLGPAPLEDMARQIATANGPCGNNRDYLFLLEKAMHDIGHEEDYVIELANEVRKVLAESSTKKVTPVKESRASRVANKSKNNVPTAHQILPHHPEAVATTI

SEQ ID NO: 1878 - DNA, 672 bp, Populus balsamifera subsp. trichocarpa
  misc_feature (1)..(672): Ceres ANNOT ID no. 1483180
  misc_feature 209309:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
atggttttctggatttttggctatggttcattggtgtggaacccaggttttgaatatgatgagaaagtgattggatttatcaaggactacaggcgtgtctttgatcttgcgtgcattgatcacagaggtacacctgagagtcctgcaagaacttgcacgctggaaaatgttgaaggagctatttgctggggagctgcctattgtgtacggggaggtcctgaaagggaaagattagctatggagtatttggagaggagagaatgcgaatatgataaaaagaccctcgtagacttttataaggaaggggaaccctcacaacctgctttaactggagttatagttttcacatcgactccagaccaggtgtcaaacaagtactacctcgggcctgcccctttggaggaaatggctaggcaaattgcaactgctcatggaccatgtgggaacaacagagactatctcttcctgctagaaaaagccatgtttgcgatcggtcatgaggacgagatggtgatagaactagcaaaagaagtgaggaaggttcttggaattacagggaatggtattcccactgagaagaagataactgggacatccccgaaagcgctcatatcccatatgccagtccttcaacttcgtccactccaagaagccgtcgtaatggactcttga

SEQ ID NO: 1879 - protein, 223 aa, Populus balsamifera subsp. trichocarpa
  misc_feature (1)..(223): Ceres ANNOT ID no. 1483180
  misc_feature (3)..(181): Pfam Name: ChaC Pfam Description: ChaC-like protein
  misc_feature: SWISSPROT Homolog: CHAC_ECOLI Cation transport protein chaC with e-value of 7.4e-16 and BLAST sequence identity of 33.3
  misc_feature: SWISSPROT Homolog: YEZ3_YEAST Hypothetical 26.3 kDa protein in RAD4-CHD1 intergenic region with e-value of 5.7e-15 and BLAST sequence identity of 44.6
  misc_feature 209406:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
  misc_feature (1)..(223): Functional Homolog of  Ceres CLONE ID no. 39740 at SEQ ID NO. 1921 with e-value of 2.79E-84 and BLAST sequence identity of 84.0
MVFWIFGYGSLVWNPGFEYDEKVIGFIKDYRRVFDLACIDHRGTPESPARTCTLENVEGAICWGAAYCVRGGPERERLAMEYLERRECEYDKKTLVDFYKEGEPSQPALTGVIVFTSTPDQVSNKYYLGPAPLEEMARQIATAHGPCGNNRDYLFLLEKAMFAIGHEDEMVIELAKEVRKVLGITGNGIPTEKKITGTSPKALISHMPVLQLRPLQEAVVMDS

SEQ ID NO: 1880 - DNA, 672 bp, Populus balsamifera subsp. trichocarpa
  misc_feature (1)..(672): Ceres ANNOT ID no. 1480950
  misc_feature 209509:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
atggttttctgggtttttggctatggttcattggtgtggaacccaggttttgaatatgatgagaaagtgattggctttatcaaggactacaggcgtgtttttgatcttgcttgcattgatcacagaggtacacctgaaagtcctgcaagaacttgcacgttggaaaatgttgaaggagctatttgctggggagctgcttattgtgttcggggaggtcctgaaagggaaagattggcaatggagtatttggaaaggagagaatgcgaatatgataaaaagaccctcgtagactttgacaaggaaggggaaccctcggagcctgctttaactggagttatagtttttacttccactccagacaaggtatcaaacaagtactaccttgggcctgccccgttggaggaaatggctaggcaaattgcaactgctcatggaccatgcgggaacaacagagactatctgttctcgctagaaagagccatgtttgctataggtcatgaagatgacacggtgattgaactggcaaaagaggtgaggagggttcttggaactaaagggaatggaattcccgtggagaagaagatatctgggtcatccccagctgctctcaaatcccacatgccagcccttcaacttcgttcacttcaagaagcagtcgtgatggactcttaa

SEQ ID NO: 1881 - protein, 223 aa, Populus balsamifera subsp. trichocarpa
  misc_feature (1)..(223): Ceres ANNOT ID no. 1480950
  misc_feature (3)..(181): Pfam Name: ChaC Pfam Description: ChaC-like protein
  misc_feature: SWISSPROT Homolog: CHAC_ECOLI Cation transport protein chaC with e-value of 7.4e-16 and BLAST sequence identity of 33.3
  misc_feature: SWISSPROT Homolog: YEZ3_YEAST Hypothetical 26.3 kDa protein in RAD4-CHD1 intergenic region with e-value of 5.7e-15 and BLAST sequence identity of 44.6
  misc_feature 209606:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
  misc_feature (1)..(223): Functional Homolog of  Ceres CLONE ID no. 39740 at SEQ ID NO. 1921 with e-value of 1.99E-83 and BLAST sequence identity of 77.0
MVFWVFGYGSLVWNPGFEYDEKVIGFIKDYRRVFDLACIDHRGTPESPARTCTLENVEGAICWGAAYCVRGGPERERLAMEYLERRECEYDKKTLVDFDKEGEPSEPALTGVIVFTSTPDKVSNKYYLGPAPLEEMARQIATAHGPCGNNRDYLFSLERAMFAIGHEDDTVIELAKEVRRVLGTKGNGIPVEKKISGSSPAALKSHMPALQLRSLQEAVVMDS

SEQ ID NO: 1882 - protein, 256 aa, Arabidopsis thaliana
  misc_feature (1)..(256): Ceres CLONE ID no. 39890
  misc_feature (75)..(174): Pfam Name: K-box Pfam Description: K-box region
  misc_feature (9)..(59): Pfam Name: SRF-TF Pfam Description: SRF-type transcription factor DNA-binding and dimerisation domain)
  misc_feature: Utility: pH (high) Useful for making plants tolerant to high pH or low phosphate
  misc_feature: Phenotype: FLOWER - Aborted fertility Useful for sterility, genetic confinement systems
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - pH (high) Useful for making plants tolerant to high pH or low phosphate
  misc_feature: Phenotype: INFLORESCENCE - Reduced Apical Dominance Useful for modifying plant structure, ie increased branching
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 1883 - DNA, 726 bp, Populus balsamifera subsp. trichocarpa
  misc_feature (1)..(726): Ceres ANNOT ID no. 1511886
  misc_feature: Utility: pH (high) Useful for making plants tolerant to high pH or low phosphate
  misc_feature 209870:<222: Transcription Factor
  misc_feature: Phenotype: FLOWER - Aborted fertility Useful for sterility, genetic confinement systems
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - pH (high) Useful for making plants tolerant to high pH or low phosphate
  misc_feature: Phenotype: INFLORESCENCE - Reduced Apical Dominance Useful for modifying plant structure, ie increased branching
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgggaagaggtagggttcagttgaagagaatagagaacaagatcaaccggcaggttacattttccaaaagaagaactggattgttgaagaaagctcatgaaatctcagtcctatgtgatgccgaggttgccttgatcgtcttctctcataaagggaagctctttgaatactccaccaatgcttgcatggaaaagatacttgaacgccacgagaggtattcttatgcagagaggcaattagtcgcaactgatcttgattcgcaggggaactggaccctagagtataacaggctcaaggcaaaggttgaacttctacagagaaaccacaggcactatttgggggaagatctggactccgtgagtctcaaagagcttcaaaacttggagcaacagattgataccgcccttaaactcattcgggaaagaaaaaaccatctgatgtatcagtcgatttctgagctgcagataaaggagaaggcaattaaagagcaaaataacatgttagtgaagcagatcaaggagaaggagaaagcactggcacagccggcactctgggatcagcaagatcatggccctaatgcttcctcattccttttaccacagccgccactgccttgtttaaacatcagttaccaggaagaagatccagaagcgaggaggaattatgaacttgacctcacgctggaaccaatttattcgtgtcaccttggatgctttggaacatga

SEQ ID NO: 1884 - protein, 241 aa, Populus balsamifera subsp. trichocarpa
  misc_feature (1)..(241): Ceres ANNOT ID no. 1511886
  misc_feature (75)..(174): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AP1_ARATH Floral homeotic protein APETALA1 (Agamous-like MADS-box protein AGL7) with e-value of 2.4e-136 and BLAST sequence identity of 99.6
  misc_feature: SWISSPROT Homolog: AP1_SINAL Floral homeotic protein APETALA1 (MADS C) with e-value of 2.1e-128 and BLAST sequence identity of 94.5
  misc_feature: SWISSPROT Homolog: CAL_ARATH Transcription factor CAULIFLOWER (Agamous-like MADS-box protein AGL10) with e-value of 2.9e-101 and BLAST sequence identity of 77.0
  misc_feature: SWISSPROT Homolog: AGL8_SOLTU Agamous-like MADS-box protein AGL8 homolog (POTM1-1) with e-value of 5.6e-73 and BLAST sequence identity of 67.8
  misc_feature: SWISSPROT Homolog: AGL8_SOLCO Agamous-like MADS-box protein AGL8 homolog with e-value of 5.2e-70 and BLAST sequence identity of 65.9
  misc_feature: Utility: pH (high) Useful for making plants tolerant to high pH or low phosphate
  misc_feature 210042:<222: Transcription Factor
  misc_feature: Phenotype: FLOWER - Aborted fertility Useful for sterility, genetic confinement systems
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - pH (high) Useful for making plants tolerant to high pH or low phosphate
  misc_feature: Phenotype: INFLORESCENCE - Reduced Apical Dominance Useful for modifying plant structure, ie increased branching
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(241): Functional Homolog of  Ceres CLONE ID no. 39890 at SEQ ID NO. 1926 with e-value of 4.39E-88 and BLAST sequence identity of 75.3
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 1885 - DNA, 747 bp, Populus balsamifera subsp. trichocarpa
  misc_feature (1)..(747): Ceres ANNOT ID no. 1517635
  misc_feature: Utility: pH (high) Useful for making plants tolerant to high pH or low phosphate
  misc_feature 210192:<222: Transcription Factor
  misc_feature: Phenotype: FLOWER - Aborted fertility Useful for sterility, genetic confinement systems
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - pH (high) Useful for making plants tolerant to high pH or low phosphate
  misc_feature: Phenotype: INFLORESCENCE - Reduced Apical Dominance Useful for modifying plant structure, ie increased branching
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atgggaagaggtagggttcagttgaagagaatagagaacaagatcaaccggcaggtaacattttccaaaaggagaactggattgttgaagaaagctaatgaaatctcagtcctgtgtgacgctgaggttgctttgattgtcttctctcacaaagggaagctctttgaatactccacagatgattccatggaaaagatacttgaacgctacgagagatattcttatgcagagaggcaactagttgccactgatcttgattcacaggggaactggaccctggagtataacaggctcaaggcaaaggttgaacttctacagagaaaccataggaactatttgggggaggatctagactccatgagtctcaaagagctacagaacttagagcaacagattgataccgcccttaaacacattcgggcgagaaaaaaccatctgatgagtcagtcgatttctgagctgcagagaaaggagaaggcaattcaagtgcaaaacaacatgttagtgaagcagatcaaggagaaggagaagaatgataaagcgctggcacagccggcattctgggatctgcaagatcatggccctaatgcttcctcattccttttatcacagccggcaggcctgccactgccttgcttaaacatcggtggcagtcaccaggaagaagctcctgaagcgaggaggaatgagcttggccatacgctggaaccaatttattcttttcaccttggaggttacggagcatga

SEQ ID NO: 1886 - protein, 248 aa, Populus balsamifera subsp. trichocarpa
  misc_feature (1)..(248): Ceres ANNOT ID no. 1517635
  misc_feature (75)..(174): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: AP1_ARATH Floral homeotic protein APETALA1 (Agamous-like MADS-box protein AGL7) with e-value of 2.4e-136 and BLAST sequence identity of 99.6
  misc_feature: SWISSPROT Homolog: AP1_SINAL Floral homeotic protein APETALA1 (MADS C) with e-value of 2.1e-128 and BLAST sequence identity of 94.5
  misc_feature: SWISSPROT Homolog: CAL_ARATH Transcription factor CAULIFLOWER (Agamous-like MADS-box protein AGL10) with e-value of 2.9e-101 and BLAST sequence identity of 77.0
  misc_feature: SWISSPROT Homolog: AGL8_SOLTU Agamous-like MADS-box protein AGL8 homolog (POTM1-1) with e-value of 5.6e-73 and BLAST sequence identity of 67.8
  misc_feature: SWISSPROT Homolog: AGL8_SOLCO Agamous-like MADS-box protein AGL8 homolog with e-value of 5.2e-70 and BLAST sequence identity of 65.9
  misc_feature: Utility: pH (high) Useful for making plants tolerant to high pH or low phosphate
  misc_feature 210364:<222: Transcription Factor
  misc_feature: Phenotype: FLOWER - Aborted fertility Useful for sterility, genetic confinement systems
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: WHOLE PLANT - pH (high) Useful for making plants tolerant to high pH or low phosphate
  misc_feature: Phenotype: INFLORESCENCE - Reduced Apical Dominance Useful for modifying plant structure, ie increased branching
  misc_feature: Phenotype: WHOLE PLANT - Other Useful for making bigger plants
  misc_feature: Phenotype: FLOWER - Other Useful for making ornamental plants with modified flowers
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(248): Functional Homolog of  Ceres CLONE ID no. 39890 at SEQ ID NO. 1926 with e-value of 3.30E-83 and BLAST sequence identity of 71.5
MGRGRVQLKRIENKINRQVTFSKRRTGLLKKANEISVLCDAEVALIVFSHKGKLFEYSTDDSMEKILERYERYSYAERQLVATDLDSQGNWTLEYNRLKAKVELLQRNHRNYLGEDLDSMSLKELQNLEQQIDTALKHIRARKNHLMSQSISELQRKEKAIQVQNNMLVKQIKEKEKNDKALAQPAFWDLQDHGPNASSFLLSQPAGLPLPCLNIGGSHQEEAPEARRNELGHTLEPIYSFHLGGYGA

SEQ ID NO: 1887 - protein, 315 aa, Arabidopsis thaliana
  misc_feature (1)..(315): Ceres CLONE ID no. 39893
  misc_feature (1)..(315): Also Known As Ceres CDNA ID no. 23370190
  misc_feature (1)..(315): Also Known As Ceres GEMINI ID 531G6
  misc_feature (131)..(156): Pfam Name: zf-CCCH Pfam Description: Zinc finger C-x8-C-x5-C-x3-H type (and similar)
  misc_feature 210528:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MMIGENKNRPHPTIHIPQWDQINDPTATISSPFSSVNLNSVNDYPHSPSPYLDSFASLFRYLPSNELTNDSDSSSGDESSPLTDSFSSDEFRIYEFKIRRCARGRSHDWTECPFAHPGEKARRRDPRKFHYSGTACPEFRKGSCRRGHSCEFSHGVFECWLHPSRYRTQPCKDGTSCRRRICFFAHTTEQLRVLPCSLDPDLGFFSGLATSPTSILVSPSFSPPSESPPLSPSTGELIASMRKMQLNGGGCSWSSPMGSAVRLPFSSSLRPIQAATWPRIREFEIEEAPAMEFVESGKELRAEMYARLSRENSLG

SEQ ID NO: 1888 - DNA, 1083 bp, Populus balsamifera subsp. trichocarpa
  misc_feature (1)..(1083): Ceres ANNOT ID no. 1530660
  misc_feature 210629:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgatgatcggagaacatcctcatcaccatccaaatcccaccgtccaaatccctcaatgggacccatacgatgaccaaacaacatcaccatcaccgtcaacaatcccctcttctccattcaccaacttcaatgcgctcgactccctgacggcacttcaccgttaccttccgtcaaacgagccagacccatcctttgaagacgagctagacttaccagtggatgcgttctcatgcgatcacttccgtatgtacgtgttcaaagtgagaaggtgtggacgtggtcggtcgcatgactggactgaatgtccgtacgcgcatcctggagagaaagctcggcgaagggacccacaaaggtatcattactctggaacggcctgccctgaatttcggaaaggcggttgcaagaaaggagattcttgtgagtttgctcacggtgtctttgagtgctggctccatcctgcccgttacaggactcagccgtgtaaggatggacctgcttgtcgccgcagggtctgcttttttgctcacactcccgaacagcttaggctccttcctcagcatagtcctaaaggaaacggatccgggtcgtgggaacttgattttgggtccctggttatgcatcctctcgactcttacctgacaaaagctgggtcttttgtttcatctccaacctcgattttgacttctccgccagtttctccaccatctgattcgccaccgatgtcaccagtcagtccacagcttgggaagatgaaaatagggtctcctgttggttcttggggggtccaatccgggtctagatttgggtcgccacgtgggtcatcgctgcgacccgggttctgcagcctgccttctactcctactagaacaatggcaactcggtctggacttggccagctggatatctggggagatagtagtacttgcgaggaggagcctgcaatggagagggtggagtctgggagagatttgagggcgaagatatatgcaaagctgagtaaagagaactcactggaccctgatcgagttgagtcggctgtttccgggccagatgttgggtgggtttccgagttggtgaagtga

SEQ ID NO: 1889 - protein, 360 aa, Populus balsamifera subsp. trichocarpa
  misc_feature (1)..(360): Ceres ANNOT ID no. 1530660
  misc_feature (121)..(146): Pfam Name: zf-CCCH Pfam Description: Zinc finger C-x8-C-x5-C-x3-H type (and similar)
  misc_feature: SWISSPROT Homolog: ZC3H5_HUMAN Zinc finger CCCH-type domain-containing protein 5 with e-value of 7.9e-10 and BLAST sequence identity of 30.5
  misc_feature: SWISSPROT Homolog: ZC3H5_CANFA Zinc finger CCCH-type domain-containing protein 5 with e-value of 1.3e-09 and BLAST sequence identity of 30.0
  misc_feature: SWISSPROT Homolog: ZC3H5_MOUSE Zinc finger CCCH-type domain-containing protein 5 with e-value of 2.3e-09 and BLAST sequence identity of 29.7
  misc_feature: SWISSPROT Homolog: UNK_DROME Protein unkempt with e-value of 3.4e-07 and BLAST sequence identity of 32.5
  misc_feature 210742:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(360): Functional Homolog of  Ceres CLONE ID no. 39893 at SEQ ID NO. 1931 with e-value of 2.90E-82 and BLAST sequence identity of 60.8
MMIGEHPHHHPNPTVQIPQWDPYDDQTTSPSPSTIPSSPFTNFNALDSLTALHRYLPSNEPDPSFEDELDLPVDAFSCDHFRMYVFKVRRCGRGRSHDWTECPYAHPGEKARRRDPQRYHYSGTACPEFRKGGCKKGDSCEFAHGVFECWLHPARYRTQPCKDGPACRRRVCFFAHTPEQLRLLPQHSPKGNGSGSWELDFGSLVMHPLDSYLTKAGSFVSSPTSILTSPPVSPPSDSPPMSPVSPQLGKMKIGSPVGSWGVQSGSRFGSPRGSSLRPGFCSLPSTPTRTMATRSGLGQLDIWGDSSTCEEEPAMERVESGRDLRAKIYAKLSKENSLDPDRVESAVSGPDVGWVSELVK

SEQ ID NO: 1890 - DNA, 1395 bp, Populus balsamifera subsp. trichocarpa
  misc_feature (1)..(1395): Ceres ANNOT ID no. 1455308
  misc_feature 210860:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgatgatgatcggagaactctctcatcaccgttcgaatcccaccgttcaaatccctcaatgggacccatacgaagagcaaacaacgacgtctccctcgctgtccccaatcccgacttctccattcaccaacttcaacgccctcgattctctaacgtctctccaccgttaccttccgtcaaacgagccagaccctacttttgaagacgaactagatttaccagtggacgcgttctcatgcgatcacttccgtatgtacgagttcaaagtgaaaaggtgtgcacgtggccggtcacatgactggactgagtgtccgtatgcacatcctggcgagaaagcgcggcgcagggacccacgaaggtatcattactctggaacggcctgcccggagtttcggaaaggtggctgcaagaaaggcgatgcatgtgagtttgctcacggtgtctttgagtgctggctccatccggcccgttaccgcactcagccgtgtaaggatggacctgcttgtcgccgcagggtttgtttttttgctcacactccggaacagctcagactccttcctcagcagagtcctaagggaaatggatccgggtctggactcgggtcgggggaatatgattttgggtccccggttatacatccttttgactcctacatgactaaagctgggatttttgtttcatctccgacttcgattttgacttcaccgccagtttctccaccatctgactcgccaccaatgtctccaggcagtccacaggtgataggcggctctggacccggatccttaaattccatgagtgcgcttcttgcttcgatgcggggactgcaggttgggaaggcgaaaatgggatctcctgttggttcctggggagtccaatccggatttagattcgggtctccgcgtgggtcatcactacgacccggtttctgtagcctgccttcaactcctactagaacaatggcaagtcggtctggacttagtcagttggatatctggggcgatggggtcacttgtgaggaagagcctgcaatggagagggtggagtctgggagagatttaagggcaaagatatatgccaagctaagtaaagagaactcggtggaccgtgaccgaggtgactcgggtgtttcgggtccagatgttgggtgggtttctgagctgtgtccagatcagaatactaccaaattttctcaaccatgtggtggtgtgggaagtgaaactggactgacggtcagtcattctccttttaccggggagaagttctgtgtttgcttgaaacaaaaccagaggggggcttatctgatcttgcatatccctgttgtggaattgagacggcgatacgagagaggtggattcaaactcgatgctctctcgagtgattgttcccgctga

SEQ ID NO: 1891 - protein, 463 aa, Populus balsamifera subsp. trichocarpa
  misc_feature (1)..(463): Ceres ANNOT ID no. 1455308
  misc_feature (122)..(147): Pfam Name: zf-CCCH Pfam Description: Zinc finger C-x8-C-x5-C-x3-H type (and similar)
  misc_feature: SWISSPROT Homolog: ZC3H5_HUMAN Zinc finger CCCH-type domain-containing protein 5 with e-value of 7.9e-10 and BLAST sequence identity of 30.5
  misc_feature: SWISSPROT Homolog: ZC3H5_CANFA Zinc finger CCCH-type domain-containing protein 5 with e-value of 1.3e-09 and BLAST sequence identity of 30.0
  misc_feature: SWISSPROT Homolog: ZC3H5_MOUSE Zinc finger CCCH-type domain-containing protein 5 with e-value of 2.3e-09 and BLAST sequence identity of 29.7
  misc_feature: SWISSPROT Homolog: UNK_DROME Protein unkempt with e-value of 3.4e-07 and BLAST sequence identity of 32.5
  misc_feature 210983:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(463): Functional Homolog of  Ceres CLONE ID no. 39893 at SEQ ID NO. 1931 with e-value of 7.99E-80 and BLAST sequence identity of 61.1
MMIGELSHHRSNPTVQIPQWDPYEEQTTTSPSLSPIPTSPFTNFNALDSLTSLHRYLPSNEPDPTFEDELDLPVDAFSCDHFRMYEFKVKRCARGRSHDWTECPYAHPGEKARRRDPRRYHYSGTACPEFRKGGCKKGDACEFAHGVFECWLHPARYRTQPCKDGPACRRRVCFFAHTPEQLRLLPQQSPKGNGSGSGLGSGEYDFGSPVIHPFDSYMTKAGIFVSSPTSILTSPPVSPPSDSPPMSPGSPQVIGGSGPGSLNSMSALLASMRGLQVGKAKMGSPVGSWGVQSGFRFGSPRGSSLRPGFCSLPSTPTRTMASRSGLSQLDIWGDGVTCEEEPAMERVESGRDLRAKIYAKLSKENSVDRDRGDSGVSGPDVGWVSELCPDQNTTKFSQPCGGVGSETGLTVSHSPFTGEKFCVCLKQNQRGAYLILHIPVVELRRRYERGGFKLDALSSDCSR

SEQ ID NO: 1892 - protein, 313 aa, Arabidopsis thaliana
  misc_feature (1)..(313): Ceres CLONE ID no. 39922
  misc_feature (1)..(313): Also Known As Ceres CDNA ID no. 23369842
  misc_feature (1)..(313): Also Known As Ceres GEMINI ID 534G2
  misc_feature (6)..(74): Pfam Name: RRM_1 Pfam Description: RNA recognition motif. (a.k.a. RRM RBD, or RNP domain)
  misc_feature 211140:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
MTMTTVKVSNVSLGATDRDLKEFFSFSGDILYLETQSETERTKLAYVTFKDLQGAETAVLLSGATIVDSSVIVSMAPDYQLSPEALASLEPKDSNKSPKAGDSVLRKAEDVVSSMLAKGFILGKDAIAKAKSVDEKHQLTSTASAKVASFDKKIGFTDKINTGTVVVGEKVREVDQKYQVSEKTKSAIAAAEQTVSNAGSAIMKNRYVLTGATWVTGAFNKVAKAAEEVGQKAKEKVGMAEEEDKRKVVDEFARVHLSESPKAASSTQEAERESKLSESPEAKKDSEHLEPQSKPLQQQSPPPMASAPAPAQP

SEQ ID NO: 1893 - DNA, 876 bp, Populus balsamifera subsp. trichocarpa; identical to SEQ ID NO: 1431
  misc_feature (1)..(876): Ceres ANNOT ID no. 1485544
  misc_feature 211233:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 1894 - protein, 288 aa, Populus balsamifera subsp. trichocarpa; identical to SEQ ID NO: 1432
  misc_feature (1)..(288): Ceres ANNOT ID no. 1485544
  misc_feature (14)..(81): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 5.1e-08 and BLAST sequence identity of 23.1
  misc_feature 211310:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(288): Functional Homolog of  Ceres CLONE ID no. 39922 at SEQ ID NO. 1936 with e-value of 3.30E-99 and BLAST sequence identity of 77.4

SEQ ID NO: 1895 - DNA, 870 bp, Populus balsamifera subsp. trichocarpa; identical to SEQ ID NO: 1433
  misc_feature (1)..(870): Ceres ANNOT ID no. 1447051
  misc_feature 211408:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 1896 - protein, 289 aa, Populus balsamifera subsp. trichocarpa; identical to SEQ ID NO: 1434
  misc_feature (1)..(289): Ceres ANNOT ID no. 1447051
  misc_feature (22)..(89): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 5.1e-08 and BLAST sequence identity of 23.1
  misc_feature 211485:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(289): Functional Homolog of  Ceres CLONE ID no. 39922 at SEQ ID NO. 1936 with e-value of 2.30E-91 and BLAST sequence identity of 73.8

SEQ ID NO: 1897 - protein, 298 aa, Arabidopsis thaliana
  misc_feature (1)..(298): Ceres CLONE ID no. 40153
  misc_feature (125)..(293): Pfam Name: Mra1 Pfam Description: Suppressor Mra1
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
MVRPYGIKVNKRKEREERYDKEEDEVEEQPKFEQKQKARESSKKAKKESTSRAEEDNDEEEVTEEATAAAEDIVGGIPIVLNAPNKEKSGIVFVLEKASLEVAKVGKTYQLLNSDDHANFLKKNNRNPADYRPDITHQALLMILDSPVNKAGRLKAVYVRTEKGVLFEVKPHVRIPRTFKRFAGIMLQLLQKLSITAVNSREKLLRCVKNPIEEHHLPVNSHRIGFSHSSEKLVNMQKHLATVCDDDRDTVFVVGAMAHGKIDCNYIDEFVSVSEYPLSAAYCISRICEALATNWNII

SEQ ID NO: 1898 - DNA, 855 bp, Populus balsamifera subsp. trichocarpa
  misc_feature (1)..(855): Ceres ANNOT ID no. 1453549
  misc_feature 211689:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
atggtgaggccttatggtaaagggcacaagaaaaggaagaaaggggagaggtatgataaggaagaagaggaagaggaagaagaacaagttgaagaagagaaagctgatagtgagactgaaatgagagctcaagatggcgaagaaaaaacagaagaggaaaaagaaatgcaactgccaggagtggaggagggcattcctattgtcccaagtcatcaaactggcaagaaacctggggttatattcgtgctcgaaaaggcttctttggaagttgcaaaagttggaaagagttaccaaattttgaattctgaggagcatgccaatttcctgcggaggaataaaaaaaatcctgctgattacagacctgacattatttatcaggctctcctatccatcttagatagcccattgaataaggctgggcggttgagagctgtatatgtgaaaacagataaaggtgttctttttgaagttaagccacatgttcgtattccgaggacttacaagcgttttgccggtattatgttgcagctgctacaaaaactgagtataactgctgtcggtaatcgtgagaagcttttgcgtgtgatcaagaatcctgtaacccaatacctgccattaaactctcgtaaaataggcttctcccatagctcagaaaaattggtccaaatggagaagtatgtggctggagttggtgatgacaccgaccttgttttcgtggttggtgctatgtcccatggtaaaattgaatgtgattatgtagatgacttcatatcagtgtctgaatatccgctgagtgctgcctggtgtattgcaagggtatgcgaggctgtgtcgaagaagtggcgtgtgctgtaa

SEQ ID NO: 1899 - protein, 284 aa, Populus balsamifera subsp. trichocarpa
  misc_feature (1)..(284): Ceres ANNOT ID no. 1453549
  misc_feature (113)..(279): Pfam Name: Mra1 Pfam Description: Suppressor Mra1
  misc_feature: SWISSPROT Homolog: MRA1_SCHPO Multicopy suppressor of ras1 (Suppressor protein mra1) with e-value of 1.1e-50 and BLAST sequence identity of 50.7
  misc_feature: SWISSPROT Homolog: NEP1_MOUSE Probable ribosome biogenesis protein NEP1 (Nucleolar protein EMG1 homolog) (Protein C2f) with e-value of 1.6e-50 and BLAST sequence identity of 50.5
  misc_feature: SWISSPROT Homolog: NEP1_HUMAN Probable ribosome biogenesis protein NEP1 (Nucleolar protein EMG1 homolog) (Protein C2f) with e-value of 1.2e-49 and BLAST sequence identity of 49.3
  misc_feature: SWISSPROT Homolog: NEP1_YEAST Nucleolar essential protein 1 (Essential for mitotic growth 1) with e-value of 3.9e-49 and BLAST sequence identity of 46.9
  misc_feature: SWISSPROT Homolog: NEP1_DROME Probable ribosome biogenesis protein NEP1 with e-value of 1.3e-48 and BLAST sequence identity of 47.3
  misc_feature 211810:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(284): Functional Homolog of  Ceres CLONE ID no. 40153 at SEQ ID NO. 1941 with e-value of 2.40E-96 and BLAST sequence identity of 66.5
MVRPYGKGHKKRKKGERYDKEEEEEEEEQVEEEKADSETEMRAQDGEEKTEEEKEMQLPGVEEGIPIVPSHQTGKKPGVIFVLEKASLEVAKVGKSYQILNSEEHANFLRRNKKNPADYRPDIIYQALLSILDSPLNKAGRLRAVYVKTDKGVLFEVKPHVRIPRTYKRFAGIMLQLLQKLSITAVGNREKLLRVIKNPVTQYLPLNSRKIGFSHSSEKLVQMEKYVAGVGDDTDLVFVVGAMSHGKIECDYVDDFISVSEYPLSAAWCIARVCEAVSKKWRVL

SEQ ID NO: 1900 - DNA, 849 bp, Populus balsamifera subsp. trichocarpa
  misc_feature (1)..(849): Ceres ANNOT ID no. 1528184
  misc_feature 211918:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
atggtgaggccttatggtaaagggcacaagagaaagaagaaaggggagaggtatgataaagaagaagatgaagtggaagataaacaagttgaagaagagaacactgatgatgagactgaaataagcgcacaagatgctgaagaaaaaacagaagaggaaagagaagaagtaccagaattggagggcattcctgttggcccaagtactcaaactgccaaaaaacctggggtcatatttgtgctggaaaaggcatctttggaagttgcaaaagttggaaagaattaccaaattttgaattctgaggagcatgccaatttcctgaggaggaataataaaaatcctgctgattacaggcctgacatcatttatcaggctctcctatccatcttagatagcccattgaataaggctgggtgtttgcgagctgtatatgtgaaaacagataaaggtgttctttttgaagttaagccatatgttcgtattccaaggacttataagcgttttgctggtattatgttgcagctgcttcaaaagcttagtattgctgctgttggtaagcgtgagaagcttttgcgcgtgatcaagaatcctgtaacccagcacctacctttaaactctcgtaaaataggcttctcccatagctcagacaaatttgtcgaaatggagaagtatgtagccggagttggtggtgacactgaccttgttttcgtggttggtgctatgtcccatggtaaaattgaatgtgattatatagatgattttatatcagtttcagaatatccgctgagtgctgcctggtgtattgcaaggatatgtgaggctgtgtcaaagaagtggcgtgtactgtaa

SEQ ID NO: 1901 - protein, 282 aa, Populus balsamifera subsp. trichocarpa
  misc_feature (1)..(282): Ceres ANNOT ID no. 1528184
  misc_feature (111)..(277): Pfam Name: Mra1 Pfam Description: Suppressor Mra1
  misc_feature: SWISSPROT Homolog: MRA1_SCHPO Multicopy suppressor of ras1 (Suppressor protein mra1) with e-value of 1.1e-50 and BLAST sequence identity of 50.7
  misc_feature: SWISSPROT Homolog: NEP1_MOUSE Probable ribosome biogenesis protein NEP1 (Nucleolar protein EMG1 homolog) (Protein C2f) with e-value of 1.6e-50 and BLAST sequence identity of 50.5
  misc_feature: SWISSPROT Homolog: NEP1_HUMAN Probable ribosome biogenesis protein NEP1 (Nucleolar protein EMG1 homolog) (Protein C2f) with e-value of 1.2e-49 and BLAST sequence identity of 49.3
  misc_feature: SWISSPROT Homolog: NEP1_YEAST Nucleolar essential protein 1 (Essential for mitotic growth 1) with e-value of 3.9e-49 and BLAST sequence identity of 46.9
  misc_feature: SWISSPROT Homolog: NEP1_DROME Probable ribosome biogenesis protein NEP1 with e-value of 1.3e-48 and BLAST sequence identity of 47.3
  misc_feature 212039:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(282): Functional Homolog of  Ceres CLONE ID no. 40153 at SEQ ID NO. 1941 with e-value of 6.49E-94 and BLAST sequence identity of 66.6
MVRPYGKGHKRKKKGERYDKEEDEVEDKQVEEENTDDETEISAQDAEEKTEEEREEVPELEGIPVGPSTQTAKKPGVIFVLEKASLEVAKVGKNYQILNSEEHANFLRRNNKNPADYRPDIIYQALLSILDSPLNKAGCLRAVYVKTDKGVLFEVKPYVRIPRTYKRFAGIMLQLLQKLSIAAVGKREKLLRVIKNPVTQHLPLNSRKIGFSHSSDKFVEMEKYVAGVGGDTDLVFVVGAMSHGKIECDYIDDFISVSEYPLSAAWCIARICEAVSKKWRVL

SEQ ID NO: 1902 - DNA, 1041 bp, Populus balsamifera subsp. trichocarpa
  misc_feature (1)..(1041): Ceres ANNOT ID no. 1474758
  misc_feature 212147:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
atggccatggacttgccttcgaaggcaatccgggagccttaccaggccgatgtctaccaccagctctgttcaacagaactggtccagaaaactgttcgaatcatattgctgcccaaggtttataatgtagcccaaacccacttcaacccattttcaaataacaattggctagatttattgcgagtgaagaaaatggtgaggccttatggtaaagggcacaagagaaagaagaaaggggagaggtatgataaagaagaagatgaagtggaagataaacaagttgaagaagagaacactgatgatgagactgaaataagcgcacaagatgctgaagaaaaaacagaagaggaaagagaagaagtaccagaattggagggcattcctgttggcccaagtactcaaactgccaaaaaacctggggtcatatttgtgctggaaaaggcatctttggaagttgcaaaagttggaaagaattaccaaattttgaattctgaggagcatgccaatttcctgaggaggaataataaaaatcctgctgattacaggcctgacatcatttatcaggctctcctatccatcttagatagcccattgaataaggctgggtgtttgcgagctgtatatgtgaaaacagataaaggtgttctttttgaagttaagccatatgttcgtattccaaggacttataagcgttttgctggtattatgttgcagctgcttcaaaagcttagtattgctgctgttggtaagcgtgagaagcttttgcgcgtgatcaagaatcctgtaacccagcacctacctttaaactctcgtaaaataggcttctcccatagctcagacaaatttgtcgaaatggagaagtatgtagccggagttggtggtgacactgaccttgttttcgtggttggtgctatgtcccatggtaaaattgaatgtgattatatagatgattttatatcagtttcagaatatccgctgagtgctgcctggtgtattgcaaggatatgtgaggctgtgtcaaagaagtggcgtgtactgtaa

SEQ ID NO: 1903 - protein, 282 aa, Populus balsamifera subsp. trichocarpa; identical to SEQ ID NO: 1901
  misc_feature (1)..(282): Ceres ANNOT ID no. 1474758
  misc_feature (111)..(277): Pfam Name: Mra1 Pfam Description: Suppressor Mra1
  misc_feature: SWISSPROT Homolog: MRA1_SCHPO Multicopy suppressor of ras1 (Suppressor protein mra1) with e-value of 1.1e-50 and BLAST sequence identity of 50.7
  misc_feature: SWISSPROT Homolog: NEP1_MOUSE Probable ribosome biogenesis protein NEP1 (Nucleolar protein EMG1 homolog) (Protein C2f) with e-value of 1.6e-50 and BLAST sequence identity of 50.5
  misc_feature: SWISSPROT Homolog: NEP1_HUMAN Probable ribosome biogenesis protein NEP1 (Nucleolar protein EMG1 homolog) (Protein C2f) with e-value of 1.2e-49 and BLAST sequence identity of 49.3
  misc_feature: SWISSPROT Homolog: NEP1_YEAST Nucleolar essential protein 1 (Essential for mitotic growth 1) with e-value of 3.9e-49 and BLAST sequence identity of 46.9
  misc_feature: SWISSPROT Homolog: NEP1_DROME Probable ribosome biogenesis protein NEP1 with e-value of 1.3e-48 and BLAST sequence identity of 47.3
  misc_feature 212274:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(282): Functional Homolog of  Ceres CLONE ID no. 40153 at SEQ ID NO. 1941 with e-value of 6.49E-94 and BLAST sequence identity of 66.6

SEQ ID NO: 1904 - protein, 381 aa, Arabidopsis thaliana
  misc_feature (1)..(381): Ceres CLONE ID no. 40436
  misc_feature (234)..(350): Pfam Name: NAD_binding_1 Pfam Description: Oxidoreductase NAD-binding domain
  misc_feature: Phenotype: ROSETTE LEAVES - Disorganized Rosette Useful for making plants with increased biomass
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
MSHSAVSQAGAVSVSIENQRSLRRSVFKNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKVEEYSDEIFKLLDNGAHIYFCGLKGMMPGIQDTLKRVAEERGESWDLKLSQLRKNKQWHVEVY

SEQ ID NO: 1905 - DNA, 1137 bp, Populus balsamifera subsp. trichocarpa
  misc_feature (1)..(1137): Ceres ANNOT ID no. 1441645
  misc_feature 212503:<222: Transcription Factor
  misc_feature: Phenotype: ROSETTE LEAVES - Disorganized Rosette Useful for making plants with increased biomass
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atggctcatttggctgcactttctcaggtttcctttgctgttcctgctgggagcgataccaccctaaggagacctgcttttaagattcaaaatataagctttggtgataaatcatggcaccctgcctcatctttggatttgaaatcaaggaatactgggttgaaaaaacgattgttggtatgcatgtctgtgcaacaagccagtagatctaaggttgcagtttcacctttaggacttgaagatgccaaggaacccccattgaatacatacaagcccaaggaaccttacacagcaacaattgtctctgtagagaggattgtcggcccaaacgctcctggagagacttgccatgtagtgattgatcatggtggtaatgttccctactgggaaggacagagttatggcgtaataccccctggtgaaaacccaaagaaaccaggggccccccacaatgtacgtctatattcaatagcatctaccaggtatggagattcttttgacggcaagactgctagtttatgtgtccgccgtgctgtctattatgaccctgagactggaaaggaggatccttcgaagagtggagtgtgcagcaatttcctctgcaactcaaagcctggagacaaagttcagatcactggaccttctggcaagataatgcttttacctgaggatgacccaaatgccacccacataatgattgctacgggcactggtgtagctccatttagaggttatctccggcgcatgtttatggaggctgtcccaacatacaagtttggtggtcttgcgtggcttttccttggggtggccaacaatgacagtctcctctatgatgaggaatttgccaaatatcttcaggataacccagaccatttccggtatgacaaggcactcagtagagaacaaaagaacaagagtggaggcaagatgtacgtgcaggataagattgaggaatacagtgatgagatcttcaaacgcttggatgatggagcccacatatatttctgtggactcaaaggaatgatgcctgggatccaagatacgctgaagaaagttgcggaacagagaggagagaagtgggatgaaaagctctcacagcttaaaaagaaaaaacaatggcatgttgaagtgtactga

SEQ ID NO: 1906 - protein, 378 aa, Populus balsamifera subsp. trichocarpa
  misc_feature (1)..(378): Ceres ANNOT ID no. 1441645
  misc_feature (231)..(347): Pfam Name: NAD_binding_1 Pfam Description: Oxidoreductase NAD-binding domain
  misc_feature: SWISSPROT Homolog: FENR2_PEA Ferredoxin--NADP reductase, root isozyme, chloroplast precursor chloroplast precursor  (EC 1.18.1.2) (FNR) with e-value of 1.0e-167 and BLAST sequence identity of 79.8
  misc_feature: SWISSPROT Homolog: FENR2_TOBAC Ferredoxin--NADP reductase, root-type isozyme, chloroplast precursor  (EC 1.18.1.2) (FNR) with e-value of 5.9e-165 and BLAST sequence identity of 78.5
  misc_feature: SWISSPROT Homolog: FENR2_ORYSA Ferredoxin--NADP reductase, root isozyme, chloroplast precursor  (EC 1.18.1.2) (FNR) with e-value of 9.9e-163 and BLAST sequence identity of 77.1
  misc_feature: SWISSPROT Homolog: FENR3_ORYSA Ferredoxin--NADP reductase, embryo isozyme, chloroplast precursor  (EC 1.18.1.2) (FNR) with e-value of 5.1e-159 and BLAST sequence identity of 76.6
  misc_feature: SWISSPROT Homolog: FENR_CHLRE Ferredoxin--NADP reductase, (EC 1.18.1.2) (FNR) with e-value of 3.4e-105 and BLAST sequence identity of 62.7
  misc_feature 212633:<222: Transcription Factor
  misc_feature: Phenotype: ROSETTE LEAVES - Disorganized Rosette Useful for making plants with increased biomass
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(378): Functional Homolog of  Ceres CLONE ID no. 40436 at SEQ ID NO. 1948 with e-value of 8.50E-163 and BLAST sequence identity of 79.4
MAHLAALSQVSFAVPAGSDTTLRRPAFKIQNISFGDKSWHPASSLDLKSRNTGLKKRLLVCMSVQQASRSKVAVSPLGLEDAKEPPLNTYKPKEPYTATIVSVERIVGPNAPGETCHVVIDHGGNVPYWEGQSYGVIPPGENPKKPGAPHNVRLYSIASTRYGDSFDGKTASLCVRRAVYYDPETGKEDPSKSGVCSNFLCNSKPGDKVQITGPSGKIMLLPEDDPNATHIMIATGTGVAPFRGYLRRMFMEAVPTYKFGGLAWLFLGVANNDSLLYDEEFAKYLQDNPDHFRYDKALSREQKNKSGGKMYVQDKIEEYSDEIFKRLDDGAHIYFCGLKGMMPGIQDTLKKVAEQRGEKWDEKLSQLKKKKQWHVEVY

SEQ ID NO: 1907 - protein, 272 aa, Arabidopsis thaliana
  misc_feature (1)..(272): Ceres CLONE ID no. 40501
  misc_feature (1)..(272): Also Known As Ceres CDNA ID no. 23427553
  misc_feature (1)..(272): Also Known As Ceres GEMINI ID 531H6
  misc_feature (118)..(195): Pfam Name: MBD Pfam Description: Methyl-CpG binding domain
  misc_feature (58)..(111): Pfam Name: zf-CW Pfam Description: CW-type Zinc Finger
  misc_feature 212785:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 1908 - DNA, 1032 bp, Populus balsamifera subsp. trichocarpa
  misc_feature (1)..(1032): Ceres ANNOT ID no. 1482074
  misc_feature 212865:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgcagtcccatcctggagaaactttccatgtgttaaaaaaggaaggagatgactgcactggttcacgttacacaggtcatttgaatagctctcttcaggaaccaattgaagtttcttcttcttcgaatgaggataactctgatgatacatgggatatagatgaccaatcaattgaagattcctctaaacagttggttctttatgaccctttggctaatgatgctggtgaaattgaacctgttcctcaaccgatcctgtcccaccatccatttagaagatactcagacctgaatgtgccttctagagttttgccatctgtaggagcttttactgtgcaatgtgccaaatgtttcaagtggaggctcatcccaacaaaacagaagtatgaagaattacgtgaacatattctggaagagccttttttttgtgaaactgctcgtgagtggcggcctgatatatcatgtgatgatccaacagacattgatcaagatgggagtaggctgtgggcaattgataaacctaacattgctcagccccctcccgggtggcaaaggttgctgagaatcaggggcgaaggaagtaccaaatttgcagatgtgtactatcaagcaccgtcaggcaagagacttcgctcaatggtggaaatccaaaagtacttaattgaacatccagagtatatgagagatggtataactctcacacagttttcatttcaaataccaaagcctctgcaggaaaactatgtgagaaaaaagcgtcctcgtttatcagcttcatgtcttgaacctggtgaagcaaatccccttaaatgggttggtccaggtgattgtacagaactccagcttggccggccagcaatcctacctccacccttgattcagtcctctgcttatcttcctttctactggccagtaaagaagaaagcaaggacaccatcgaaacagagtcacaggactaatccagtgtgtaatctggatgaaccaaaagttgaagagcctgatcaatctagaaatagtggttgtgatttgtga

SEQ ID NO: 1909 - protein, 343 aa, Populus balsamifera subsp. trichocarpa
  misc_feature (1)..(343): Ceres ANNOT ID no. 1482074
  misc_feature (109)..(162): Pfam Name: zf-CW Pfam Description: CW-type Zinc Finger
  misc_feature (169)..(246): Pfam Name: MBD Pfam Description: Methyl-CpG binding domain
  misc_feature 212939:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(343): Functional Homolog of  Ceres CLONE ID no. 40501 at SEQ ID NO. 1951 with e-value of 1.29E-70 and BLAST sequence identity of 63.7
MQSHPGETFHVLKKEGDDCTGSRYTGHLNSSLQEPIEVSSSSNEDNSDDTWDIDDQSIEDSSKQLVLYDPLANDAGEIEPVPQPILSHHPFRRYSDLNVPSRVLPSVGAFTVQCAKCFKWRLIPTKQKYEELREHILEEPFFCETAREWRPDISCDDPTDIDQDGSRLWAIDKPNIAQPPPGWQRLLRIRGEGSTKFADVYYQAPSGKRLRSMVEIQKYLIEHPEYMRDGITLTQFSFQIPKPLQENYVRKKRPRLSASCLEPGEANPLKWVGPGDCTELQLGRPAILPPPLIQSSAYLPFYWPVKKKARTPSKQSHRTNPVCNLDEPKVEEPDQSRNSGCDL

SEQ ID NO: 1910 - DNA, 987 bp, Populus balsamifera subsp. trichocarpa
  misc_feature (1)..(987): Ceres ANNOT ID no. 1453923
  misc_feature 213039:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgcagtcccgtcctgaagaaactatccgtatggtaaaaaaggaagcagattgctgcactgattcctgtcacacaggtcatttgcagagcactcttcaggaacccatagaagtttcttcctcaaacgaggataactctcatgatacaggggatattgatgacccatcaattgaagattcctctaaacagttggtcctttatgaccctgtgactaatggtgctggtcaaattgaacctgttcctcaacctattcagttccagcgtccatttagaagatattcagacccgaatgtgccttctagagttttgccatctgtaggaacttttactgtacaatgtgccaaatgttttaagtggagactcatcccaacgaagaagaaatatgaagaattacgtgaacatattctagaagagccttttttctgtgaaactgctcgtgggtggcgacctgatatatcatgtgatgatccaacagacatcactcaagatgggagtaggctgtgggctattgacaaacctaacatagctcaaccccctcctggctggcaaaggttgctgcgaatcaggggcgaaggaagtagcaaatttgcagatgtgtactatcaatcaccatcaggcaagagacttcgctcaatggtggaagtccaaaagtacttaattgaacatccagagtatatgacatatggtgtaactctctcacagttttcatttcaaatcccaaagcctctgcaggaaaactatgtgagaaaaaggcgtccaagtatatcagcttcatgtgattatactagacatcttcaacccggtgaaggtgattttacagaactccagcttggcaggcccgcttctccttcttttgatcgaccagtaaagaagaaagccgggacacaatcaaaacaggattacaggactgccaatccagtatgtaatcaggatggagcgaaagttgaagagcttgatcaatctagaaacagtggttctgatttgtga

SEQ ID NO: 1911 - protein, 328 aa, Populus balsamifera subsp. trichocarpa
  misc_feature (1)..(328): Ceres ANNOT ID no. 1453923
  misc_feature (108)..(161): Pfam Name: zf-CW Pfam Description: CW-type Zinc Finger
  misc_feature (168)..(245): Pfam Name: MBD Pfam Description: Methyl-CpG binding domain
  misc_feature 213111:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(328): Functional Homolog of  Ceres CLONE ID no. 40501 at SEQ ID NO. 1951 with e-value of 3.90E-64 and BLAST sequence identity of 60.7
MQSRPEETIRMVKKEADCCTDSCHTGHLQSTLQEPIEVSSSNEDNSHDTGDIDDPSIEDSSKQLVLYDPVTNGAGQIEPVPQPIQFQRPFRRYSDPNVPSRVLPSVGTFTVQCAKCFKWRLIPTKKKYEELREHILEEPFFCETARGWRPDISCDDPTDITQDGSRLWAIDKPNIAQPPPGWQRLLRIRGEGSSKFADVYYQSPSGKRLRSMVEVQKYLIEHPEYMTYGVTLSQFSFQIPKPLQENYVRKRRPSISASCDYTRHLQPGEGDFTELQLGRPASPSFDRPVKKKAGTQSKQDYRTANPVCNQDGAKVEELDQSRNSGSDL

SEQ ID NO: 1912 - protein, 286 aa, Arabidopsis thaliana
  misc_feature (1)..(286): Ceres CLONE ID no. 40508
  misc_feature (74)..(280): Pfam Name: Peptidase_S9 Pfam Description: Prolyl oligopeptidase family
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Small Useful for making plants with increased biomass and foliage
  misc_feature: Phenotype: ROSETTE LEAVES - Other Useful for making ornamental plants with modified leaves
MASGLSEIGSTKMFDGYNKRYKHFSETLGCSMTFSIYFPPSASASSSHKSPVLYWLSGLTCTDENFIIKSGAQRAASTHGIALVAPDTSPRGLNVEGEADSYDFGVGAGFYLNATQEKWKNWRMYDYVVKELPKLLSENFSQLDTTKASISGHSMGGHGALTIYLRNLDKYKSVSAFAPITNPINCAWGQKAFTNYLGDNKAAWEEYDATCLISKYNNLSATILIDQGENDQFYPDQLLPSKFEEACKKVNAPLLLRLHPGYDHSYYFIATFIEDHISHHAQALEL

SEQ ID NO: 1913 - DNA, 858 bp, Populus balsamifera subsp. trichocarpa
  misc_feature (1)..(858): Ceres ANNOT ID no. 1453626
  misc_feature 213353:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Small Useful for making plants with increased biomass and foliage
  misc_feature: Phenotype: ROSETTE LEAVES - Other Useful for making ornamental plants with modified leaves
atggaaacaaagccaagtgagatcagtagctcaaagatgtttggtggatacaacaagagatacaagcatttcagccctacactgggttgctccatgactttctacatctatttccctccatccccttccccttcccacaaattcccagtgctgtattggctctctggtcttagctgcaccgatgagaactttatagctaaatcaggagctcaacgtgttgcttcgacagagggcattgtcctgatcgctcctgatacatctccaagaggcctgaatgtggaaggagaggcagacagctgggattttggtgtaggtgctggattctatcttaatgctactcaagagaaatggaagaactggcggatgtatgactatgttgtcaaggaactgccaaaacttcttagtgaaaattttccgcagctggagacgtcaaaggcatctatatttggtcattcaatgggcggccatggtgctttaacaatctacctgaagaacctcgacaagtacaaggtgtcggtatctgccttctcaccagttgccaacccaattaattgtccatggggccagaaggctttcacaaattatcttggacccagtaaagctgattgggaggaatatgatgccacttctctggtgtcaaaggtccatgatgtatctgctaccattttaattgatcagggagatgaggataaattcttgcatgatcagctgctcccaaacaagtttgaagaggcatgcaggagtgcaaatgtttcagttctgatgcgattacaacctggttatgatcactcctactttttcattgccactttcatcgatgaccacattcaccaccatgctcatgctcttaaactttaa

SEQ ID NO: 1914 - protein, 285 aa, Populus balsamifera subsp. trichocarpa
  misc_feature (1)..(285): Ceres ANNOT ID no. 1453626
  misc_feature (44)..(279): Pfam Name: Peptidase_S9 Pfam Description: Prolyl oligopeptidase family
  misc_feature: SWISSPROT Homolog: ESTD_MOUSE Esterase D (EC 3.1.1.1) (Esterase 10) (Sid 478) with e-value of 2.2e-87 and BLAST sequence identity of 57.1
  misc_feature: SWISSPROT Homolog: ESTD_HUMAN Esterase D (EC 3.1.1.1) with e-value of 4.7e-85 and BLAST sequence identity of 56.4
  misc_feature: SWISSPROT Homolog: ESTD_PIG Esterase D (EC 3.1.1.1) with e-value of 4.7e-85 and BLAST sequence identity of 56.7
  misc_feature: SWISSPROT Homolog: YEIG_ECOLI Esterase yeiG (EC 3.1.-.-) with e-value of 4.1e-77 and BLAST sequence identity of 56.0
  misc_feature: SWISSPROT Homolog: YAIM_ECOLI Hypothetical protein yaiM with e-value of 1.6e-75 and BLAST sequence identity of 52.6
  misc_feature 213516:<222: Transcription Factor
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Small Useful for making plants with increased biomass and foliage
  misc_feature: Phenotype: ROSETTE LEAVES - Other Useful for making ornamental plants with modified leaves
  misc_feature (1)..(285): Functional Homolog of  Ceres CLONE ID no. 40508 at SEQ ID NO. 1956 with e-value of 9.39E-125 and BLAST sequence identity of 81.3
METKPSEISSSKMFGGYNKRYKHFSPTLGCSMTFYIYFPPSPSPSHKFPVLYWLSGLSCTDENFIAKSGAQRVASTEGIVLIAPDTSPRGLNVEGEADSWDFGVGAGFYLNATQEKWKNWRMYDYVVKELPKLLSENFPQLETSKASIFGHSMGGHGALTIYLKNLDKYKVSVSAFSPVANPINCPWGQKAFTNYLGPSKADWEEYDATSLVSKVHDVSATILIDQGDEDKFLHDQLLPNKFEEACRSANVSVLMRLQPGYDHSYFFIATFIDDHIHHHAHALKL

SEQ ID NO: 1915 - protein, 318 aa, Arabidopsis thaliana
  misc_feature (1)..(318): Ceres CLONE ID no. 40538
  misc_feature (1)..(177): Pfam Name: RRS1 Pfam Description: Ribosome biogenesis regulatory protein (RRS1)
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
MDTEMETEQIYQVDVGNLLAFNPNHRFSSAPSSRGELVKEILTEGTKLVQEIANKLFNFPSTETNDGPIVQLPPPTTKLPREKHIPRPKPPTKWEEFALKKGIQKRKKEKVVWDEQTNQFKRRHGYDRVNDDNDVPIIEAKESDEPGVDPFAKRLDDKKKRVGKQEKNRLQNLKAAEKAGALPSHVQLAATSLPISGTKAQPKKIGKDELGDVAGLAATSTASGGKFDKKLPGEKPPKKQGKHHKYLPVVSGRGDVNAEKEQTNNVLSKIFSKHSHEILNVGKAINMYNVKKEKKKSGRSDKLKPKKDITKKPANKAK

SEQ ID NO: 1916 - DNA, 1083 bp, Populus balsamifera subsp. trichocarpa
  misc_feature (1)..(1083): Ceres ANNOT ID no. 1452757
  misc_feature 213775:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
atggatacacaaaatgagtaccaggttgaccttggaaatcttatggcttttgacccctttcaccactttacctctattccttctgctagggaggagttagttgcagaatgtctaagtaatggcactgagctagttcaagccattgtcagtggtgttttcaacttgccttcaactgaagatatagacggtcctcttgtcaagttgccgcctccaacaacaaaactgccaagggagaagcctctgccgaagccaaaacctcctacaagatgggaacagtttgccaaagcaaaaggaataaggaaccgcaaaaaagacaaggttgtttgggatgaacaaactggtacttggaaacgtcgttatggatatgatcgtgtcaatgatgatgctgatgttcccataattgaggccaagatgaccgatgagccaggagtggatccttttgccaagagagtagcagagaagaaggaaagggttcaaaaaaaccagaagaatcagttgcaaaacttgaaaactgccgccaaagctggtgctttgcctagccatgttcagctagctgccacagccttgcctataactggaacccaggctgcaaaaaagaaatttaccaaagacgagctaggaaatgtagctggactagcttctactgcaactgccagtggtggaaagtttgacaagaagttgcgaggagaaaagcctgttaaaaatcaaggaaaacatcgcaagttcctaccagttgtagaaggttcggggattggcagtcaagaaaaggagcaaactgatagagttctaagcaaactaatctcatcgaattcacatgagattcttaatgtggataaggctgttaccatgtacaatgtcaataaggagagaaaacgaaggaatcaatatgggaagccttcttcaacaaggaaagagcaagggaagtcttcttcaacaaggaatgagcaagggaagtcttcttcaacgccaagcaaattgaaaccaaataacaaaccaatgaaggcaaagagctttccaaataaaggaaaggggagtttttcgaagaaaggaaaggggagtttttcgaagaaagggaaggcatag

SEQ ID NO: 1917 - protein, 360 aa, Populus balsamifera subsp. trichocarpa
  misc_feature (1)..(360): Ceres ANNOT ID no. 1452757
  misc_feature (1)..(173): Pfam Name: RRS1 Pfam Description: Ribosome biogenesis regulatory protein (RRS1)
  misc_feature: SWISSPROT Homolog: RRS1_ARATH Ribosome biogenesis regulatory protein homolog with e-value of 6.2e-170 and BLAST sequence identity of 99.7
  misc_feature: SWISSPROT Homolog: RRS1_HUMAN Ribosome biogenesis regulatory protein homolog with e-value of 4.9e-42 and BLAST sequence identity of 37.5
  misc_feature: SWISSPROT Homolog: RRS1_MOUSE Ribosome biogenesis regulatory protein homolog with e-value of 1.0e-41 and BLAST sequence identity of 37.2
  misc_feature: SWISSPROT Homolog: RRS1_CAEEL Ribosome biogenesis regulatory protein homolog with e-value of 7.7e-37 and BLAST sequence identity of 32.6
  misc_feature: SWISSPROT Homolog: RRS1_YEAST Regulator of ribosome biosynthesis with e-value of 3.0e-19 and BLAST sequence identity of 34.2
  misc_feature 213900:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Strong Useful for making stronger plants
  misc_feature (1)..(360): Functional Homolog of  Ceres CLONE ID no. 40538 at SEQ ID NO. 1959 with e-value of 8.19E-110 and BLAST sequence identity of 67.9
MDTQNEYQVDLGNLMAFDPFHHFTSIPSAREELVAECLSNGTELVQAIVSGVFNLPSTEDIDGPLVKLPPPTTKLPREKPLPKPKPPTRWEQFAKAKGIRNRKKDKVVWDEQTGTWKRRYGYDRVNDDADVPIIEAKMTDEPGVDPFAKRVAEKKERVQKNQKNQLQNLKTAAKAGALPSHVQLAATALPITGTQAAKKKFTKDELGNVAGLASTATASGGKFDKKLRGEKPVKNQGKHRKFLPVVEGSGIGSQEKEQTDRVLSKLISSNSHEILNVDKAVTMYNVNKERKRRNQYGKPSSTRKEQGKSSSTRNEQGKSSSTPSKLKPNNKPMKAKSFPNKGKGSFSKKGKGSFSKKGKA

SEQ ID NO: 1918 - protein, 310 aa, Arabidopsis thaliana
  misc_feature (1)..(310): Ceres CLONE ID no. 40692
  misc_feature (175)..(235): Pfam Name: WRKY Pfam Description: WRKY DNA -binding domain
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: ROSETTE LEAVES - Other Useful for making ornamental plants with modified leaves
  misc_feature (304)..(304): Xaa is any aa, unknown, or other
  misc_feature (309)..(309): Xaa is any aa, unknown, or other
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERNNTMQEVLIQQMASSLTKDSKFTAALAAAISGRXMEQSXT

SEQ ID NO: 1919 - DNA, 963 bp, Populus balsamifera subsp. trichocarpa
  misc_feature (1)..(963): Ceres ANNOT ID no. 1455695
  misc_feature 214135:<222: Transcription Factor
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: ROSETTE LEAVES - Other Useful for making ornamental plants with modified leaves
atggattcatcatgggtgaacacttctcttgatctcaacatcaatcccttcaagcatgtcaatgaaactcaagctcaagagagcaaagagtttgagggatattcaactagggttgaacagaaattacaagttaaaaaagaggctggtgttagtgctcttgttgaagagttaaatagggtgaatagtgagaaccagaagttaacagaagtgcttggtgttgtatgcgaaaaatacctgactttgcaaaaacatttagctgatttgacgagcaagaattcagaaaaagaactcatgactacaccagtaatatcaatgaagagaaaggcagagagtgaagattatagcaacttgattaatgcaattaatggaggaaacacagaaagtagttctagtgatgaagactcaagtaaaaggccacaggagaatctgaagacaaagatttcaagggcttattttccgactaatgcatccgatacaagcttggttgtgagggatggctatcaatggagaaaatatggtcaaaaggttaccagagacaatccttctcctagggcgtactttaagtgctcatttgcgccaagttgccctgtcaagaagaaggtccaaaaaagtgctgaaaacccttcaattttggtagcaacttatgaaggagagcacaaccatgctagccattctcaacctgaactatcattaggttcaagccaaagttctagttttggtccagttcccagtccatcatccatcagaacttcagttcccactgtgacccttgatttgatccaaagtggaatgcacgttgacagtgctaaaaagactgttcaagaaaaccttcaagtgccagaagttcagaaagttttggtccaacaaatggcttcttctttgacaagggatccaaattttacagctgcactggcagctgctatctctgggagattcaaccagactcggattgagaaattgtga

SEQ ID NO: 1920 - protein, 320 aa, Populus balsamifera subsp. trichocarpa
  misc_feature (1)..(320): Ceres ANNOT ID no. 1455695
  misc_feature (163)..(223): Pfam Name: WRKY Pfam Description: WRKY DNA -binding domain
  misc_feature: SWISSPROT Homolog: WRK18_ARATH WRKY transcription factor 18 (WRKY DNA-binding protein 18) (AtWRKY18) with e-value of 1.8e-163 and BLAST sequence identity of 99.0
  misc_feature: SWISSPROT Homolog: WRK60_ARATH Probable WRKY transcription factor 60 (WRKY DNA-binding protein 60) with e-value of 4.9e-83 and BLAST sequence identity of 70.6
  misc_feature: SWISSPROT Homolog: WRK40_ARATH Probable WRKY transcription factor 40 (WRKY DNA-binding protein 40) with e-value of 4.6e-56 and BLAST sequence identity of 48.9
  misc_feature: SWISSPROT Homolog: WRK47_ARATH Probable WRKY transcription factor 47 (WRKY DNA-binding protein 47) with e-value of 6.9e-31 and BLAST sequence identity of 36.5
  misc_feature: SWISSPROT Homolog: WRKY9_ARATH Probable WRKY transcription factor 9 (WRKY DNA-binding protein 9) with e-value of 2.3e-28 and BLAST sequence identity of 32.9
  misc_feature 214254:<222: Transcription Factor
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(320): Functional Homolog of  Ceres CLONE ID no. 40692 at SEQ ID NO. 1962 with e-value of 2.40E-64 and BLAST sequence identity of 57.5
MDSSWVNTSLDLNINPFKHVNETQAQESKEFEGYSTRVEQKLQVKKEAGVSALVEELNRVNSENQKLTEVLGVVCEKYLTLQKHLADLTSKNSEKELMTTPVISMKRKAESEDYSNLINAINGGNTESSSSDEDSSKRPQENLKTKISRAYFPTNASDTSLVVRDGYQWRKYGQKVTRDNPSPRAYFKCSFAPSCPVKKKVQKSAENPSILVATYEGEHNHASHSQPELSLGSSQSSSFGPVPSPSSIRTSVPTVTLDLIQSGMHVDSAKKTVQENLQVPEVQKVLVQQMASSLTRDPNFTAALAAAISGRFNQTRIEKL

SEQ ID NO: 1921 - protein, 161 aa, Arabidopsis thaliana
  misc_feature (1)..(161): Ceres CLONE ID no. 40708
  misc_feature (19)..(158): Pfam Name: UQ_con Pfam Description: Ubiquitin-conjugating enzyme
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
MTSSSSPARKALSKIACNRLQKELSEWQVNPPTGFKHRVTDNLQKWVIEVTGAPGTLYANETYNLQVEFPQHYPMEAPQVIFVPPAPLHPHIYSNGHICLDILYDSWSPAMTVSSVCISILSMLSSSPEKQRPTDNDRYVKNCKNGRSPKETRWWFHDDKV

SEQ ID NO: 1922 - DNA, 486 bp, Populus balsamifera subsp. trichocarpa
  misc_feature (1)..(486): Ceres ANNOT ID no. 1457313
  misc_feature 214432:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
atgacgagctcctctgcaacaactcgcaaggcactgagtaagattgcttgcaatcggcttcaaaaagaacttgttgagtggcaagtcaaccctccaactggtttcaaacataaagtcactgataatctccaaaggtgggttattgaagtaattggagctccgggcaccctttacgctaatgagacctatcagcttcaagtcgatttccctgagcattaccctatggaagcccctcaggttatctttcttcacccggctccgctgcatcctcatatttatagcaatggccatatttgtttagatatactatatgattcctggtcacctgccatgactgttagttccgtctgtatcagtattctctcgatgctttcaagctcccctgcaaagcaacgtcctgaggacaatgaccgatatgttaagaactgtagaaatggaagatctccaaaagagaccaggtggtggttccacgatgataaagtgtaa

SEQ ID NO: 1923 - protein, 161 aa, Populus balsamifera subsp. trichocarpa
  misc_feature (1)..(161): Ceres ANNOT ID no. 1457313
  misc_feature (19)..(158): Pfam Name: UQ_con Pfam Description: Ubiquitin-conjugating enzyme
  misc_feature: SWISSPROT Homolog: UBCY_ARATH Ubiquitin-conjugating enzyme E2-18 kDa transduction-associated protein 3 with e-value of 4.3e-82 and BLAST sequence identity of 90.7
  misc_feature: SWISSPROT Homolog: UBCY_ARATH EC 6.3.2.19 (Ubiquitin-conjugating enzyme 15) Ubiquitin-protein ligase Ubiquitin carrier protein (PM42)
  misc_feature: SWISSPROT Homolog: UBE2W_MOUSE Probable ubiquitin-conjugating enzyme E2 W (EC 6.3.2.19) (Ubiquitin-protein ligase W) (Ubiquitin carrier protein W) with e-value of 2.2e-39 and BLAST sequence identity of 51.0
  misc_feature: SWISSPROT Homolog: UBE2W_HUMAN Probable ubiquitin-conjugating enzyme E2 W (EC 6.3.2.19) (Ubiquitin-protein ligase W) (Ubiquitin carrier protein W) with e-value of 2.8e-39 and BLAST sequence identity of 51.0
  misc_feature: SWISSPROT Homolog: UBE2W_BRARE Probable ubiquitin-conjugating enzyme E2 W (EC 6.3.2.19) (Ubiquitin-protein ligase W) (Ubiquitin carrier protein W) with e-value of 1.5e-38 and BLAST sequence identity of 51.7
  misc_feature: SWISSPROT Homolog: UB2D1_HUMAN Ubiquitin-conjugating enzyme E2 D1 with e-value of 1.1e-19 and BLAST sequence identity of 38.5
  misc_feature: SWISSPROT Homolog: UB2D1_HUMAN EC 6.3.2.19 (Ubiquitin-protein ligase D1) Ubiquitin carrier protein D1 (UbcH5) Ubiquitin-conjugating enzyme E2-17 kDa 1 (E2(17)KB 1)
  misc_feature 214545:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature (1)..(161): Functional Homolog of  Ceres CLONE ID no. 40708 at SEQ ID NO. 1965 with e-value of 7.00E-81 and BLAST sequence identity of 90.6
MTSSSATTRKALSKIACNRLQKELVEWQVNPPTGFKHKVTDNLQRWVIEVIGAPGTLYANETYQLQVDFPEHYPMEAPQVIFLHPAPLHPHIYSNGHICLDILYDSWSPAMTVSSVCISILSMLSSSPAKQRPEDNDRYVKNCRNGRSPKETRWWFHDDKV

SEQ ID NO: 1924 - DNA, 486 bp, Populus balsamifera subsp. trichocarpa
  misc_feature (1)..(486): Ceres ANNOT ID no. 1487784
  misc_feature 214618:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
atgacgagctcctctacaacgacccgcaaggcactgagtaagattgcttgcaatcggcttcagaaagaacttgttgagtggcaagtcaatcctccaactggtttcaaacataaagtcactgataatctccaaaggtgggttattgaagtaattggagctccgggcaccctttatgcaaatgagacctatcagcttcaagttgatttccctgagcattacccgatggaagctcctcaggttatatttcttcatccggctccgcttcatccgcatatttatagcaatggccatatttgtttagatatactgtatgattcttggtcacctgccatgactgttagttctgtctgcatcagtattctctctatgctttcaagctccactgtgaagcaacgtcccgaggataatgaccgatatgtaaagaactgtagaaatggaagatctccgaaggagaccaggtggtggttccatgatgataaagtgtaa

SEQ ID NO: 1925 - protein, 161 aa, Populus balsamifera subsp. trichocarpa
  misc_feature (1)..(161): Ceres ANNOT ID no. 1487784
  misc_feature (19)..(158): Pfam Name: UQ_con Pfam Description: Ubiquitin-conjugating enzyme
  misc_feature: SWISSPROT Homolog: UBCY_ARATH Ubiquitin-conjugating enzyme E2-18 kDa transduction-associated protein 3 with e-value of 4.3e-82 and BLAST sequence identity of 90.7
  misc_feature: SWISSPROT Homolog: UBCY_ARATH EC 6.3.2.19 (Ubiquitin-conjugating enzyme 15) Ubiquitin-protein ligase Ubiquitin carrier protein (PM42)
  misc_feature: SWISSPROT Homolog: UBE2W_MOUSE Probable ubiquitin-conjugating enzyme E2 W (EC 6.3.2.19) (Ubiquitin-protein ligase W) (Ubiquitin carrier protein W) with e-value of 2.2e-39 and BLAST sequence identity of 51.0
  misc_feature: SWISSPROT Homolog: UBE2W_HUMAN Probable ubiquitin-conjugating enzyme E2 W (EC 6.3.2.19) (Ubiquitin-protein ligase W) (Ubiquitin carrier protein W) with e-value of 2.8e-39 and BLAST sequence identity of 51.0
  misc_feature: SWISSPROT Homolog: UBE2W_BRARE Probable ubiquitin-conjugating enzyme E2 W (EC 6.3.2.19) (Ubiquitin-protein ligase W) (Ubiquitin carrier protein W) with e-value of 1.5e-38 and BLAST sequence identity of 51.7
  misc_feature: SWISSPROT Homolog: UB2D1_HUMAN Ubiquitin-conjugating enzyme E2 D1 with e-value of 1.1e-19 and BLAST sequence identity of 38.5
  misc_feature: SWISSPROT Homolog: UB2D1_HUMAN EC 6.3.2.19 (Ubiquitin-protein ligase D1) Ubiquitin carrier protein D1 (UbcH5) Ubiquitin-conjugating enzyme E2-17 kDa 1 (E2(17)KB 1)
  misc_feature 214731:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature (1)..(161): Functional Homolog of  Ceres CLONE ID no. 40708 at SEQ ID NO. 1965 with e-value of 6.30E-80 and BLAST sequence identity of 90.0
MTSSSTTTRKALSKIACNRLQKELVEWQVNPPTGFKHKVTDNLQRWVIEVIGAPGTLYANETYQLQVDFPEHYPMEAPQVIFLHPAPLHPHIYSNGHICLDILYDSWSPAMTVSSVCISILSMLSSSTVKQRPEDNDRYVKNCRNGRSPKETRWWFHDDKV

SEQ ID NO: 1926 - DNA, 486 bp, Populus balsamifera subsp. trichocarpa
  misc_feature (1)..(486): Ceres ANNOT ID no. 1505885
  misc_feature 214804:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
atgacaagcagctccgctctgtcacgcaaggctttaagcaagatcgcttgcaacaggctgcaaaaagagctcgcagaatggcaactcaatcctccttcaggcttcaagcataaagtcactgataatctccaacgatgggtgattgaagtgaatggagccgcagggactctgtatgcgaatgaaacttatcagcttcaagttgatttccctgaacattaccctatggaagcaccacaggtgatttttgccccgccggctcctctgcatcctcacatctacagcaatggacatatctgtttagacatactgtatgattcatggtccccggctatgactgttagttctatctgtatcagcattctctctatgttatcgagctcaacggtgaagcaacgtcctgctgacaacgatcgttatgtgaagaactgtaggagtggccgatctcccaaggagacaagatggtggttccatgatgacaaggtttaa

SEQ ID NO: 1927 - protein, 161 aa, Populus balsamifera subsp. trichocarpa
  misc_feature (1)..(161): Ceres ANNOT ID no. 1505885
  misc_feature (19)..(158): Pfam Name: UQ_con Pfam Description: Ubiquitin-conjugating enzyme
  misc_feature: SWISSPROT Homolog: UBCY_ARATH Ubiquitin-conjugating enzyme E2-18 kDa transduction-associated protein 3 with e-value of 4.3e-82 and BLAST sequence identity of 90.7
  misc_feature: SWISSPROT Homolog: UBCY_ARATH EC 6.3.2.19 (Ubiquitin-conjugating enzyme 15) Ubiquitin-protein ligase Ubiquitin carrier protein (PM42)
  misc_feature: SWISSPROT Homolog: UBE2W_MOUSE Probable ubiquitin-conjugating enzyme E2 W (EC 6.3.2.19) (Ubiquitin-protein ligase W) (Ubiquitin carrier protein W) with e-value of 2.2e-39 and BLAST sequence identity of 51.0
  misc_feature: SWISSPROT Homolog: UBE2W_HUMAN Probable ubiquitin-conjugating enzyme E2 W (EC 6.3.2.19) (Ubiquitin-protein ligase W) (Ubiquitin carrier protein W) with e-value of 2.8e-39 and BLAST sequence identity of 51.0
  misc_feature: SWISSPROT Homolog: UBE2W_BRARE Probable ubiquitin-conjugating enzyme E2 W (EC 6.3.2.19) (Ubiquitin-protein ligase W) (Ubiquitin carrier protein W) with e-value of 1.5e-38 and BLAST sequence identity of 51.7
  misc_feature: SWISSPROT Homolog: UB2D1_HUMAN Ubiquitin-conjugating enzyme E2 D1 with e-value of 1.1e-19 and BLAST sequence identity of 38.5
  misc_feature: SWISSPROT Homolog: UB2D1_HUMAN EC 6.3.2.19 (Ubiquitin-protein ligase D1) Ubiquitin carrier protein D1 (UbcH5) Ubiquitin-conjugating enzyme E2-17 kDa 1 (E2(17)KB 1)
  misc_feature 214917:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature (1)..(161): Functional Homolog of  Ceres CLONE ID no. 40708 at SEQ ID NO. 1965 with e-value of 5.70E-79 and BLAST sequence identity of 87.5
MTSSSALSRKALSKIACNRLQKELAEWQLNPPSGFKHKVTDNLQRWVIEVNGAAGTLYANETYQLQVDFPEHYPMEAPQVIFAPPAPLHPHIYSNGHICLDILYDSWSPAMTVSSICISILSMLSSSTVKQRPADNDRYVKNCRSGRSPKETRWWFHDDKV

SEQ ID NO: 1928 - DNA, 492 bp, Populus balsamifera subsp. trichocarpa
  misc_feature (1)..(492): Ceres ANNOT ID no. 1495571
  misc_feature 214990:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
atgacaagcagctccgcttcgtcacgcaaggctttaagcaagatcgcttgcaacagactgcaaaaggagcttacagaatggcaactcagtcctccttcaggtttcaagcataaagtcaccgataatctccaacgatgggtgattgaagcgaatggagccgcaggcactctttatgcaaatgaaacttatcagcttcaagtcgatttccctgaacattaccctatggaagcacctcaggccactcctactatcatcaatgtatggaaggtcggttgtggtacctggaaacaaaatttactccgtccatatatactgtatgattcatggtccccagctatgactgttagttctatctgtatcagcattctgtctatgttatccagcgcaaccgtgaagcaacgtcctgccgataatgatcgttatgtgaagaactgtaggagtggacgatctcccaaggagacaagatggtggttccatgatgataaggtttaa

SEQ ID NO: 1929 - protein, 163 aa, Populus balsamifera subsp. trichocarpa
  misc_feature (1)..(163): Ceres ANNOT ID no. 1495571
  misc_feature (104)..(160): Pfam Name: UQ_con Pfam Description: Ubiquitin-conjugating enzyme
  misc_feature: SWISSPROT Homolog: UBCY_ARATH Ubiquitin-conjugating enzyme E2-18 kDa transduction-associated protein 3 with e-value of 4.3e-82 and BLAST sequence identity of 90.7
  misc_feature: SWISSPROT Homolog: UBCY_ARATH EC 6.3.2.19 (Ubiquitin-conjugating enzyme 15) Ubiquitin-protein ligase Ubiquitin carrier protein (PM42)
  misc_feature: SWISSPROT Homolog: UBE2W_MOUSE Probable ubiquitin-conjugating enzyme E2 W (EC 6.3.2.19) (Ubiquitin-protein ligase W) (Ubiquitin carrier protein W) with e-value of 2.2e-39 and BLAST sequence identity of 51.0
  misc_feature: SWISSPROT Homolog: UBE2W_HUMAN Probable ubiquitin-conjugating enzyme E2 W (EC 6.3.2.19) (Ubiquitin-protein ligase W) (Ubiquitin carrier protein W) with e-value of 2.8e-39 and BLAST sequence identity of 51.0
  misc_feature: SWISSPROT Homolog: UBE2W_BRARE Probable ubiquitin-conjugating enzyme E2 W (EC 6.3.2.19) (Ubiquitin-protein ligase W) (Ubiquitin carrier protein W) with e-value of 1.5e-38 and BLAST sequence identity of 51.7
  misc_feature: SWISSPROT Homolog: UB2D1_HUMAN Ubiquitin-conjugating enzyme E2 D1 with e-value of 1.1e-19 and BLAST sequence identity of 38.5
  misc_feature: SWISSPROT Homolog: UB2D1_HUMAN EC 6.3.2.19 (Ubiquitin-protein ligase D1) Ubiquitin carrier protein D1 (UbcH5) Ubiquitin-conjugating enzyme E2-17 kDa 1 (E2(17)KB 1)
  misc_feature 215103:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature (1)..(163): Functional Homolog of  Ceres CLONE ID no. 40708 at SEQ ID NO. 1965 with e-value of 2.19E-61 and BLAST sequence identity of 72.6
MTSSSASSRKALSKIACNRLQKELTEWQLSPPSGFKHKVTDNLQRWVIEANGAAGTLYANETYQLQVDFPEHYPMEAPQATPTIINVWKVGCGTWKQNLLRPYILYDSWSPAMTVSSICISILSMLSSATVKQRPADNDRYVKNCRSGRSPKETRWWFHDDKV

SEQ ID NO: 1930 - protein, 316 aa, Arabidopsis thaliana
  misc_feature (1)..(316): Ceres CLONE ID no. 40729
  misc_feature (1)..(316): Also Known As Ceres CDNA ID no. 23360311
  misc_feature (1)..(316): Also Known As Ceres GEMINI ID 533G7
  misc_feature (243)..(276): Pfam Name: TPR_1 Pfam Description: Tetratricopeptide repeat
  misc_feature (283)..(316): Pfam Name: TPR_2 Pfam Description: Tetratricopeptide repeat
  misc_feature 215202:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 1931 - DNA, 975 bp, Populus balsamifera subsp. trichocarpa
  misc_feature (1)..(975): Ceres ANNOT ID no. 1481678
  misc_feature 215414:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcagtgataatccgctgcagctcttgcttctcttctccaccctcctccgatcacatcatctcccccaaaccccatcttccagctggaaaattggcctctcttctgtttagagcacggaagtttacaccatcatctggagatgcttcaagtatactatctgcttctcgccataagttgccaggcagcgaaagtgtgcacataaggcctgcatcagaagggcatctgaacactgttcaagtaccgcctgtttgtgacaaatttcttgaactattgtctgctcatcagggaaacatgcaattgagatcctcggcaatggcttttcttgttactaatgccttgatgtggactaccccttttgaagctctagctgaaacatgtgaggcagatagctctatcttcaacatgcctttgctgttatttgtggcccttgtaggggccactgttggagggttgcttgcacggcagaggaaaggggaattgcagcggctgaatgagcaattacgccagatcaatgcagctctaagaaggcaagccaagatcgagtcctatgcccccaccttgagctatgctcctgttggtagtagaatactagagagtgaagtgattgttgatccaaggaaggaggatttgatttctcgattgaaagttggaaagaattttttgcggaatcaagatccagagaaggcatttgtggagtttaagtcagctcttgagcttgctcagaacctgaaggatccaacagaggagaagaaggctgtaagaggtttaggagcctcactgcaaaggcagggtaaacttcaagaagctattaaatatcactcaatggttcttgcaatctccaagagagaaggagaggaatccggaaacacggaggcttatggagcaatagcggattgctacactgaacttggtgatctcgagcaagctgccaaattttatgacaaatatattgcaaggttggaaacagactga

SEQ ID NO: 1932 - protein, 324 aa, Populus balsamifera subsp. trichocarpa
  misc_feature (1)..(324): Ceres ANNOT ID no. 1481678
  misc_feature (291)..(324): Pfam Name: TPR_1 Pfam Description: Tetratricopeptide repeat
  misc_feature: SWISSPROT Homolog: K1043_HUMAN TPR repeat-containing protein KIAA1043 with e-value of 3.6e-06 and BLAST sequence identity of 33.3
  misc_feature 215613:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(324): Functional Homolog of  Ceres CLONE ID no. 40729 at SEQ ID NO. 1974 with e-value of 2.40E-94 and BLAST sequence identity of 66.1
MAVIIRCSSCFSSPPSSDHIISPKPHLPAGKLASLLFRARKFTPSSGDASSILSASRHKLPGSESVHIRPASEGHLNTVQVPPVCDKFLELLSAHQGNMQLRSSAMAFLVTNALMWTTPFEALAETCEADSSIFNMPLLLFVALVGATVGGLLARQRKGELQRLNEQLRQINAALRRQAKIESYAPTLSYAPVGSRILESEVIVDPRKEDLISRLKVGKNFLRNQDPEKAFVEFKSALELAQNLKDPTEEKKAVRGLGASLQRQGKLQEAIKYHSMVLAISKREGEESGNTEAYGAIADCYTELGDLEQAAKFYDKYIARLETD

SEQ ID NO: 1933 - protein, 258 aa, Arabidopsis thaliana
  misc_feature (1)..(258): Ceres CLONE ID no. 40766
  misc_feature (2)..(258): Pfam Name: TRAP_alpha Pfam Description: Translocon-associated protein (TRAP) alpha subunit
  misc_feature: Phenotype: INFLORESCENCE - Late Flowering Useful for modulating flowering time
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MMNLRVLFLALLLLASPLLQVARCQSDAEDHSSLVDDVVGENTDDAVEEDDHDLDMNLSSFPGVETVCVFPKNSAKLVPAGEETELLVGLKNEGKTRVGVMGIRASVHLPYDHKLLVQNLTMLRLNNASIPTSLQATFPYIFAVSQYLQPGAFDLVGYIIYDVEGKPYQSVFYNGTIEVVESGGLLSGESVFLLTLGIGLLLLLGLWAYSQVQRLTKKTKKVSKVEVGTRSTDASLDEWLEGTTLAKTSSGKTKNKKN

SEQ ID NO: 1934 - DNA, 915 bp, Populus balsamifera subsp. trichocarpa
  misc_feature (1)..(915): Ceres ANNOT ID no. 1450499
  misc_feature 215937:<222: Transcription Factor
  misc_feature: Phenotype: INFLORESCENCE - Late Flowering Useful for modulating flowering time
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaagcatcttagggttttcttcttcgctctcctcctcctcgcttctcctctccttcaagttgctacgtgtcagtcagattcagatgctgaagtcgcagagactgcggaagaagtcagtgatcttgggattgttggtgaggatgcacaggattttggtgatgcgaattttagcccagctccaggagtcgagacagtctgtgttttccccaaaaacagtgcacgtttggtgacggctggagaagagactgaactattagttggaatgaaaaatgatggggagctgcccataactatcattgcaattagggccagtgttcatcttccttttgatcataagctactggttcagaatctctctgctcagggcttcaacaatgcaactgttccagcctctgctcaggctaccttcccatatatctttggtgtcagcaagtacttgcagcccggaagcttcgatcttgtaggcaccattgtttacgagatagaccagcatccataccaaagtaccttccacaatggtaccattgaagttgttgactctggtgttttcctaagcatggagtcggtttttcttattacccttggaattgcccttcttgtcctctttggtctatgggttaatggtcaaatacagaatctttctaagaaaactaagagggctccgaaagtggaggttggaactgggactagagatgcctccatggatgaatggcttgaggtgtgtggctttagtatagttcttcctcccatccttcttcccttgttggagaaatttcctagcctcatttatagtatcatcgggaacagcattggccaagtcacaatcccagaagttaaagaagaagaagtaaacagtggcgcatacccagtttcagctgcgcaaggcactgtagaagagtgcaagctcttgtaa

(The sequence listing continues in the following parts.)

The invention claimed is:

1. A vector, comprising:
(a) a first nucleic acid molecule comprising a plant regulatory region; and
(b) a second nucleic acid molecule comprising a nucleotide sequence that encodes a polypeptide having at least 95% sequence identity to SEQ ID NO:997 or a nucleotide sequence having at least 95% identity to SEQ ID NO:996, wherein said first and second nucleic acid molecules are operably linked and wherein said regulatory region is heterologous to said second nucleic acid molecule and is selected from the group consisting of YP0092 (SEQ ID NO:4146), PT0676 (SEQ ID NO:4120), PT0708 (SEQ ID NO:4125), PT0613 (SEQ ID NO:4113), PT0672 (SEQ ID NO:4119), PT0678 (SEQ ID NO:4121), PT0688 (SEQ ID NO:4123), PT0837 (SEQ ID NO:4132), the napin promoter, the Arcelin-5 promoter, the phaseolin gene promoter, the soybean trypsin inhibitor promoter, the ACP promoter, the stearoyl-ACP desaturase gene, the soybean α subunit of β-conglycinin promoter, the oleosin promoter, the 15 kD zein promoter, the 16 kD zein promoter, the 19 kD zein promoter, the 22 kD zein promoter, the 27 kD zein promoter, the Osgt-I promoter, the beta-amylase gene promoter, the barley hordein gene promoter, p326 (SEQ ID NO:4184), YP0144 (SEQ ID NO:4163), YP0190 (SEQ ID NO:4167), p13879 (SEQ ID NO:4183), YP0050 (SEQ ID NO:4143), p32449 (SEQ ID NO:4185), 21876 (SEQ ID NO:4109), YP0158 (SEQ ID NO:4165), YP0214 (SEQ ID NO:4169), YP0380 (SEQ ID NO:4178), PT0848 (SEQ ID NO:4134), PT0633 (SEQ ID NO:4172), the cauliflower mosaic virus (CaMV) 35S promoter, the mannopine synthase (MAS) promoter, the 1' promoter from the T-DNA of *Agrobacterium tumefaeiens*, the 2' promoter from the T-DNA of *Agrobacterium tumefaciens*, the figwort mosaic virus 34S promoter, an actin promoter, the rice aetin promoter, a ubiquitin promoter, the maize ubiquitin-1 promoter, a ribulose-1,5-bisphosphate carboxylase (RbcS) promoters, the RbcS promoter from eastern larch (Larix laricina), the pine cab6 promoter, the Cab-1 gene promoter from wheat, the CAB-1 promoter from spinach, the cab1R promoter from rice, the pyruvate orthophosphate dikinase (PPDK) promoter from corn, the tobacco Lhcb1*2 promoter, the *Arabidopsis thaliana* SUC2 sucrose-H+symporter promoter and thylakoid membrane protein promoters from spinach (psaD, psaF, psaE, PC, FNR, atpC, atpD, cab, rbcS, PT0535 (SEQ ID NO:4111), PT0668 (SEQ ID NO:4110), PT0886 (SEQ ID NO:4137), PR0924 (SEQ ID NO:4192), YP0380 (SEQ ID NO:4178) and PT0585 (SEQ ID NO:4112).

2. A method of modulating leaf development, leaf morphology, drought tolerance, phosphate use or nutrient uptake in a plant, said method comprising introducing into a plant cell an exogenous nucleic acid molecule, said exogenous nucleic acid molecule comprising a regulatory region operably linked to a nucleotide sequence encoding a polypeptide having an amino acid sequence with at least 95 percent sequence identity to SEQ ID NO:997, wherein a plant produced from said plant cell has a modulated leaf development, leaf morphology, drought tolerance, phosphate use or nutrient uptake as compared to a control plant that does not comprise said nucleic acid.

3. The method of claim 2, wherein said nucleotide sequence encodes SEQ ID NO:997.

4. A plant cell comprising an exogenous nucleic acid molecule which comprises a regulatory region and a coding region, wherein said regulatory region and said coding region are operably linked, and wherein said coding region encodes a polypeptide having at least 95 percent sequence identity with SEQ ID NO:997 and wherein said regulatory and coding regions are operably linked, and wherein a plant produced from said plant cell has modulated leaf development, leaf morphology, drought tolerance, phosphate use or nutrient uptake as compared to a control plant that does not comprise said nucleic acid.

5. The plant cell of claim 4, wherein said coding region encodes the polypeptide of SEQ ID NO:997.

6. A transgenic plant comprising the plant cell of claim 4 or 5.

7. The transgenic plant of claim 6, wherein said plant is a species selected from the group consisting of *Panicum virgatum* (switchgrass), *Sorghum bicolor* (sorghum, sudangrass), *Miscanthus giganteus* (miseanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago saliva* (alfalfa), *Beta vulgaris* (sugarbeet), or *Pennisetum glaucum* (pearl millet).

8. Seed of the transgenic plant according to claim 6 or 7, wherein said seed contains said exogenous nucleic acid.

9. A food or feed product comprising vegetative tissue from the transgenic plant according to claim 6 or 7, wherein said food or feed product contains said exogenous nucleic acid.

10. A method of producing a transgenic plant having modified leaf development, leaf morphology, drought tolerance, phosphate use or nutrient uptake, said method comprising growing a plant cell comprising an exogenous nucleic acid molecule which comprises a regulatory region and a coding region, wherein said regulatory and coding regions are operably linked, and wherein said coding region encodes a polypeptide having at least 95 percent sequence identity to SEQ ID NO:997, wherein a plant produced from said plant cell has a modified leaf development, leaf morphology, drought tolerance, phosphate use or nutrient uptake as compared to a control plant that does not comprise said nucleic acid.

11. The method of producing a transgenic plant of claim 10, wherein said coding region encodes the polypeptide SEQ ID NO:997.

12. A method of modulating leaf development, leaf morphology, drought tolerance, phosphate use or nutrient uptake in a plant, said method comprising introducing into a plant cell an exogenous nucleic acid molecule, said exogenous nucleic acid molecule comprising a regulatory region and a coding region, wherein said regulatory and coding regions are operably linked, and wherein said coding region encodes a polypeptide with an amino acid sequence that has at least 95 percent sequence identity with SEQ ID NO:997, and wherein a tissue of a plant produced from said plant cell has modified leaf development, leaf morphology, drought tolerance, phosphate use or nutrient uptake as compared to a control plant that does not comprise said nucleic acid.

13. The method of modulating leaf development, leaf morphology, drought tolerance, phosphate use or nutrient uptake in the plant of claim 12, wherein said coding region encodes the polypeptide of SEQ ID NO:997.

* * * * *